United States Patent 6,812,339 (POLYMORPHISMS IN KNOWN GENES ASSOCIATED WITH HUMAN DISEASE, METHODS OF DETECTION AND USES THEREOF) - sequence listing, part 10

SEQ ID NO: 11935 - DNA, 57914 bp, Human
acacgcaattatatccagtagaattcctgtttgctcaaatgggaagtccctagccgttactcatgttgtcttacgtctgtattgaactcttattagtttgtaaaagctttggcagaactttacaatcagatggtatgattttgcaaagccacttcctcttactaccactggtcatctgtcatttattgggctgccgtaaagcaggattccccttaaatcaaattaaattggaatcacttgagtaaggctcaggtactagtatatatatacatatatagatagatagatagatagatatatttttttttttttgagacggagtctcgctgtgtcgcccaggctggagtgcagtggcgcaatctcggctcactgcaagctccccctcccggggttcacgccattctcctgcctcagcctcccgagtcgctgggactacaggcgcctgcaaccacgcctggctaattttttgtatttttagtagagacagggtttcaccgtgttagccaggatggtctcgatctcctgacctcatgatccgcccgcctgggcccccaaagtgctgggattacaggcgtgagtcaccgcgcccagccaggcactagtatttttaaaacattctccaagtaattttcatgtgcagccagaattgcaactcaccaggctaaactgcagttgcgcaattctggtcttcttgatacctgatttctttgccccttctcttttctggttcaatgcataataagaattttccaatattagttttattagcttccacttactgaattctgcttacgggggttcctgcttagtctagatagtaagcaggaacttacaaactatgtaagcttatagactacataagcaggaaccctgtaagcaagaactcagtaagtggaagctaattaaaactacgtgccaggcagggtgccaagcattttttgtgcattatctcatttaactttcatagcaaccccgaagtaggtgccatttctatgaaacctgcccagttactgccccactccgcggaataagctcttacccaccgctcctcttcttcaattcatttctgttatggaactgtcgcggcactacaaagtctctatgtagttataaataaacgttatctggaagagcagccgacaacaactttcaagatctccaattccccgaccccacactccaactgacgccttcaaccacaactactgagccccactttcaaagctcactcactaatattggataatagttgtctgcctacctcagcctccggagtagctgggactatagcgtcttactagccagcttcagggctagaatagcctttctgtgcaagtggaaaaaacctcaggtatttcccaaatcggtagctgcagaggggctctatccctaccagagatggagaaaagccctctcgcgctttttatgtcagccagagcggctcgttaagagagcgaaggccaggggctgcacaggtcgcatcccgtgagcatgaggtcagagaacctgcccctggggcaaaccgcgaggggtgggacgggtgggtgcaggcggggcggagggtaggagccgccctagtggcggcccctgggagtgtcccgtgcctcgccttaaaggagggcgccaacgcaatttcagtatgtgggagacgggctgccccacccccgcgcgcaaaaccctggtttagcttaagggatggaggcggggacccctgcgcaggcttgcggcgtgggaggcggccgcccgcgacctacgacgccgcgcgccgggaggctgagagttcggcgccgggagggtcccggggacagaagagcgcctcgcccggttgccaaggcaaccccacgcggctggagaagccggcgctcgcagcccggcccgggccgctgccggaagtgacgcgagttcacctgccgagcgggggctgggaggaggggcggagggtgcagaggtgccgccgccgccgcgagccagtcgggagcgcgcgaggcgcggggagcctgggaccaggagcgagagccgcctacctgcagccgccgcccacggcacggcagccaccatggcgctcctgctgtgcttcgtgctcctgtgcggagtagtgggtgagtaggggccatggggtcctcagcacccgcccagcccgggggcgctcgctgcccgcggccacccaggaacaatggggcgtgggggagggggcgggcgcgatttgggggcgctgctgcaggggcggcggggcgggcagaattgcacaggggcgcttttgctgggccgggcgctcctggagccgtcccgtagggagccgcgcagggcgcgcggagtgcccggggacggagccctcggcggggggtggaggcggaggggctcgggcgcggcgtgtcgggtgcgcctcgcagctctcccatagcattctctgccccggtgcgggcttgcctttctttgctctcgccgtctcccttgtcagccttcgtgtcggttctctccagcgttacccgatttcaaaaaccttgggcggcgagttttcaggtgtcgagtcgcccaggcggggaggctgaattgcaaacgccattattcaatggacatggagctgcccggtgcctcggatcggccaggctacctctaggaaagaggcgctgagcgaacgccagcctggacggtgttagtctcctggaagcagctcgcccaggcaggagctgctaaccagacgcgcattgtgaaggagaccgtggaaaatcaaaagtgggttcctgcaaaaatgtagcattggtttctgcagtccttgggcgaagtgcaaaggagaattcagtgacctcgtttttgagtttgtaatgagtcgttcattttggagataagacgggctgagttgtacagggtaattgctagaggatttgccaagtgcgtttgtcgactgctcctttctctgggaggggaaaaaaggcatgtgaaaaatgcgtggaccattaggaggcgtaatcattttgacactttaaaaaacggattttccatgtcggtgttttaaccaactgatcttgtttgtcaaactaagcacttgctgcgttttataaccaaataattcatttttaaaaatccgtaggtgggatcctaggaggcgcacttagtatagcctctggaagggtaattttttgttgttaggtgctctgaagcaggatctagtggccctttctgttgggatggctctctgcttcctgttgaaatgttaattccattgttggatgccacagctgtgagcattactcatgggatcaacattctattagcaagtctaatcttcgatctgagcctatagcactacctccacctttttgatatatatcatttagacttggcgggctgaaatgtccaaagtaagccttccggagaagatgaagggtcatagaaccagtttacaggtacattcccacctttctttcttttttttcttttttttgtctaggccgaacctgaagatgaagttgagaacacagtgtgttctctgggaaaaaaaaaaaaatagttttagaccacatctaaagcagaaaagtggaagaacataaattatgtggaggaacttttttttttttttaaatggagtttcgctcttgttgcacaggctggagtgcaatggcgtgatcttggctcaccacaacctccgccccccgcgtttaagcgattctcctgcctcagcctcctgagtagctgggattacaggcaccccccaccatgcccggctaacttttttatttttagtagaaaccatgttggtcaggctggtctcaaactcccgacctcaggtgatccgcctccctcagcctcccagagtcctgggattacaagcgtgagccaccatgcctggcaggaactagttgttgttgttttaacgggaatatttagataattggatttaattttttttttttggaatgcctcactttgataggcacaattctaagaaataatattttgatgcagagagtcattgtgctcataaggtatacacgggtacagtgaacatctactcgaagggccagtgtctcagctaaacaaggcaactatctttattccagtttttcagtttaagaaacagctgaggccaggcacggtgcttgtaatcccagcaatttgggaggttgagacgggagggtcatttgagtgtaggagtttgagaccagcctgggcaacatggcgagaccgcatttctacaaaaaatacaacaaaataaaacccaaaaagaactagctaggtgcagtgatgcttgtcatagtcccagctacgcgggaggctgagatgggaggattgccggagcctgggaggtctaagctcatgaggtctaagatcatgacgctgctctcgagcctgggcgacagagtgagactctgtctcaaaaaaaaaaagaagacatactaattgatgaatggctttatttcttcagatatttctgaccatttagaaatgcattggtatgggccgggcgcggtggctcacgcctgtaatcccagcactttgggaggccgaggcgggcagatcatgaggttaggagatcgagaccatcctggctaacacggtgaaaccccgtccctactaaaaatacaaaaaaattagccgagcctggtggcaggcgcctgtagtaccagctgaggctgaggcaggagaatggcgtgaacccgggaggcgtagcttgcagtgagcccacatcgcgccactgcattccagcctgggcgacagagctagactccgtctctgaaacaaataaacaaaaaaaaaggcattgttattaactcaagttcactgttaacatgattgactcctactttagcaaaacaagggaaagactcattcagattataccgtcagtgatagatattcctccagctctgaaacagttttgtggtatactctggctgcagatgggactcctttcgatgcatttttattggctgcctactagtgagtcatactactagtaatcagtagtagcagcagtagtaagcagtggcagtagcagtagtagtaaaattaaacccttgatcagttatgaaatgccagatactgttctaagggctttacatacctatatattcaatccaccaagcaacccgagagggtatttattatacttatccctgttgtacaaatagagaaacagaggcacagagtcgttatataattaacttgtgaagatcacagatttgctcttgaatctgtgttctcatcacactatgctcttctgtccctacagcagccactttctcttactaccactggtcatctgtcatttattaagaacctactgttggtttgactgtgtgtcaaatactgaaggcttttattattagctctttaatgtcatagtcttaattgaatactttgaggcattgtgaggacactagtttctccagggcttgggttgacattgtaaactaatgtggcctagggacctgcagcgtcagcattacttagggatcttgttaaagtttggggtggtgttcttcaattgccaacatgaatggaactaaaaaagtctggtctcccaacctcttgttagctatttgatggtggccaagcctcactgtgtgtctgttgccttacgtgtcaagaatggggatcctggagcaggtaatgggggttgaaggtggaagggttgggtagatgttggtcaagggatacaaaattaaatccattatccaacatggtgactatagttaataacaatgtattatatttttgaaaattgctatgagtggattttaagtgttctcaccacaaaaagtatgtgaggtaatgcatatgttaattccctggatttaaccatttcacaaggcacacatatttcaaaataatgtgttatatgtagataaacatacacaatttttgtcaatgaaaaatagaaaaaaaacagaaaaataccaaatttataaaataaattgaggtgtttggatgaaaaaaaatacaagagctttgccttcatgtctgtagatctcttaatatattattggtcttgcatctcagatatcaaataaaggtacctagcttgacacaaaagttggtagctgcaaggttaagctgtattagtttgatgatgggccaggaaatgatatattttctaaattttatccttaaatattggctgtaacaaatgctgatatagcaaaacgtaagcttctattagacagcaagagggaaacttgagtgaatgaatgcaacttacctccaagtcctcttaaaggaggtaaaataataaatactgtgttttaccagtgctccccccaaagcattattctaaggcatgcaggagggtatagtgagcagctacaatagtaagatccaacccagaggtaggttcaaggccaagagtaggagagtggttgaggaaatcctcctagggccagtaccatttcatagtaatgcccatttgtgttgggggatgagtctatggcctattttcttctgattcaaaagcacattcccaatttcaaccttgctgaaaaagaggcatttttgtacctgctattaagaacagctaggatacaggataaggctggcataaaattatttagcaagcacatgctagctattccagtttgaaatctaccaaactgtaaaatcggggagaaataaaaagttgaagttgaagttgttcctcaagatgagggaacaaaatcttacaaaaggtgggattaggcactcgcttaactctatatggagaacatccttctcaagctaggtggaagatgaggaagaatattaccaaaagctgaccaggccatttggagaccaaaaggaaaggaaaaaaggcatttaggaagcaagctagtaaaagaagttcttctgggtctgactaggtaagtgaatctaagggaaccataccaaagatatgttacccattactccagcatgaagccagtggcaaaatacctcaagacattttaaacccagagaagtgtatgaaaaatatgatagttaaccaagcagattaaaatcaaaccactaaatggtaaaaatctcttcagaaatctgaaatccaagatactcacttttccattaattctgtgttttatagggggaaaagaaaagtaacaaatgtaaagattttttttatttctactggggagggaggaggataaatagaactgttttccaatttgctctccactgtatacacacatacccacacacatacataagcaaacatacgaccaaaaataccccaaacaaaaaacaaaaaaaccaggaatcaaaacccagaacaccctcaaactgctaccaatacttcatattttgtaccaaaaaaatatccctgagaggaagtgcaaaatgcaaaatcaaatgacagaaaaatgctgaacaaaccagcattattaatatacaaaatatttatattagtgaactagtaacagggtgatgttctctgtgtctgtaaaactttggaaccacatagctgatttgttcaatctagtccatgccagcttccaaaaaccaaacttttagccagcttcattctttgatgcctcatcaaaattttctacaagatcgggaacatcatcatcctcctcatcagtgtcttctggttttgctgctttactgtccaagtacttgccgtgggaactgttcagctaacttccctaaggcttgttaaactgtcagcaccaagctgacttaatattcccaggtatcatttctgtgattggtttggcttctgcatgaccagtaattgcaaaggtgttagcagaaagggaagcttggactttgggattgttgaagtgaataactgtcccatcatctttaatcatgttcatctcttcaataccaactatattattcacagccagttttttttagagaactactgaagctttttgtcatcagccatggctgttttatgtaccaccttcttctttctgcgagctgtaccccttgccccctataccggacctgaagcctgaagtttgggctaactttttcttgattcatgctgttggtaaatcctgaagcagggagggtcctccagcaccagcacgcggcaagagcaagatggctgcccgatatgccccctcttaatcttttcattcctgcgattataccaccatcagaggaaaaatgcctcccctccaaggcaagcctccctacattggctccttaccctgtctgttgtggggtctccatcgattaccaacttagctcactgcactagatcagaggacagggccattacctatattcattgttgcagtccctgcatggtcttgtggctcctggcagacagctagtgttcagcaagtcctttttgcatgactgaaagttttcaacttctttgccactaggcctgtgtgtatgatagagctctcttcagttcatcactctctcccttctcatctaataaagatggtccttacagtgattattccactagtcatgtctgagtcagtttttaatctaaagaagctgagcttctgctttatctttgacctcgttctattttttctcctgcttcagttgccaaaggttacagtaatgcatgtgccaaattggtttatctctttggaactccttgacacctattttggttctttcccaccctgttgacctgcgctttactgtcttctaaaataggtcccttaaatgtcagccttccttatagtttagcccatagtcaatcttgaccttaaacctgggtgacctcttgtatccatcatggtaatctcccaagtattggtagtgaattaaaaatattttcagctcccagcctggccaacatggtgaaaccctgtctgtactaaaaatacaaaaattagccaggtgtggtgatgtgcgtctgtaatcccagctactcaggaggctgaagcaggagaattgcttgaagctgggaggctgaggtttcagtgagctgagatcgcgccactgcactccagcctgggtgacagagcgagactccatctcaaaataaattatatgtatacacacacacacacacgcacgcacatgcacacacacacatatatatataaaatatatatttgcacctcaacccacctctgctttggatcctgggccactatttccaactgcgtaactattcaacttccattcgaatacctaacactcttcactctccaagtacactcacctgttaattaagtgatacttaatgtactgatactactatgtgcaaagccatgtgccaggtgcccctacaatagaacatgacattgcaagttgcaaaagctttggcagaattttccagtcagatggtacagcttttgcaaagacatagagatctgaagggtttgatatgtcttgggagttgagtagttcagtgcatgtaaggcacctaaccagtgcttctcaaactttgtgcatctgaatgattcttacaaggaagtctaggtggggcttgtgagtttgcattttaacaagttttacatgatgtcactgctgaccacgttttgtgtgggcaaagatctaaaggccatactgagagcttggtgggagctgacaggtctgtcaggttatgcaccctaaccccacggtactaagacatttgtggaagtgtcgagaagtaaggttatacgctgagatttattttattgaatggtagctatgtagcagttctcaaggaaggtagaactaatagagctaacacaggaatcctctgggatgatctggacgtaagcagtccctgttgaaacgcagcagaagagagttgggcttctgctttgatctggaaagcttttctgaagaagatagtagtggaacctgatgtctggttgcttgaatgagtagcatgaaaaagttggagagatttctggcttgagtgtataatgatgtcactaacctacgggaaataaaaaggagcaggttttagggagatgacaatgagcttaagtttggacaggtagtatttgaggtgcctgagaggcaaggaggtaaaaaaatatctgataggaagattgcaacacaggactggatttcaggaaagagacagacattggtgatacagacttgagaattcactgctgttaggtggcgtctgtgtaaagttaaggaggaaatgcaggtaggactagaagagaaggtgaaatgtgaggcgggggaaacatgaacttctaataagtacatgaggaagcagctgggagtaagaaggagtgataggggatataggagacctagaggatgaaggtgtcctagagaatgatgcaaaagtgaggctagtgggttttagcactgggagactgttgagaacattcagaaagttcccatggggaagacagctctgcagaggtgagagtgaagccagattttattattattattattattttgagacggagtcttgttctgttacccaggctggagagcagtggcacgatcacggttcactacaacttccacctcctgggttcaagcgattctcctgcctcagcgtcccgagtagctgggaatacaggtgcccgccaccacacctggctaatttttttatttttagtagagatggggcttcgccatgttggccaggctggtctcgaactcctgacctcaggtgatccaccctccttggcttcccaaagtgctgggattataggcgtgagccaccgcacctggccaggctccaaattttgatagaggagtgggcatcaggtaagtggagagtgaaaaataaacttcacatttgcaggtggtttgacagtgaagctttgcatgtgtggccttaattccagaggacagtagcatatcccaggggagaaggtagaagccagcagataaagactcttttaacttccctccatctaggcctacaatcttgtccacatcatcattccacaaaacatggtatttctccttaaggccaattcctgaacttcagaccttttggcttctcagggatgtcactctgttatcccatctattatatctggattccgtcaactttaaccaagcttatttatccctctttatattccttcggtactgttgtcgctttgcctttattttttatttttaaattatttatttttttgagacagtgtctctctctcttgcccacgctggagtgcagtgggctcaggtgattcttctatctcagccctcaagtagctgggactacaggcacctaggcttatttttcttctttcttccttttttttttggagacggagttttgctcttgttgcccaggctagagtgcaatggcgcgatctcgactcaccgcaacctctgcctcccgggttcaagtgattctcctgcctcagcctcccgagtagctgggattacaggcatgcaccaccacgcctgggtaattttgtatttttagtagagcgggggtttctccatgttagtcaggctggttgtgaactcccgacctcaggtgatccgcccgcctcggcctccgaaagtgctgggattacaggtgtgagccactgcgctcagcctttatttttctttattaaccagatttctggaaaaaatagcctgcatgtactgactgcattattttctttcatgcccactaattcttccatcctttgcaatctaattttcatccccttctacttctatgaaactgcagttgctgtagattgcagttgacactgtggctacatccggtggtcacatcgtatcttcagcctcttaaacctcagcacaaatagctctattgaacagtttctttctgctcttgagctattcctcatttccttttgtatggtccatttccttcgtgtaccgtaaatgccaacatttctcagtttatgggtgcagttactgtttatttgcctacagtctccagtacatttctagtctcccttctccaactttacccacatcaaaaccatccacttaatgtctctacacacacttcccacaggcatctccagctgattctgtttcacactcttctctctcatattaattggcattttcagacaccaaaatgcccaggcaaaaatatgaatatcttacttggcctttcctattttcccatctgctcatatccaatttcgaagtcattgtgtccctccagccactacctgtaatctaggttataccattctctcttcagcttgttgagatgctttcataattggcctcctgttgagtgaactttaccctgtcctccaggcacatcctgttacttactgcagcatgttctaacctttatcaagcatgccgatactgtcattgttttctcttgccagaatgtacatttcataggtcaggcactgtttacattgtattcccagtatatggcacagggcatgttcattgcataaatggggaaagttatgctagacaggaattcatgtttgtaggcttgggaaggacctagaagagaaagagcatttgaagatcaagaataggtacctcatggaagaggtgagcagggctgggctctgtgtcctgcacaggtcagctttgtgtcagctttgccaggtgttcaggagtggagtttatatcaccactcacatttagttctcctacttgcagccagttctctccccttcccttatttccacctttcatctgtcatagaagtcatcatcagatgagagttgatgctttgtgtcattaaataaaggaaataattgaggctgggaactttggattcagtttatttggtggctagcaagtagttgatgtgaagataattattaaattaaattaattattaaaataagataattattaaaataatgcagaaaacaattaaaaattatccaaccagaatgaccttatgggtttatcttactgtctttcatctaacttctgtttcttaagaaaacaaacctagtaatctagaataataattgttcaattgggtttggatttaggttggttctttttatttttctttttcttttttaaacagagtcttgctctgtcgcccaggctggagtgcagtggcgcgatctcggttcactgcaacctccgcctcccaggtttaagcaattctcctgcctcagcctcccaagcagctaggattacaggcgctcaccaccatgcccaggcgattttgtgtgtgtgtgtgcgtgtgtgtgtgtgtgtgtgtgtgtatttttagtagagttggggtttcaccatgttggccagcctggtcttgaacttctgacctcaggtgatccacccacctcagcctcccaaagtgctgggattacacgtgtgagccactgtgcctggcctacattgatctcttctgtgccttcccatttgtctttcttccctcaacttattgcctcacccattcttttttcagtagttacccagggccaggcgtggtggctcatgcctgtaattccagcacttgtgggaggccgaagcaggcggatcacctgaggtcaggcattcgagaccagcctggccaacatagtgaaaccctgtctctactaaaaatacaaaaatcagctgggcgtggtggtgtgtgcctgtaatctcagctacctaagaggctgaatcaggagctacccaggaggagaatcgctggaacccgggaggcagaggctgcagtgagccgagatcatgccactgcactccagcctgggcaacagagcaagactctatctcaaaaaaaaaaaaaaaaaaaaaaaagccagttagaggctgggagtggtggtgtgcgcctgtaattccagcactttggaaggctgaggtgggagaatcacttgagctcaagattagcctgtgcaacataacaagacctcatctctacaaaaaatacaaaaattagccacgtgtgatacaaaaattagccgggtgtggtggcacgttcctgtagtcccagctattcgggaggctgaggtaggagaatcacttgagcccaggaggtcaaggctgcagtgagctatgattgcaccaccgcactccagcctgggcgacagagtgaaaccctgtgtccaaaaaaagttagccaattagacttaaattaagcctttgagtttaagttgactcaagtttttgtagtttatttcagttggtggggtgtttgcagaagaaaagactttcttgatctattgataaaaaaaggaagataggaaaagggaaggagataatagtaacaatatttttagggtaagtgtgagatcagtggtatggttcagtttgtcctttggtacttggtgagaaaaaggattaacaattaaattaaccaacatttatacatactaagaaaatgcaaatttctttggaaacgttaaaatcattttcattctttcaaagatatttcttacaaagtggaatgggaatggttttaatttcatttacttctaagaaataaaagtatgttaagattttaagaagaaacaacataactaattgcagttattttttcactttcccatcgttagatgtgtgttctatgtgagttttagacattttcagaggaagggtggattgactgtatgtttgaagtcctctcaaggaatctcaagggacatacaatgaactaaatgtgttcagcccccacctttgttcagttgttggagtgactatcacttattctcttcagtctctctcacatgtattttaaacacttgaatactggacagttcccatgggagatttctgtcaaggaccagatacaaacttttgactttgttttgtgccagggtaattctgcaggaagaattgagaagactcttaacttactcagttgtacagtggaaatctgatacttctagaatgaacttgtaaatctggatgagcaaaatgatcatatcttatttttaaagacaattgcacacgcatctcatttagagccactctcttaaccttgggatagaaaggacacatcatattattctcatgtataggaaacaagtcctaaagcccaggcaattgtggcattggtgttagaacagtgctgtccaacagaaatataatgcaagccacatatgtaatttaaaatttgctagtagccacattaaaaggcaaaaagaaaaatgtgaaatgaaacaatatattttgtttaacacaatacatacaaaatatgcttttttccccatgtattcaaatgaaaaatattgggatattaaaatgtttttcgtactttgccagaatctggtcagtgtttgacctacagcacatctcatttgcactagccatgtttcaagtgccagcagctactgtattggtcagcactaggagttttagttccagtcatcttccaccatagtcctagaacatttaacctgaaaaagcatgggggcagtgtgccatcaaaacagctttctcaaatggaacatgcctttggaatagttctcatgagattttacttctaaaatcgttattttttttttgtcacatagtatttgtttcctgttagcgatgagctaaaatagtttcttatttcttacttaatctcttgtagtcatcaaaacatttgttacaggcacacaaaattgtatcagctctccttattccatagttaaagccaatcacatcttgagtataaagcagaaaagtatatgcataataattatatttttaatttgcctaggtggggaaataaatgcatttatggaaaggtccaaaagaagcaggatagaatggccccaggtaatggttgctggggaaatttgaattcacttagagttattaaaaaggaatctataccaagattggggcaatcaggttagacatgctcacaacagggataattttcttattggagttaactttttcttcattaacttcaggacttttctataaggaaatacactatttgctcattttgctaataacatctgtgtctatttcttggatatcttattttctgtgatcacatctttataagacacttcatctgggtgggttttggtgttttgtttttgtttttgttttgctaaatagtcacttttcctgtctcatgttaattgaagaggaagagaagcgagctgcaagttttatatgagccaggaggcaaaggaagatttccttatatggagtgatacatattattctatgaaggtgatgaaaatattcaccatggcaactgatctgccttacccataatgcaaaataccctatttgcatttattttgccagagaattctgaaattaggatctatgtagtagagaatatgaggaaggtaatatactatttcggttgaaaaggagaataatttttcttttgactcgtcaagtgcagtagtaagaaggggggaagagaagaacaaagagttggatctgtaactgtgaacaattgattgaaataattcactacttttagaccaaccaagaagaagaatagttttgaccagaattggaatttgaacgctcccccaagttgagtatgtctgtgtgctagtggagtggggaagggttgagtcacaatccagttcagcaaatctctgccaggatgtttactttttagctccccttatctgattttccattgtaaatttgtattaaatatttctgataagcagcctcaattcttgtggaagtttgagggcaaataaataatatgtacttatgggcaaggcattgtaatagttgcttcaggagatttaaatgagtaacacaccattctagtactcttggcaagcttaaatccagagggaggagtcagacaattattcgtgcagctatggtaccaggcagagcaaggcaggaatcatagcagatatgctatctgaaaatgtaaggtattctgattattccttccatgccttaactggcatctctaaaccatttttccttccaccttgggaacccctcatcctttgagacttctgccctttgcttatatctaacttatagttgctgctccttttttatttttttatttttatttatttatttatttattttttaatgagacggaatctcgctctgtcgcccaggctggaatgcagcctgcttctccttgttgacaggaaatgctcagcttcacattcaccccctgccccagcattatccggcattttagtatttacgttttacaatgcacttttctaacatccttacaccacattttcttgacctttcaaatacagtgaaaggtattttttagcaattttacttaggcagtgctctccttatgcttagttctttctttttttttttttttttttttttgagacagagtctggctctgtcgcccaggccggattgcagtggtgagatcacagctcactgcaagctctgcctcctgggttcacaccattctcctgcctcaccctctcgagtagctgggactacaggtgcctgccacctcacccagctaatttttttgtatttttagtaaagacggggtttcaccatgttgtccaggatggtctcaatttcctgacctcgtgattcgcctgccttggcctcccaaagtgctgggattacaggtgtgagccaccgcgcccggcatgcttagttcttttttcttttttcccacgctaaaccagagaccctttttttgaaatggagtttcgctcgttacccaggctggagtgcagtggcgcgatctcggctcaccgtaacctccacctcccgggttcaagcgattctcctacctcagcctcccgagtagctgggactacaggcatgcgccaccacgcccagctaattttttgtattttttagtagagacggggtttcttcatgttggtcaggctggtcttgaactcccgatctcaggtgatccgcccaccttggcctcccaaagtgctgggattacaagcgtgaggcagcacgcccggccaaccagagaccctttaatgcttagatcttcacttctaaaatcttgaactctaatatcatgcctcccagctttctcattctgcatcacaccttctccttaatatcagtgaggcctccagagccttccccaactctcacacccctactggtcttctggctactttaaaaccagaatttcgtcactagtcctggtcagactccagctcccgttcctgatgtggatcagttctccggggcagtttctttgctcctactcacggactgtgatgcacagctgtgtggcttggggaggtactttttattgtccaatttgactggactttttgtcttttttttttttttttttttttgagacagagtctcactctgtcacctaggctggagtgcagtggcgcgatctaggctcactgcaacctctgcctccctggttcaagcgattctcctgcctcagcctcctgagtagctgggattacaggagcccgccaccatgcctggctaatttttgtagtagagacgtggtttcaccatgttggtcaggctggtgtcgaactcctgacttcgtgattcacccgcctcggccttccaaagtgctgggattacaggcttgagccactgcacctggctttttttttgagacacagtttcattctccctcccaggctgcagtgcagtggcatgatcttagctcactgcaagctctgcctcccgggttcaagtgattctcatgcctcaacctgttgaacagctgggattacaggcatgtgccaccacgccctgctaatttttgtatttttaatagagatagggttttgccatgttggccaggctgatctcgaactcctgacctcaagtgatccacccaccttggtctcccaaagtgctaggattacaggtgtgagccactgcgcccggccgcctttttgaattaagtacattaataaagcgttagaacattatgtatttaacacaaagacaatttgaatttgcttttttgttgcttattccttcaggtattctaaaatttatttttaagtaaagcttttaattgaagttatgacatgcacagaataccacacagtttagaccattaatttttataaacgtacagggtagagcattgtcacaaagtggccacacctgcatacctagcaacctgatccggaaatagaacccaacccacatatcagaagccctgtcatgccccttccagtcccttcctttactatttttctttttctttttcttttttttttttaatttgagatggagtctcgctctgttgctcatgctggagtgtagtggcttgatctcgactcactgcaacctacacctcctgggttcaagcgattctcctccctcagcctcctgagtagctgggactacaggcgcatgccaccatgccaggctatttttttttttttttttttttttgtattttttagtagagacggggtttcaccatactggccaggctggtctccaactcttgacctcaagtgatcaatcacccacctcggcctcccaaagtgctgggattacaggcgtgagccactgggcccggcctccttcacccttttttccactcttttctgatttctaacaatgtagattagtgttaacattttatataaatagaattttacagtttgtgttttttgtcttattttacttctcatgttggtaagattattcatgttgtgtagctttgttttattcatttgcattgctgtgtgatattctattatgtgactgtatcacaattgatttatttattctactgatggaccctttttcccagcttttttgccattatgaaataactactgtgaaggccgggcgtggtggctcacgcctgtaatcccagcacttcgagaggccaagatgggcctatcacttgaggttagcagttcaagaccaacctggtcaacatggtgaaaccccttctctactaaaaatacaaaaattagccgggcgtggtaatgcatgcctgtaatcccagctactagggaggctgaggcaggagaatcacttgagcccaggaggcagaggttgcggtgagccgagattgcactgttgcaccgcagcctaggcgacagagcgagactcagtctcaaaaaaaagaaaaagaaaatactactgtgacattatcctacatgtgttttcatgcatatgcacataaatttctccctatcaatggaatttctgagtcctgtaggttatacataagtttcactgtggttgatactgccagttagttttccaaagctaattgtaccagttgacacttcgatcaaagagtatgaaagttccagttgcggtcaggcgcagtggctcacgcctgtaatcccagcactttgggaggtcgaggtgggtggatcacgaggtcaggagttcaagaccagactggccagcgtggcgaaaccccatctttactaaaaatacaaagcttagttggtcgtggtggcagggcgcctataatcccagctattcaggaggctgaggcaggagaatcgcttgaaccagggaggcggaggttgcagtgagctgagtttgtgccattgcactctagcctgggcgacggaacgagactctgtctcaaaaaaaaaaaaagaaaagaaaaaagaaagttaagaaagttccagttgcgctacatccttatcatggccttctttcattttgactattctggtggatgtgttagtgccatctcattataattttcttttcttattctttttgttatggaaaatttcaaatatatgtaaaactagagaaaattatttggcacatcccagtatatctttgctcagctttatcaactctcagctcatgtcggactttttctgctgctctgttgactctgatttgtttcgccattcctcctcacaggtgtctcagacttggaccagtctctaaaattctctacctacaaaatgttcagcctcttgtattttaagttaatattgtagtccccgtttgtcacagaggatatcaggtacaaattcttgcaatttcttgtactctaatgtgtaaacttaacgataagtgtgccaatgtttacatctttccttcaatctctttttggttttttagagttaaggtctcactgtattgtccaggctggttgagcaagtgatgctccctccttgtctcccgaagtgttgagattacaggcttgagctacggtacctagggtctaataaaaggtgtcttattcctgatatttgttttttgggttttttttttttttggtggtgggggacagggtctttttctgtcacccaagctggaatgcagtgatgcagtcacaactcactgcagcctcgacctcccaggctcccacctcagtctccgtagtagctgggactgcaggcatgcaccaccacgtacaactaacttaaaaattttttttttagagatggtgccttcctatgttgcccaggttggtctcaaactcctgggcctaagcagtcttcctgcctcaacctcccaaagtgttgctattacaggtgtggtgaacaggtccttattgacagttttctaggtctcattcttttttgagggcttgatcttttagtctctggtgtttggctataagatttttaacgtctcctattctatttgctttttccttttgacttataaatgtactcaatgtttcccatttcaaaaagaacctttccttgaccacatatcatacactgtctattttctcccctcatcgagaacaaatttctcaaactagtagtcatttctgtctttgctcacatctctcaagcactgtggtcagataatatcctgttgcagctccccaaaaccttcactaaatctgatttggcctaggacaccgatgatgttctaattgccaaatctagtggatacatttcagtgtcattttttttacataataaattgtgagttcttcctagtggaaggcactgctaaatgccttttaaatataaaagatgacaagacatagggttatgtatcatagtagaagtattaggcttatcagatgacagtgaattgcctactagctactatttattgaagagtgaacaccaggatgtgctgcagctgttctaagaggtttacatgtgttatttaatttctccaatgaagtaggcattattatttttaatcttcattttagagaggaaaacatctagtcacggagaggctagaaattgcctgtggccaagcatttagtgagataaatttgaatctgaacccagatctaactttagaactcctactgtttaagaaatgtctgcatttgttgggagctggactcagagaactcctgctaatgcctttgagatgtggatacaggggaggagaagaaatgattgtcagggaaggcttcttgttggttgattgatcaatgggctagaattagaacatacttagttaggtctgaaatagataatttagttcaacacccctaatttacatttgagccctagggaagcaacttgtccaaaatcatacagagcttttttgtgtaataaatttggcaacagtcagataacctagtctgacatttatttttctgtttttccaaaaaaagaaaaagtttcacccaaacccctgaaccatgtgccacctaaaatgctactagaaatgtagcatagaagaagagtataaattccaaacatttctctaccatggtgattggaataggatttctaataatgcacccattgtattttatagtgacttcagaaatgaaatctttattactgttgtatgatgttcgtggattgacttctacatacagagtgagtgtggctccagaatcagtcggcctagatttgaatcttgctccttcagtagcttagatgtgtctcagtgtgtttgtttcttcattgcaaaacacggatgcataatattagtacctttttcttggagttgttatgagaatggaaagagttaatacgtgtagggcattttgaaaagtgcttggtctgtcataagcactcagtaactgtttagttgctgtttattgttaaggtgatggtttccccatttctattccagtttatttcctgggggcctgctttttgatttctcattggggatagggagctgggaattgatatttgaaaagtacaaagaagagcaagtgtgtatacttatgccatttctcattgttactaatttatcttgctgtattaatttccttagctctgagtacatattaacagtctatactgagtaacactcgtgggaattaaagaactaaaactcctagacaatgaagagcataatttctacttccctgtattttcttctctttctcagcaatatatatatatatatatagctatatatatatatatacacatatatatagctatatatatatacacacacacacatatatatatatatatatatttttttttttttttttttttttttgagatggagtctcgctctgttacccaggctggagtgcagtggcgcgatcttggctcactgcaacctctgcctccgggtttcaagcgattcttctgcctctagctgggactacaggtgcctgccaccacacccggctagtttctgtatttttagtagagacggggtttcgccatgtgggccaggctggtcttgatgtcctgaccttgtgatctgcctgtctcagcctcccaaagtgctgggattacaggcgtgagccacggcacccggccttagcagtatttaaagccttagttggtagagttaattagtgttaacatatttaaagtgtttttcccttctagaaactgggatactcactatttagatgactttcaaatattgctaatctcaaagcaacttcctgggaagaagaaaggcaaaggttggagttagggtctggcagagggggaaaggaaatggtgcaaatagcatggtggtcacctttttgtatagagtttagagtatctcagtgacttgctaacctagacatctatagtatttgtaattaaatgcacaaaattacacttgtctttatcaatcttcttcttcattttctcgaacctctaaatctacttataaatcttttaacatactagttcctgatttgtctaacttattttcttccttttttttttttttgagaaggactcttgctctgtcaccaggctggagtgcaatggtgcaatcttggctcactgcagcccctgcctcccaggttccagtgattctcctgcctcagcctcctgggtagctgggattacaggcacatgccaccacgccaagctaatttttgtgtttttagtagagatggggtttcatcctggccaggctggtctcaaactcttgatttcaggtgatccgcctgccttggcctccgaaagtgctgggattataggcatgagccaccgcgcccggcctctaacttatttcttaaagttgctgtagtgaatcattttttgactattattgagtgtgtgttttgacacagcgtcttgctctgttgcccaggctggagggcagaggcgcagtcatggctcgttgcagcctcagcttcccaggctcaagtgattctcctattcagccttcctagtagctgggaccacaggcgtgcactaccacacctggctcatgttttgattttttgtaaatatgagctctcactatgatgtaccctgcttagatctaccatgcctggctaatttttttatttttttgtaggtatgaattctcactatgttgcccaggttggtcttgaactcctggactcaagtgatctttcctcctcagcgcctccgaaagtgctgggatggttacaggggtgagccatattattgtgtttttatagtaagtcttctgatttctatgattcgaattcagcattcacattcagaatgtgttctccctttaaaatagtaacccttatgacgggttttgacatttttcacaaagctcaatattaaataagttcttcataacatttggtattaaggtcatatcccctttccaagcaaccgaacaagcatgtaagactttggaatataaatttaagttcctcttattggctgggcacgttggcttacacctgtactcccagcattttgatagccccaggcaggtggatcgcctgagttcgggagttcaagaccagcctgaataacacagtgagaccccatctctacaaaaaaatacaaaaattagtggggcatggtggcgtgcacctgtagtcccagctactcgagaggctaaggtgggaggatggcttgagcccagcaggtggaggctgcagtgagccaagattgtgtcactgcactctagcctgggtgacagagccagactctgcctccaaaataaagaaaactcctgtttttatttgtaaaacttttcatttttttgttaatttctttggaatggcgccagatatttcgagaagaatcatgtatcagtgtgtaatcttttttcctttatttcatcctagagatagctgaaagataacagctcttttcgtctatagaatgaagaatacgtagttgtgattttagagtatccacaataaaagtttttcttaacatacttcttttatgtcaacaactatacataaagtagcatcagtgttcatttcttctcagatttgctaacatttctcatcaaaaaataagtatcctgtctttccttccatcagtatgtgaccaggctcgctcaattccctgagctgtttctcccatgtaggcttcattgttcgggttctttgcttctctggatgcacagtcaccccagggctcccttctcatgccttatggtcctctctcccatcaccggtctgccttcagatagctccttcctttcactttccctctactctgagctccctccttctacttgtccaaggctggaagggagaaggctgactgaataagtctagggacacaccctccagagaggaagcacgttcacttccagttaagttagtatgtgcttcagaatagggacatgtaaatacctagaggaaatgtataaaacagaggaggaagcaattaacactgcctgtggggatcaggggaacttctgagatgagctgacaagtaaagtgcattatttattttttttctttttgagacagtgtctcactctgtctcctaggctgaagtgcagtggtgtgatctcagctcactgcaacctctgcctccctggttcaagcaattctcctgcctcagcctcccaagtaactgggactacaggcgcccaccaccatgcccagctaattttttgtatttttaatagagacgcggtttcaccatgttggccaggctggtctcaaactcttgacctcaaatgatccgcccgtctcagcctcccaaagtgctgggattacaggcatgagccaccatgcccaacctaaaatgtattttgataaatgactagaggtgctctctggggacaaggtggagcaagagagaaaagggacttttacacatagaaggaaaagcatatgccaacagtgttccacacatgtggactgatttgtctttttccccttagtgcctcctctgatttgttgtttttattattggtcccagaccaaaacaatctcactgttgtggttcattttgttgtcaatttttttcactatttgtaaatgtaccgtcattcattcctagtgcaatttcccttctcttatacaaaggcacttgtgcctgtgaacattgttttgcctgccacttccctcagagatctcaaaattgttatctgcttacctccaggcatccagacttgcctgattgctgttttattgttacaacaaagtgctttgttgactgcttagatgtcaagacagattatgcagttatgcagttgcctaactcataattcatagctcctctctgtccctgcttgaattctacaatgagtcatgatctttaaaatccctgtgcatgtgccatcactgatcagggtttacatctagtatctttctgggataggttaaaaacacagaaaatatgtttcaaagtgttccttttgttttgtttcctcagcgatagaaaaaagaaaaccttcattcaacaaatatttgttgaatgccaagtgcccaaaattttgctctgctaaaaaaaaaccagtgatgatcaagaacagcatgagctttgccaccaaagtcaaatgtgaaatagtccctggaggcagagggtgagcgcagtttcagtaaagtgaggaaagtgcccgtgatgaaagcattgttagtgctagtccgaggagtaattagaggacatatgttctggaggaaggggctgaactgagaccatagtaagcctaaaaggtgggatggagcagaagaggaggtatctttttttttttctttttaagatggagtctctctctgttgcccaggctggagtgcagtggtgcgacctcggctcactgcaacctccacctcccgggttcaagccattctcctgcttcagcctcctgagcagctgagaccgtaggcatgtgccaccacgtccggctaatttttatattttagtagagatggggtttcaccgtgttagccaggatggtctcgatctcctgacctcgtgatccgcctgccttggcctcccacagtgctgggattacaggtgtgagccaccgcgcccagcaagaggaggtatcttacactgtgctcgtgctgagtgaggcgagatgatgatggagatgatgatggctgtattatactgtgggagtgggaagtggtaagaagctaaaggtgctagagggtggctagtcaaaggaccttgagggagaattaaggtgtctgaatcaatgaggagcgaccagagattgtcagacatgtcagtgacgtcttttttacaaaaggagttataggctggatgcagtgacccatgcctgtaattccagcactttgggaggctgaggtgggaggattacttgagccctggagttcaagaccagcttgggcaacataacgagactgcaactccactgggaaaataaaaataaaaataaaattagtgggcatggtggcacatacctgtagtcccagctccttgggaggctgaggcaggagaggatcccttgagcccaggggtttgaggccacagtgagccttggttgtgccacagcacttcagcctgggcaacagagtgagaccctgtttcaaaaaaatagataaataaaagcaattatatagagaacactctgggtgaagtatggagaacaagttagaatgagaaagtgtggttgcagggaagccagttagcaggctacatccaggccacgtgaaagataatagtggcctggatataggtaaaaatggttggatttggaatgtattaaagaggacatagtatgctttgaatgagtgaacgttgataccctgctgcctttcattttgtctccaggtttgtgcagatgattggtgatgcagctatttcttgcatctgtgatcttatgcagggattgattgccaaaagtgttggtagtaggtcacgtcactgagataaggagttcaaaggagaaatttagggttgtgctggggaaacaaacagtttgatcaaacatcatctcagcttgctgccactggtccccctgcctccaaatcaagtatgtgggttgaattataaaattacccccatattttcttgtgttattagaagtcttccagcccagctttaaaactgtcgctggtttgtgctttccttattttagattctcaggggatctacaaggatatccctattacctaaacagacttcttcctgctcttgaattttcttgtctcatatcctcatttttcttatttcagtgcctttatgatctttcacttccctcttctccttccacattagtctggattaagtaactggtattattcaacatttacttggattttgcataagaagcagttctttgatgtcattgtctgtaatgcctgttccacaggttttgtaaggatcagatgaaataattaaagccctttgcataatgcttgacttacagataagcaataaatttaaattcctgtgcacttctgtatattaatgtacataatttttttttctcctgagagggaccatccaggcagttccctcgtgtctttattggctaatggattgaaaagtacatttttccatcattttgcgaattcccaatatgtttaaatcttcttgagaatttctgctgaaatcattaccttcatgtccagttgaacagtataccctatccatgatgagaaacttcactgctctgtatgcagtctgtattagtctgctcaggctgccgtaacaaaatgccatagacaaaataccaatacaaaataccatagatgccttaaacaatagaaacttggtttttcacagctctggagtctgggcagtccaagattaagatgccagcaagtttggtttctggtgagggccctcttcctggctggtagacagctgccgtctccctctatcctcacgtggcagagagagtgctccggtatttccttctcttaagcggatgtcagttccttctgttctgggctctatgctatggcctcatttaatcttaatcacttccttaaaagccctacctctaatacagtcacataggaggtcagggattcaacatatgaattttgggggggacatgatttactctaccgccgtcccccaaaagtatttttattctattaatatatttattagtatacattatatgtttaatgttatgttccttttgaaagacctaatttcattcgatgattgtatttgctgttgggtgaatggaaccaaagctgaaggtggcaatatttagtcatacttctatttatatgagtgaaagtcagcattactccccagaagccaaattttagtagcatctttttgctggaggggactggttctacctgatctgtttgtccttgctctttgtctgaggtaggtgagcttgaatttcttactctgattttcctgactgttgttggacatttaggttgttttcagatgtttttgtgtttcagagagcatcagtgagtaatatccttgtacatatgagctgttcagttatgagagttcagctgcagttcctaaaagtggattagcacactgacatttcacacgtcttctactgcgttgacagtaggttgtgctgatttactttctgtgttgccacagtttccaacacttttgccaagattggccttattgaatttttttaaccaccgtcaattttatatttgaaatatgttacgttattctaatttatatttatttaattataaatatggttgtgtgctctcttgttaatcttttttaaaaatagactttattttgtacagcagttttagatttacagcaaaatcgagcagaaagtacagagttcccctgtacccctttcccccatgcaccaacatctccctcgcttgtcaacacgccccccaccagagtgtaccttgttaggattgatgaacccgtattgacataacattaccacctagagtccatagtttacatcggggttcactcttggttttgtacattctacgggtttggacaaatggatgacatgcagccaccattatagtattacacagaagcatttccctgccctaaaaatcctatgttccggctgggcgcggtggctcacgcctgtaatcccagcactttgggaggccgaggcgggcggatcacgaggtcaggagatcaagaccatcctggctaacacggcgaaaccccgtctctactaaaaatacaaaaaaaaaaattagccggacgtggtggtgggcacctgtagtcccagctacccgggaggcttgaggcaggagaatggcgtgaacctgggagacggagcttgcagtgagccaagatcgcgccactacattccagcccaggcgtcagagcaagactctgtctcaaaaaaaaaatcctatgttccacctattctcctcttccctctttcccctgcatctgttgattttttttttttttttactctctgtagttttgccttttccagaatgtcatatagttgtaatcatacagtggcttttttcacttagtaatatgcatttgtgtttaagtttactccatgtcttttcatggctagagtatgcatttttgacttggtatgcaatactacagaagtaatactatgttcttttctaatcaggaggtacataatgtccatttgttctggtgaaggtaaatttgatcgtttgattaaggtgatgtataccagatttcttcactgtaaagttactactttttcctctgtaatgaaagtgttttgtgggaagatactttgacattatgtaacaaatgctgtttctcatcatagctttcagcaccaattttcaatattttgcctgaaacaattattactctgtttttgccaaatggtgattttttaataagatttttagtatagttaaatttttgtcttcttccatagcttttgtgtttttctgttctacttttctctaaggctttcctcactcaaaacattattaaaaattctcatgtttacttctctttttaaaaaactagtgataacatttcatgagcactttctaatgtttatgactttaagattgccagaaggaaaagatcactgaagaccacctaggttaacaaacagcttaaatttgaaaaaacaagtgaaagaagccaacgcatgttatcagttcataacattacctcccttctagaagaatagcttcttccattctctccagtttgcttccaatcttatagtggaaccagatcttctaaggccttagtaggaggtgacatcaagggctaaaaaaatactctttgatgaactcatgtcactttgatgctcagatataagtcagactgtgcagaagagaagctttaaagatccaagtgatttagaaactggagataagaaaagcaagcagaaaactgggaaatgttatttcagtcactgccaatatgggatgtggttccgtctgtttatttacataatatgatctagtgctgtgcacttattaactagactgcaaatacttgcagcttaataatgtgccgcatattttatcacatcctgaattataaatttgaataaaattgtaagaagatctgatatttgatttaccttttaaaccgtgtttcaacctgcaagtagtttgcaagttaaattgttaatctacttgctgcataaataaaattgggcagtattaggaaagatgcccagggccgctgtctgagaccaagtgtctgtcttttgtcttatgtaatttgtgtctgttgcgtacttcagcacttgaaaaactattcctctgtgaaaagaggcccttcagtgttgctaggaaacccaggaactgttttatatgatctcaagattttaattcatttctagtgcaacacagtgaagaggaattgaaggctttaaccattttttgaaagaaaaacaaaaaacaaaaaaatctaaaagtcattaaaaaatcgttttaaaatatcataagcagcatactcatttaaaaaaatctcagaataaagcagaaatggacagttgtcttccttaaaatcctaattctcaaaagtagttgctgttaacaatttgacatatatcttttcagattattttgttacacatatatgactattttaaggcagttttttaaaattactttttatgtatcaaacgagaaagaaagataatataaaaactaagttgtattttattttgatcactttgtatagtgtaagtactgagaacatgaatttgggggatttcaacttttacaaatgtaggtgtctaattgaagttatttaacatttttatttgatttctacaaaatgaaaactctaaaaacacacagtaacccggaagtttttattgttattgatagcaattttttattctcacttatatattcttagctccatatttgaactatttcttggtttgttttggaatgagatttttatttttaagggtacttagattactcatattatttgatgcatgatgtgttaataaccaaactaaatttctgaaattgatcaaatttataattcactcattaattcttttctattatgtgcaaagaactacagcaggagatagaggtagccgcaatttgcaatttatttcagccctaatagagctaatgatttaatagtaaatcagggcatgcattttaaaagttcgcaaaaatacaaggtaacatgggaagaagataagtttctcaacatctaggaagatgtgacaggccaggcacagtggctcaagcctgtaatcccagcactttgggaggcaaaggcaggaggattacttgagcctcaggagttagagaccagcctgggtaacatagtgagacctcatctcttaaaaaaataaaaaatagaacatgtgacacaactctggatgccacctaagtcagtttcaccataaaatttatagaggaaaaaaaattccaaggcaacatatgctaagtgccgagtaagtgataccgatggtagaaagtaaagtacaatcagcattcatagagaaagaaaaatcattgtagggtggagaggtagaaatgccttaatgaatgagataggaatggaactgagtttattagaaataatagagtgtatttaggttacacatttaggagaaacacttgagattatgtacataaataccaaatcatatcattttaaatagaaacatgggcatgaaatggaggccagagtagttggacttttgggctggatcagtgggtttggatgatgtctgatcaatatttgctgtataacaaaacaactcaaactctagaggcttaaaacaaaaatcatgtattcatgatcctgtgggttgctagttagactaggctaggatggaaaattatgggctcaacagtggggctgcagagagctggtctagactagggctgagtgttcgagggttggccagacacctccgttgccccctctgtggtttgttcacacagtggccggtgaccgaggaggcaagagtgggtgcagcaagggtttttgaggcctaacctcggaactacacaggtcattcctggcacatcctgttggtcaaagctgggcaggcctcaggtttaagggagcaggtgcagataatttgaatcccaatttaaatttatttcaggagtgcatttacatgtgattgaaagcttacgatggtgcctaaacgtaaatggtgttgaatgtaaccaggattttctttagttctcagtctattggctttgactttattaaaattttattagaactgatagtctgtgtatattaagcttattttaggactaatggaaagaatcatgcagtgactaactcctcttcattttggtttgttctgtcaaaatttatttgaaaaacaacatcaagatagtcatgtggagaattaggactttggattgatttactcctaattttgctctaatgtgtttttttttttttttttttttttttggtgggagcaggggaaaagggagaggaagagagaggcaggccccgtgaaccataccatatcttagtgcttagggcctcctccaggtcatcatccagctctgaaggttgtcagagtcaggtgacataggtccaaatagagttgctcttcaacagaaagtagtgaaacttaatggttatgcacactttagatgtttgaatttatacttaagaaaatgttgggtaatcacaagtaaaccatagatgtgacaaactagtgctatgcatacttttatagtatgaataggaaaaaaagttttatgtgattgttcacttacagactaaatttgcatttaattttttaattttttgagacagagtcttgctttgtcacccaggctggagggcagtggcacgatcttggctcactgcagcctctacctcccaagttcaagcgatcctcctgcctcagcctcctgagtagctgggattacaggtgcacaccaccacacccagctaggctaacttttgtatttttggtaaagatggggtttcaccatgttggtgaaattaagttatgtaattttaagacgtcttttataaaataaaataaatgtgattattggctttttcagaagggaaataaaaagggatgaacagtaagaagtgtctcaaaaataatatgagtcaactatttggttttttttgtttttttttttttttgagacagagtttcactgttattgcccaggctggaatgcaatggcacaatgtcggctcactgcaacctccgcctcccaggttcaagcagttcttctgcctcagcctcccaagtagctgggattatagtcatgtgccaccatacccagccaattttgtatttctagtagagatggggtttcaccatgttggtcaggctggtctcgaactcctgacttcagatgattcacctaccttggcctcctgaattgctgggattacaggcgtgagccaccgtgcctggctgtacatttttaaaagataagtaaattgacagtgttccttttctttttgaattatcctcatcaaaacttattgcttagaaatatttttaagcattcaatagaaggttatagaattaaatctaataaaaatttaaagaagccttagcagaaactgtgtcacagttgatcagcatataccctaccgacagtgacttagttccctgtgtgtttgtggtgagcatgaattaatgtagccttgaatttgtatgacatgactgaccgtattagtccattctcacaccgctatagagaaatacctaaaactgggtaatttataaagaaaagaggtttgattggctctgcaggctgtacagaaagcatggctggggaggcctcaggaaacttacaatcatggcagaaggcgaaggggaggcaggcacgtcccacgtggccagagcagagaagggggaggtgctgcacacttttaaacaaccagatctcctgagaactcactcactatcagcaagggggaaatccacccccatgatccagtcacctcccaccaggcctctcttccaacactggggattacagttcaacatgagatttgggcggggtcacaaatccaacctgtatcactcacctttcagagattctagccaaattcagttttaaacatctgcttgcatatagaaaccttctaccagtagaaacttacataatgtcaggaagttcacagcgttccttaagggaattgtatcaaataagatgatactacttgtgtcattctacttttacaaaggcacaaattaaaaactgggcatctcttgagtttggactccattcctcgggacccaaaccccgtcctgtatccctcgcatcaatgtgctgcttctgaatggctgcggggcactgtgtgggctgtcagcgtatagcaaatgcttagtcccttgtacatttctttctctagatttcgccagaagtttgagtatcactactcctgaagagatgattgaaaaagccaaaggggaaactgcctatctgccatgcaaatttacgcttagtcccgaagaccagggaccgctggacatcgagtggctgatatcaccagctgataatcagaaggtggatcaagtggtaagtttgatatgtccttgctcgcttagcagctgtctgtgcaactatctgatgtgtccatcaccttgccagtcacatggatgggctgcagggagctaggaaggaagccccccaacttctcaggctttatggtctgggtgaggaaggcaattgctctggtggaaattgaggacacatgtaatggagggaaatagataatgagtgtgacctaaggttacagaagagcaaaagatcactggagttcttagagacacttcagggaagaagaggaacttatgaaagttctgacaatctggatttgaggcggggaatagcagaggcctagatggagcaggcatgacgttgagacaggagtgtgtgttgtgttaggagatggcacataactgtgctttgttaaacgttagacagaattgaaatttttaagttttacccaaggattctgtcagcagtagaagtgtcattagctatggtgtaacaactacatagtattacagtctattttccttattttttcaagttaaatatcctgtccaatgaattttttaaaagacaaaatctttttaaatttattttttttactttgactttaaaacttcccagtgtaaaaatgaagtctttagagcaaaaaacaatctataaaatatttagtcttaaatttaaaaaatcttaaaacattgtttcagtattttttctaatcaaagtaataagagtctaatgtagaaaacttggaaagccaaaaatagcacagaggaggaaacatgcctaataatctcatctccaaatatatgtcatgttttaccttttcaatggttctagaatactttatttagaatgttgcatattggctttgtctgacacatttaattttttaaaaagttaataaattatattagatcagggagaggaaaataagtccaaatatttaggtaaatatagtaatatatatatttggaagagaaattttgtttttacttcatttgttcatgtaaaagaaggggatatttaaaagttacaagtaacatccttccatttaatggctgaatcagtgcagttaggtaattaatatttttggcaaacccagtcggtttgcccttgatgtttatgttaaggaaataattaaggtgctttcccaagttgtgagtgactagagccaccccctccaaagatgtaacctctgccctgattctgttaccagaacttctttctgtttccctgagcaaaataaatcgggcctgactcattttatctactcagcctcgttgccctgttccctgtcactcttacctcccccttctctcccttctctctctctggaggtgctggcacctagagtacaggctcctgtctgaggtcctgcagttccccgttcctgtgacagtgcagtgcctgtcccgctttagagcccaggactctgatcctgtgcgtaagataggggaagcctaggaaccatatggagagcgtgggtcttccgtgcttctgctgagtgaagcttgtgaccaggtgcatgtagagaccaagaagcactgtgccctgagccattagcgtgtctgttaatgagaagaagactccaagtcgtccatgctgagtgagaggcacggctttgccgtctacaggagttgtaagataaatgtgaaactgggacttgactctgagtgaccgtttctgggttaaaaacctagcttctaacctaaaacacagtcacatcagaccaaaagaaagaagggttaggaagagattgatgcagaagaggatgcatacatggaatttaaactacatatgttaacagagcccctattttaatatatttcagctagtagacagaatggttaaaaactaggaattggaggactgagctggaaaaatttgcattcttattccttatgtgatctctttagtcagcagttactgtaaacagcgtgcttgggcagtgttttgtatactttaattgtatatacttaagccttaaaacaacatagtaaggtgagaattattatacatatggcaaggaggaaacagaggcccagagattttcatgcccagagtaacaagtgcagttgggatttgaacccaggtccctctgactctcacagctgctctgttatcatttgcactgtcctctgctgcctcccgtgtttcataaacctgtttcctcatgtgtaaagtaggaacagctatacctagcatctcagggtcattacaagaattcagcaaaatactgtattcacacgcattctgtaagcttataaatgatattgaaatgataatcatgtactgtgccaagttaaatggatctggtctgcatctttgttgtgtgacttggcaaaagctgatcagtgagagccacttctttcctcagcctaaatgtcaatgtggacaatgccatcgtccttgcagggttgtgaaggggaatctgaagacatgtaaaatttcatggtaaatttcccattccttaactaatatttataacattgttttctgggaagacactaagctagcttataaaataaccaacagcgggaatgcatcttatttctcaagccccccttaaaggactactaaggtgtgtgtggagcataatgagctattggaagtataagagattgaactctacgacctttagagttagattccacaggcaaattatgataagccttttaatcaaaggaaattaatcaaaggaagatagagtagccagatttgtggagtagtcagtgttgcttttgacaagtgggtatgtcaagaagattgagcaaataaagtaatagcttgtgtttacagagtaagtcagctgtggacccgtcaactacttcttttatttacttagcaaactggtattgagcgcaacctagatgcacacagttcatatataaataaaagatctagctgggcacggtagctcatgcctgtagtcccagcactttgggaggccgaggcaggcggatcacaaggtcaggagttcgagaccaaccaggccaatgtggtgaaaccctgtctctactaaaaatacaaaaattagcagacgtggtggtgggcacttgtagtcccagctcctcgggaggctgaggcaggagaatcgctttaacccaggaggtggaggttgcattgagccaagatcgcaccactgcactcctgcctgggcgatagaacaagactgtctcaaaaaaaaaaaaaaaagatctttggtgggttggggtggggtcagtgtggttgggaaggagataatacagaagagaacccaagttcctccactcaagaagtttctgcagaataaacctggaaaacagtgttcttagatgacatttattctgattatactgcccataattagcactcaggtaaaagaaattaattgcaggatacaggccgtagttgtgtttcctgattattatttgagttttggcatcactgctctttggcccatgggtctcgtataaccagaatgaagagatttcattagcaaaaaagaaaaattataaaatgtgttaaattaatgttagagattgttagagatgactactacagttctcttccaagaaaatattccaaacatagattttattttccctctaaagcatccagcctttagtaattgccttcaaaggctatgtgtggttcagaaaactcagtgggttaggcacaggtctttgctttagttacagaagattcattcaaaggacttgttaacctgggtacacatatcttaagaggtttattttatgattttatctgttagagtctagagccctcaagtaactccaacttagtattaagaccaaacaaagttatctttttgttagattccacaggcaaattatgataagcctttgtaggggcagggggcagtaggtacttgattttgttacacttggttggcaaactacagcctcagaggcagttgaaaaatagagtatataagaatgagcaggccaggcatggtgactcacacctataatcacagcactttgggaagccaaggcgggtggatcccctgaggtcagaagttcgagaccagcctggccaacgtggtgaaatcccttgtctactaaaaatacaaaaattagctggctgtggtggcacgtgcctgaagtctcagctactggggaggcagaggcgagagaattgcttgaacccgggaggtggagggagccgagatctcaccattgcactccagcctgggccacagacacagactccacctcaaaaagaaaagaaaaggaaaagaaaagacaacgaacaagcaaatctgtgttcttgcccaatcttactaaattgctctctaggacagtatagggctttactattttatcatgttgcgtcttggtttccccattaaaaatagaagtctgggactatacccaaggatcacattgattcctttccattttctcgttctgtggtttgggtagttttatgtttccccataatactgtgttcttctttttcttttctgggagggggcgttctgtagcagcaggtgtatccagggctcctttaagagacagttttttttgtgtgtgtttgtttttcctcctgtctaattttggctttcttttagattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttggtaagttatttttatttgtgttaacgggttactgagtaagagaatgattagtcatagtactgtagtagcagcacttgtataaaataaagcttaattttttagaataacaattttaaacacttgaagtacttctatgttggatagcatcaaatataaaactagcttttggttttggataggaaaagtaagaagtgatcaacttctttgtgaaattcataagagtttgaaaataagtgaacgagtattatggtatggaggaagaaccctaagctaggagttaggagatctagggtttttgccttgtcctcagaatttgccctgagaattatgtagaaccatgtttctatgatgaataatttaagcatttagaatggagatgaagaaatatggaagaaggaatattgaattcaagtaaggccattaggcatcacatagtatttaagcttcttggcatcactgtttttcatcattaaagtgaggagatgagacattcactgatatcttatagccctctctgtaatagttaatagggaggtagtgtaaactgctttgtaaactgccaaagactacagagtttattatccttctctagattctgtgataatgtctacaagcactcttaatcccttcaaattgagaaactgaaagataatagttcataaatatacttctaaaaccatactgtggtaagctttacacaaaatgtacattggctaccatgtagaaaaacatagctgtctagctctctgcttaatgacagtaaattcccctgtcctcatgttttaggggacacttggggattgactttcataggaaaagctgatgctagaattgtctagcatgactggaaataactgatcagggcaggcctcccacatcaacatttacctcattccttctgtttagagaactgattaggggtggggtagaatattctaaagaatactctttattttaattttaatttaatttaatattattttatttgagatggagtcacactctgttacccaggctagagtgcagtggcacaatctctgctcactacagcctctgcttcccaggttcaagtgattctcttgcctcagcctcccaagtagctgggattacaggcatgcaccaccacgcctggctaatttttgtatgtttagtagaaacagtgtttcaccatgttggccaggctggtctcaaactcctgacctcaggtgatccacccacctcggccacccagagtgctgagattacaagaatactctttaggagagcaatgttcaagatgacttgggcacccaacacttaactactcctcctacaagtagacccagcacttaactattactcctagagactaggaacaagagtggggatttttgtgtaccttcatggcaaattcatgcattgtcttggtagatagactctgctggcagcatcattgaatggggacctgaagaggtcctggtgaaatgcatcattctgaatcgcactaactaaaaatgtttcttgtggtgtgaaagtaagtcaatctaaaaaaggaaccaggaaaaggaatatggtaatgttggaaatttgaattttctgtgtcttcattgagtaaacatggagtaacttttctttgttataaatgtataagcaagtgaaagattaacacctggtccgaattcttttttttttttttttttctttttgagaccaagtctcgctctgtcacccaggctggagtgcagtggcatgatctcggctcacggcaacctccgcctcctgggttcaagcaatactcttgtcttgccgtcctgattagttgggactacaggtgcccgccaccacacctggctgattttatttttggtagagacggggtttcaccatgttagccaggatggtctcaatctccagacctcgtgatctgcctgccttggcctcccaaagtgctgggattacaggtgtgagccaccgcacccagctacctggtctgaattcttatcacagacccaggaattcctgagattataaccctgactatactttcttccaacactgctctctaggaactattaagttggaagatgtatacggaatattaactggttcatgatatgcgaagcagaagatatttgattatcggaattatttattgtgaaacccctgtttgatgggacagttacactgggattaatggggttggcacatattcccagaagagttgtggacaagcatgtttgtgtgtttgtgtattgtctggatcctgtgggaccaggttcagggtcacatttgcagttctcaactgaagagaacattacagcagaacatgtcccaaaaaggaacctgagttgggtggtaggggatggcacatgatgtggctcagttcactcatggcaggagccgtgactgcccggcagtaggaatggcctttttatattaaactttgaaccccagcatgtcctaagaatgggtaagtgggaagcattgacacagttcaccctgagttactcctggggagaattttatagccaagtcagccttcagttcaaaccaaggagggggagaggggataaactggggatgagaggagaaagcagggaagtgattgccgaagagaagtagggacgactggagctctgatctggacgaggttgtgtcagagccagagaattccttgtagctttttcttccatgtttttagatgagtcgtgactgctgctgggagaaaccaccagaattatattctctcgaaggtgaaaattaattggattgaagcttatctgttagttttgcctggaaattctgcctggattatctggggcaaaagataagatgaagtgccctctagtgacccaactaagtggtggtcactggagctcatttgattgactgatagtggctctgtctaatgctttggttcttttgtgggaaatctgaagtagttgccatcatggcattcacagggtaatggcagtgcattcattgagcttgtgtgttatgtggccgttaacccacagagatgattgatagtcgtctggatgtgaggggcagcatgttgctgtagcttgctccattgccgtgcctgccttgctctttcagacacagcagaagctcttgtggatgcagctcagtaaagaagcagaagtgggaaatgataacaaagagagttgatagaaggttactgttgtggccatatatcacgggcaccttcccctggagctctggaagggcctgtttattgaaaccttttggtataaagagacagagttgttttgaagagcagaacatgcacagttaacaattcctggacatatatggtatactcccactgcaccatgccacagtggcagcagcaagtgtagtggctcagtcatcactggccttaaaggtcctaagggatttgcaaaccattgatactgggcacggcccctcactactttttattttacaataatttttagttttatggaaaagttgcaaaaatacaaggaagtttctgagagtggatccatcatctaatttcccctaatgttaacatcttacaaaatcatattataattatcaaaaccaggaaattaacactgatacaatactattaactaaattacagacccagtttgaattttactgttttccggtaatgtcctttttgtactaggattgcatctagaatccacatggcatttatatctccttaatctcctccagtcacgtctgggggcacatgatgtcatgtcttattgttaatcgtgatcgcttggtttaagttttatctgatgggcttctccactctagagttattatttttccctctataattaaaaaatgtcttgggggagctacttcgagactatgcagatatgttatttcttatttaacttttgcctattgattttagcatctattgatagattttgcctggagtcagggtatttttgaaccaataagaaattatatttcttggaaggatgacatcatgataaaagtatcccctgtctcatgtagggatttagagattatttccagtagactggtgcagccactagcaggaaaagatgatgaaggaatacgtgtatggaacagagcattactaaattggtgggataccatgtccaactacaacttgatggtcacatacccatatctgagaaggactgttgtttgtgttagtgatcatggaagcagatgttctgaggacagcggccagtatgtgggaagtccagaccaaagaaacatttaggagacaagactttattcgtgctctctttgtggttttcttctgttccagcagagtaccatgggttaagaattaatcttcctcgtagtgtaatggttggatgttggcatgtaaaagacttgtacttcctcttcccagtggaaagcaggtgggccactccaaagtgtcattcagaaacctgtgttggtagaatcttgttttattgtggacgggttgtagtgaggccctgaatttcctagcagctattttaaataactatccgttattagatatgtttagattgctggttatatgggagaaaatggatatagaaaggatgagcgttagagttagaataccatattacccatagatgtttgatgcacaaagcattgcatcagttatttatttgctggtaatttattctaataaaggatttattggtagtttgaagaactggaagagaacaaggctcatttcattgaagactcccagaatgaaataatttgcaaaacttatttaaaagtccaattgatgtagtctccagagcacctggtcagattgaaaaataaacagatttgtttggaaaaatcaacagtgcagttaaatatgtgttgacccttatttttaaaatgtaagtaggagcagatgaaggggaatacaattaaatttgttaaggagttactaagaaagagtaaggtcatggttgataaccttagttgaagataccccactgaatatgataaatcatgttgagccagttttgggaaacaatttgacaatttcttacagtgttaaaatatgtacagtcaccatatgatccagcagttactaagacaaaggaaagcatacgccagtgttcacatgagtgttcaagcagcattattcataatactgcaaaacaaaaatgcatttacctttattcatagtagtgaaagaataaaaacccattcacgactgaaaaaatgaaaatcagcttaaactaaaaaagaaaaaagtcttgacgtttatcagccggaaggacagatacagattaaagtcagccacagagtttatagaaaacattgtctctcccaaggttatagagtagtagtaaagcatagactattgctgtcttttctagtgttgcccgcagacccacatttctctacccatcctttactggaatactcaattactaaatggccccacctcctcacagctcccacttcctgtttaatcctcatttttcctaatctcagaaacagctgattgacagctgatggctacttccttacaacctcctgagaatccttcagcatccctgctcttgtccagtggcattccgtggttcctcgtaatgccgtcctcactagtcaatctgattttgatagaccacacacttgctccttgtcagtttggctgactgggctttgacagtagccccaaactggaaacacagtattcattaacaggtgactggataagcaaacttgtgttatagtccattgaaatactaaaataactatatatacaataacggctcaatctcagaaatgttatgctgaataaaagaagacaagaaaatacatactgtagtattctattcatgtggttccagaagaagagctaatctacagtggtagaatctgatcagtggcttcctgggtccagggttttggagtcccatctattgtaaccagcatgagggaacttccttgggagagggttggagtggtgcttaatggatatagacacatttattaaaagtgatcagcccacgtgattaacatgttaactttattgtgtgaatattataccttattaaagttcagcagaagagtatgcaatgccaaggtgttaatccaggattggggtgagttgcaggtaatggagttagtagttgttctaaacagttacccagaaacacctggaatataacctcagatttcctttttttttttttaattaaatattcttttttacacatgaatttccaggctgtgaatatctttttgattcagggtctggttctgtcacctaggctggagtgcagtgacatgatcaaagcttcactgcagcctcaaaatcctggtctcaagtcatcctcctaccccagcctcccaagtagctacgaccacaggcacacatcaccacacccagctaatttttcgaagtttttattatgacagagtctcgctatgttacccaggctggtctcaaacccctgacctcaagtgatccccccactgtcttggcctccaaagtgctgagattacactatgcccagcccaggttttcttttttgtagcctgctctttggatggatttgaggtgatgtaaatgcagaatgctagttgttccttgccacactaagtgttgttagtattgttgatgataaactgcctgattgtcagggttatggcgcctagagggatgtgacttggtacatactgccagagggttacatgtcaggcatggggaagaatagctaaggaatgggagggggagcttccttgactctcaagtggtcttgctgaaaaaagcaagtgcatcattcttgctttttttcaggtgtgccccatgaaatggacaggcaccgagctatgcctgagatattgccatatctactaatgcagtggctgcttgtctgagcttattctttgctgttttgtgtcagataaagctgaataaactgatgttgatcacttactgtggtctttcattcttttgtgaattctgaacccagaaccaactgataatgagtcagtggttgtgtacaatgctgtattcataaaagtaagttccattctcttatgtaaatttataatttgttttctctttcagttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcaggtactgctgataatagtatttgtaccacatgccattgatttggactaagatctagtaggggtgtgtgtgtgatttgagatagggccttgctctgtcacccaggctcactgcaatcacggctcactgaagcttcaacctcctaggctcaagtcatcctcccacctcagcctcccagttagctggaactacaggtgcatgccatcacaccctgctaattttttttttaaaaaatgtgtagagacaggatctccctgcgttgcctgtgctggtctcaaactcctgggctcaaggagtcctctttccttggcctcccaaagtgctgggattacaggcatgagcccaggcatgtgcccagcctgcttgtatattgtagattcccagatgctttctttcccttttctacatagaataatcaggatttccataggaattattcagtgttttataatatcaatttagtgtcatatattataaatgaagagctattctatgatttcatttttttaggatattagttactttggtacttttttttggttttttttttttttttttttttccgagacaaggggtctcgctctgtcacccaggctgggcgtgcagtggtagaatctcggctccctgcagtcttcacctcccaggcttaagtgagcctcccacttcagcctcccgagtagctgagactacaggcatgtgtcaccacaccctgctaatttttgtattttttgtagagatggagtttctgcatgttgcccacactggtctcaaactcctgggctcaagctctccacccacctcagcctcccaaagtataggtgtgggccattgcgcctggcgaattttttttttttaattgatgagacatgttcatgattacaacttagatggtggctaaagtatagtaagagttggctctttagtgttttgcctagattgaaaatatagtaatttacccatggtgtgtctgtaaattaaaagaaaacccgtgtgacactaactagaaagttacaaattggccaaatctgctcacctatttgttataattgacttcttagttcaaactgatgaccaggctccaccccgccatccactgcatcctggtctttagtaggttttctctctgcctctctgtttttcaaactaagagaccaatctgggagtcctcttctgacttccttttgtatgtttcttccatctaggggggaataaaataggttttgtatgttttcctgctgcaggaaagatcctttgtggaatgcggtagcgtttatagtcttatgtgccccaagatgggtttgcagcagctacacagtggaccagcacccctgctccagctgaggctgtgtgctgcaggggatcatggttactttcaccttgatacatgtgaactggaagcatgattgaattctggaaacatctgtgtggctcaatgccagtttgcttgcatccagccttggtctgtcttgcttttaactggattgtttaatttggagaggactatgtttactaacacctgataacaatacatactataaaaatgagtttgttttctttttcctccttccatagaaatgacttcatctgttatatctgtaaaaaatgcctcttctgagtactctgggacatacagctgtacagtcagaaacagagtgggctctgatcagtgcctgttgcgtctaaacgttgtccctcgtaagttatcttctttctgttggtggttttgtttctgttatctttataccacctcctttagttcagtcagcaagtgtgtattaaggacaaagggacactgactttgatcagaacactgtggtttgattattagcttttctagaaaaatacattttattaaaaaaacttcataattgcaatgatatattaagaaggtaagagttgtcaaatcaacccttgtaccatatttagctgttataagtatgagtagcttagaacattcttatatgttaaccaagatagctttgaatattaaaatctttcagacaggttttatcattttaatgcttggaatagattatacagttcagaagacagttctttttatgaatttttcccccggatcaaaaagactaaataatttgtcttaaagttaacacatgtgatgaaatcaatctaaaaatgtatagcctaccttcagtatctatacatgtatatatgtatatattttttactattaattcttcttattttagcttcaaataaagctggactaattgcaggagccattataggaactttgcttgctctagcgctcattggtcttatcatcttttgctgtcgtaaaaagcgcagagaagaaaaatatgaaaaggaagttcatcacgatatcaggtaattaagtgagacaggagttgactgatgtataccaaatatatgtcatttctctaaagcattcgttctcttattaaccacccaaagcatctttcttaggagaatgggtaaaagctctggccgccttctcaatacatttgaaagcatttacttctaactgcaagtgcagagctccaaccaccattcgttgtgccccgctccccaaccttctcgtaccccattttaagaaccactgccaaatgattatctcaagactgcctgcttcttgagaagaatccctgcctgcagtggtagggatgaagtagatattgaggtttgaaaaaaaaactgacctgattgtatcaagtaatctggaagtttgtagaacaattggtagtataatttttattttccttaaatattctaaatcagtaggtcttaacgagaagtgtgcatattagataatagaattttagaagtaataacacatgacttcacaccctagaaattgacatttggcaggtctagggtggggtctggacacttgtacaggcacacttcagagttatcgcacactgcgataaatcacatgaatttttttgtttttccagtgcataaaaggttatgtttatactatattgtagtctaaaatgtgcagtagcattatgtgtaaaaaaacagtgtagataccccaattaaaaaaatattgctaaaaaatgctaatgattatctgagccctcagtgagtcttaatctctctgctggtgaaaggtcatgcctcactgttgatgactggtggctgatcaggatggtagttgctgaaggttgcagtggctatggcaatttctttctttggttgttgggttttttgttgtttgttttctgagacaaggtctcgctctctgttgcccaggctggagtggagtgatacaattatggcccactgcaacctctgccccctgggttcaagtgatcctcccacctcagctttccgagtatctgggactacaggcataagccaccacacctgactaattcttgtattttttgtagagatggggtttcaccatgttgccaagggtggtctcgaactcctgggctgcattggctcctgccaagatgtcaacctgtcctttaaagctttgaagccagacattgacatctttagccactaaaggcctagatggtgtcttcttccagtagaagtctgttttgtctctattgaaaatctgttacttagtgtagttaccttcatcaacgatcttttaactagatcttctggataactttctgtagcttcttcatcagcactttgttgcttcactttgtatttttatgttatggaaatggcctttttccctaaactcattaaccagcctctgttagcttccaacttttcttctgcagctgccttagctctctcagccttgatagaattgaatagagttagggccttgctctggattgggctttggtgtaagggaatgttgtgactattttgatcctctatccagaccactaaactttctccatatcagcaataagactgcttcactttcttatcgttcacgtgttcactggagtaacactttgactttactttaagaactttttctttgcatttacaatttggtttggctgtttggtgcaagatactagctttcaaccagtgttggttttcaacatgctgtcctcactaaggttaattatttctgggttttgatttaaagagagccttgctgatgattgcttgactccaggagtttgagcttgcagtgagctaggatcgcaccactgcaccctagcctggttgacagtctcaaaataaataagatatttttttaaaaagtagagccatgataactattccttttacttgaacacttagaggtcattgtagggttattaagtggcctaatttcaatatcattgtgtctcagggaatagggaggcctgagggaggggtgagagatggggaggatgttgggggggatggccagaacacacacaacatttattaagtttgctgtctcttatgggcatcattcatggtgccccaaaacagttaaaatagtaacatcaaagatcactgatcacagatcaccctaacaggtatgattatgagaaagtttgaactgttgtgagaatttccaaaatgcaacacagacatgaagtgagcacatgctgttggaaaaatggtactggtggccgggcacggtggctcacacctgtaatcccagcacttagggaggccgatatgggtggatcacgaggtcaggagatagagaccatcctggctaacacggtgaaaccccgtctctactaaaaatacaaaaaattagccgggtgcagtggcgggcgcctgtagtcccagccactcgggaggctgaggcaagagaatggcgtgaacccgggaggtggagcttgcagtgagctgagatcacgccactgcactccagcctgggcaacagagcaagactctgtctcaaaaaaaaaaaaaaaaaaaaaggtattgatacatttgcttgacacaaggttaccacaaaccttcaatttgtaaagaaaaaacaaaacaaaacaaaaatgcagtaagtatctatgaagtgtaataaaagcaaggcacaatgaaacgagtatggctgtattttttaaatgcaccaaagataactcatatacatagttattcttcggtatccatggaggacctcctgcagataccaaaatccaaggatgctcaagtccctgatataaaatggcggccaggcgcagtgactcacgcctgtaatcccagcactttgggaggcggagatgggaggatcatttgagcccaggagttcaagacaccaacctgagcaagatgtctctattaaaaaaaaaaaaaggaaaaagaaaaagatacaatgtatataacctgcacacattcttctgtatacttcgagtcatctctagattacttataatacctaatataatgtaaatactatgtaaataattgttataatgtattgtttagggaataatgacaagaaaaaagctgtacatgttaggtattttaaaaatattaaaacaaaattttctatacatggtttgttggcttcacagatgtggaacccgtggatgtggagggccagttgagctctctgtcagtgtttggtatgaaaattcttatgcctaaattcccagcaaacttaaatctgtagtgttttcagctaaggttttagataactttaatataaaaagaattttttcttttccttttttaaaaaattttaaaatttattatttatttctctttttttgagacagagtctcactctggcgcccaggctggagtgctgtggcgcaatcttggctcactgcaactttggcctcctgggttcaagcgattctcctgcctcagcctcccgagtagctgggattacaggcacctgccaccaagcccggctaatttttgtatttttagtagagatggggttttgccatattggccaggctagtcttgaactcctgatctcaagtgatctgcccacctcagcttcccaaagtgctgggattacaggtgtgattaagatagaaatatacctgtaggtgttagtgttttctcaactataaagtgttacatggctttaactagattgtcttgaccagtgatactagaatatgaaactatttgagatttgtgttttgtaagacaacattctagaatcatctacatttgtgtaaataccatatttcattaagtgtgaagttataactctttaatcagaatgacagattggagacatacacaatttatgacgttatggcttgtgctttttgcttttttgtgacacacacacacacacacacacacacacttttatatgtttagtacctaaatacaggctcttatccatgattcatagcttgcataattgtaggtttttagaaacttattctcttgacatgtattggggattttgctttgcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagacaagtttaccatctgaaaaagctggattttctttaagaggttgattataaaggtttctaaatttatcagtacctaagtaagatgtagcactttgaatatgaaatcataggtgaagacatgggtgaacttacttgcataccaagttgatacttgagtaaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttaaaaaaaaaaaagaaagaaaaagaaaaaaagataagaagaaggagtaaagggactactcctccttgccaaatgtgctaaatatcattttaggagaagaaagtgggtttattgtatttcccttaagattgtgagggagtgtggatacagtagaatgagccaacagtttctttataataaatacggtctgcaataaattatttcactagctctaaaacctttccctagattttagtagggagttggtttctgttaatatctttgggtgctgtggtggtaaatgctatattatgaacggtggcatgtatttacagttagagtattgtgtgtacactttttaatggtaaacttaagctgaatgtgtaatggatttgtgtatagttttacatatttggaagcattttaaaaacaggttttaaccttatgtaaaattacttttatactcgtgttaacattttcatctgtgccttttggtaatttaatttctattatgaatttctggtgcctatgagctagctatcacctacctgaaaggtgcttagaggtgaaggtactgtttctaaaaacacatcactgtgatacctttctatcctcacattttcaagcttgcctcttttctgttctttgtggatataacttaagcaattgtgttattcataaaggtttagaaatttcaatattcccaacactctatgtttctgattttataacagtagccatttttgaaagtcagatgtttggcctgttttatatgaataaagtttatttataaaatattataaaaaataagtaaataaacagaacattaataataaagttttggttcttcctattcctgactttcatataatgaaaattatcctattgatctaagtagaagttatcatagaaagtggacacgtataagactttccttcctttttttttttaataacatatgaggaacaagacttctcttcccatatacttcatattttagaggacattgttttaaaggcttatgtctcactgtaaaattctgtcagccaaatagtaccaatacgttttcaagtagttctcactgataatttagttgaaccagagatcaaatatttgctcccgaattactactggtaatcaagtagttgaacaaaaaattactaaagcatttccgttagatcagtcaaggacagtactgcatcttttttttttttttttttttttaagacggagtctcggtctgtcacccaggctggagtgcagtggcgggatctcggctcactgcaagctccgcctcccaggttcacgccattctcctgcctcagcctcccgagcagctgggactacaggctcccatcaccacgctcggctaagtttttgtaattttagtagagacagggtttcaccgtgttagccaggatggtctcgatctcctgacctcgtgatctgcctgcctcggcctcccaaagtgctgggattacaggcgtgaaccactgcacccggcccagtactgcatcttaacagcaaagccattttattctactttataactgagagacttgataccatccatctctttaggttacagaggataatttgaagagaaatgttactgtagaatatatagttctgtactttttttttttttttttaagagatagggtttcactattgctcaggctggtctcaaactgctgggctcaggagatcctcctgccttggcctcccaaattgctgggattacaggtgtgagccgcagcatccagccagttctgtactttgaatatggagtagtttacagctatttttttttcttactggtaatcttaactaatatgattcccttgttagagagcctctcactcccccacccccaaaaatgtctactattcatgacagtaaccaattattctggacaaattgcttctttttaatttgagctatctgccatggactttctaaaatggaaacacagcctgagtgtatcttagggagagtttgattgaaaaaatccaaatcactat

SEQ ID NO: 11936 - DNA, 28321 bp, Human
ttgttatccactctttttttttctttctcagcaacataggtttaggctgaacttatgttcatatagctgcacaaatctccacgggtatgaatataaatctatctattcaaatagactctaaaggtttcttaggttatttctcttctttctagaacttaagtaaggctttgatcaccactgataatacatccgttagttaatgcgtgtagagtttccagtctaaaggcaaataaaaagtgaaaaggggccggcgcagtggctcactcctataatcccagcactttgggaggctgaagcaggcagatcacctgaggtcaggagttcaagatcagcttggccaacatggcgaaaccccgtttctactaaaaatacaaaaattagccgggcgtggtggcaggtgcctctaatcccagctactcgggaggctgaggcaggagaatggcttgaacccaggaggtggaggttgcagtgagccgagatcgcaccattcactgcactccagcctgggtgacaagagcaaaacttcatctcaaaaaaaaaaaaaaaaaaagtgaaaaggcaggaacgctgttgttcacctgctgttttaggaattttgctcacgtacagttcaaaatattaagaagctgaaaataaagtacctggtcatgtgtggaaaaacttacagctaaaaggtgagatgaactgggtctagaaggtcggattcacgtgaaattaaaagggcaacgaaagccagaacttaatttcttaaaaaaagttaaaacaggccgggtgcagtggctcatgcctgtaatcccagcactttgggaggccgaggctggcggatcacaaggtcaggagttcgggaccagcctggctaacaatggtgaaactccgtctctactgaaaatacaaaaattagccgggcgtggtggcgcgtgcctgtagtcccagctactagggaggcggaggttgcagtgggccgagatcgcgacactgcactccagcctggccgacagagcaaggctccgtctcaaaaaaaaaaaaaaaaaacagttaaaaccctcaaaataatcccacttgttaaaatacaaaacctgaaaccatttcagtttcttctgcaaaatgagttggagagagtagggttgaaccaggcatgctctttcgggcctttcgacgctgacatcccgggatattacaccaggttcaagataccagcttgcggaaagagagctgctaaacttgaccatatgctttttgcacgacattcgacagctgtccctcccttcaccagctcttttaaggctgcaaatatatctgattcacgtgagagtccctacaagttagtacaacgtcaggccccaaggaggcgcccaataaatgttggcattgcagggccagatcccgagttccagttcagaaccctgctgaggtcaggcttcctccctgcctcccgcccctcaccacacccactcactcccccaagtaattaagtctaaactggggcctgtgcagtgattggccgcgccgggtctcactgcggatgaacttgacttgttccaatgatctgtgacagacatctgcagacagcgcccttaacagaattagggtcaggctggtatcaaaccccaggaacgccaggcattgcctcaaagtagatgcaaaccgttaaatcttccaggactcagaaggaccagagagagccggatacctctggttagctacgcggtccccagtaaagcttattcccctcttcctcccagtgtgtcttgttgccagagcaactgtgggcgtcaccgagctgacgggcggaaacagaacagaaagagtacacgtccccagctcattgatagggccattgcgcagacgcattaacttttctgagttgtagttgagtctgttgatgcagtccgcgtctgcgcattagttgttacgcgccctggccggcctcagcgcctgcgcaaattggcacaccggggagggcggagttaggtcacgagggtgcgcatgcgcaaacagcacatccggtgtggtcgacgggtcctccaagagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggtaatggttctataagtgatcataataataatgtgttactttggtgtgctgcttttgttttcatagtactctatatcagaccaccgccccttgaagttatgagaagagcctgcattgcccttttgttgtgaatggggaaattgaggctcagaaagcttagattatatgcctaataccaaacggctccgtaggagttggacttaaaagtctaaagaaaccaccttcgtgccgctactccacttggtgatccacttcacttaatattggtccggggaaaaccctattccaactttaacttaggtttaacacaactctaaaattagtagacttttcaaatgaaaaacccaaccttgaatcatctctgtcatcttggcctaatcattaccaatctccggtgaaacgtttcaatgaaagtgcaaagaatataaatactggtgcttttcttgttgaatcatcctttacttgattttgccttttagctgctactactttttttcttgttgaggaagctgttatttcactgtcctgaacccaatttttgttcacataactctattttagccttatttttccttttgattccaggatttggtaaccttgtagactgctatatttagcgagaacagtctccatcaatttttgttaaaatctgacttttcttgcccaacggggattcagtgaatactgaaaacaggcgtggcctctatcactggtatcacctgctactttgactttgaaaacatgccagcattcatggtttcttttcagtgtgatcatcagtcaggtcatcagttgtattttcagtccaatatgaggcattatggtaaaagctttggcacatgttctttatccgtaaagagtttatggtctagttggggtacagacaaaatacagcattggaattgtctggaggcctggcacagtggctcatgcctgtaatcccagtactttgggaggccgaggtaggcagatcacttgaggtcaggagttcaagaccagcctggccaacatggtgaaaccccatctctactgaaaatacataaattagccaggcatggtggcacacacctgtaatcccagctactcgggaggctgaggcagaatcgcttgaacccgggaggtggaggttgtagtgagccgagatcgtgccattgcacttcagcttgggtgagagtgaggctcagcctcaaaaaaaaaaaaaaaaagtctggtgacagtggtgctgtgcttaaagttacagacctatagaatgcttattgtacatttacattgttctgacacaccagagatatttcttagaatttaaaacaggtctgaggatctaatgacttgtgtactgaagttgcagattagccttttgattggatatttagttaccatctttgacttttgtcctagatgaccaagacctagttgtctgtggtggcgtccttgccttcaggatgtgttaaccatcatccgaccagatacactacccctttgctctaagtattctccaccacccacccaccgccctctgccacggtactatatgtttttattagccagcccggagaaggaaccttgatgagaacttttgatttaattttgtttgatgtttttgtttccaggtctggaagagtaggagcaaggcagggtctgaaagctgattttaaaaaagatgccttctccatgtagaagtcaccctgccttcataagcctctagggtctagaatgatttttcatggatgctttgaagaatgtggtttgctgaagagtgggcatggactagagttatagattatcagtgtaataaagccagaaggtttttttgagcaaatgactttcacttatgccaagacctgtttttgagcccgttgtggctgaaattgaattggcagactggactgcctttctcctctccagtgggaactaggtggcttgtcattgaagaaaaacctagtaaaagggcatattagtaatggggccaataagggggattaggatttccagatctgttagataacagataatagagctatagaaatgaaagcaacttcaagaaaagaagggattcatgataattcttagttgccacagaagggtatgatttacccttcttttgacagcattgactttcctaaatcctgcctcttctgccatttgttagcctagatcatcaactggagactggttttaatgggaaatttggacgcttatcctttgttttgattgttggcaaaggtagccttgttcctttttatggtgctggggtttctaactttcctgtggaatttcctgttgcaagagaatggaggagtccagtgagctgggagagggaaatgtaggcgatactgttgaaggattaggtagtgctgggtgctagatgtttgaatgccaggccaaggaatttggactttttttgagatggagttttgctcttttttctcaggctggagtgcaatggcgatctcggttcactgcaacctctgtctcccaggtttaagcaattctcctgcctcagcctccgaagtagctgggattacaggcatgtgccaccacgcccggcgaattttgtatttttagtggagacggagtttctccatgttggtcaggctggtctcaaactcctgacctcaggtgatccgcctgcctctgcctcccaaagtgctgggattacaggtgtgagtcactgtgcccggccaggaatttggactttatcctgtaggtaatagtaaagcttctgaagatgcttttttttttttttttgagacggagtctcgctctgtcccccaggctggagtgcgccatctcggctcactgcaagctccgcctcctgcgttcacgccattctcctgcctcagcctcctgagtagctgggactgcaggcgcctgccaccacgtccagctaagtttttgtatttttagtggagacagggtttcatcgtgttagccaggatggtcttgatctcctgacctcgtgattcgcccgcctcggcctcctaaagtgttgggattacaggcgtgagccaccacacccggcactgagggtgcttttttaaagaaaggaaaagatttaaaattggtgttagcatgtaggatgaattggagggaaatgttctttaatcttctctatttttttttggcagtctattctcttctattccctctgcatgtgttagtttagcatatgctctttggaaattgaccagtacattttaaaccaattcagaacgctaccaaacctttaaaaaacctgttgttattgggcctgatggtatgaaaatagtctgttttcttctattccctcatagctgagagacttaaccatggtttcaagaaggaaccagaggtagaaagttgtcattgagagatctttttttgtgtgtgttttggatcatcagagtataatatattggctttaaaaggacctcagaggtagaatatttttctatttgagacagatttcaaacatccagtagctgactgtttatcttgtagttagatatctctagaagaggacatctgtcccttttttagagttatattccagtgttggcaaccctttagtttccttttttgcccaactgaaagctgtgctcatttaaagtgctatttaggagggataagtagaaaacattaagactgtcctcaaaataagtctttggtcttgaaacaagttttaattcatttcccaactttcatctgttctgttctctaatctatatgaggtaattttgtcttaaaaaatagttttgtttttcctagtttacaaattcaaaaccagtttgaatctgtaaggcaaggaggcctagtccagagttttctgtctcacgggagctattaggctgttgtggactggggtccagcatttcttttggaattatccatcagatctgtggatcctaatattatctctcataactgttatccgagagattagaagtttgccacccatgtgcctgatagtcttgtttctaaatatctttcatatcattgctactttttcatcctctgttttagcctctcaatatctcttatgaagactactgtaatcctccttactggccttccggcctctggtttccagtccatcttctactgtgtttgcaggcttgatttgacttgcaaatctgattgtgtcactcccatgtacaatttgtgtttcccaaagtaaaattaaaactttttttttgacatacaggctctttcatgatctggcttcctcgctgtctgcagcttcatctcttgcctctgcctcctctatactctgctccaacagtattgagctacttgtcattctctgaacactctcatgtgtcaaactatttgcctttgcttgactgccttcaaaattccttcactttttagacttctcagctcaagtgcaatttccttttttttttgttactgtttttaaagagaacaaggtcttgctatgttgcccaggctggcctcaaactccttggctcaagcagtcctgcctcagcctcctgagtagctaggactataggcacacagcactatgcctggcttattgccctttggaacccttccctgactctccagcagattgaggtctttcctctgtattcctttttcaccttgtatgtgtgtgtgtgagagagatatggcattgtgctgtatttgggtgtctgccttctctctggaaggtgagcccttgagggcaggggctgtcttctcatctctccatcctcagtgctgaacactgtatatgttaaatggtgagcaggcctatagtcatgtcaggaatagtgagcaatgatgtgctaggttctctgccaaggtgctgggaattcaactgtgaagcacacagacgtggcttctactctcacagagtttgtaattagtgggaaatacagacaagtaaatatggatatggtgctgatggagaattattggtgagaatgggaacacaatgtgcatccaaccctgcctagtggtcctgcaataatatttctcttatacattcgccttcctaaagtaggcttcataaatcactctatttttcctcttttcctttattcttagttggtgatcttgcttttattttttcactaaaaaaaagaagtagataagaattccttcatcttttcaccactgaatcataacagatcacctacttttatacccatactctctgacttctcatggtggatgatgtgtctctttcctgtgaaagctctgcttgtgcagaggatccagtcttcccttgctcactcagggactccgcttctgcaattattcctctgttccgtgtcattaatttctgtttctctcctggatcattcccatcatacaaacatgttctaatattgtctatttaaaaaaaatccgtttgaccacagataatcttctagctaccatcccatttcctttccatcattacagaatttcttgaaagaataattaatgttcctacttcctcccttaactattcattccttaacccactcttggtattggtctgtcctcgctacttcactgaattacttcactgaaactactcttgccatgttgcaacgtttagcatttaatgtaggtattggcttctgtgtaaaaggaaagttttttcttgaatacaacactctcctgcttgttctgtctcacctcactgctttttcctttctgctgttttgtgctgggcgcttctctgactgagagcatggttgtagataccttcactttgtatttttttttaaatagataaacttaaataacacctgtatacctacaactactcctttatatttttagttttgaactgtcccccgaattccaaattagtaaatccagttgccaacttgatgtcttcacttgatgtctgatatgtaccttgaacttaacatgtccaagatcaaacctgctcatccagccatctgcctcttcaccagttagtacgtggtgtcaatgttggttgtggttttttttttttttttttttgagacatagtctcactctgtcacccaggctggagtgcagtggcacaatctcggctcactgcaacctccatctcccgggtttaagcaattctcctgcctcagcctcctgagtagctgggattacaggcacgctcccccatgcccggctaatttttgtatttttagtagagacgaggtttcgccatgttggccaggctggtcacgaactcctgacctcaggtgattcacccacctcggcctcccaaagtgctgggattacaggcgtgagccgccatgcccggccggttgtgtttttaaatgaagaaatttaagtttccggggtcccttgatttctcttatctcctgcatctgtttcatcagcaagctctgtcttctccaaaatatagcctgtatgtctttatttctgtccatttttactaccattcccctgagctctttgggtcctaagtaattcttctgcttctttttattttttatatttttgagacggagtctcgctctgttgcccaggctggagtgcagtggcgcgatttcggctcactgcaagctccgcctcccgggttcacgccattctcctgcctcagcctcccgagtagctgggactacaggcacccgccacaatgaccggctaattttttttttttttttgtattttttagtggagatgggtctcaccatgttagccaggatggtctcgatctcctgaccttgtgatccgcccgccttggcttcccaaagtgctgggattacaggtgtgagccactgcgcctggcctatttttatttttatttttatttttttgagacgcagtctcactgtgtcgccaggctggagtgcagtggcgcgatctcagctcactgcaacctccgcccttggagttcaagcgattcttctgcctcagcctccctagtagctgggattccaggagcctgccactgcacccggctaattttttgtattttatttttagtagagatggggtttcaccttcttgaccaggctggtcttgaattcctgaccttgtgatccacccacctcggcctcccaaagtgctgggattacaggcgtgagccactgcgcccggccttctgcctctttttaaccttgcgaaccattatactgttccaccgctcttataactgaatccatactgttttctgaggcttaccatgcccctcaggatttggcccttgtgtccttccccttgatcactatagtcttgttggtctgtccttgatttttttttttttttttttttttttttgagatggagttttgctcttgttgcccaggctggagtgcaatggcacgatctcggcttactgcaacttccgcctcccgggttcaagcggttcttctgcctcagcctcctgagtagctgggattgcaggcatgcaccaccaagcctggctaattttttgtatttttagtagagacggggtttctccatgttggtcaggctggtctcgaactcccgacctcaggttatccacccgcctcgacctcccaaagtgctgggattacgggtgtgagccaccatgcctggcgtctgtccttgtgtttataacatgtcaagattgttcttactgtctagaatgctctgcccccagatttttacatggttggttccttatctttcaaatattggtcttaaatagcaagctcttaaagagaccttctgttatgattgaatttaagaaaagcttcccagtcactctttattatcctgttttattttcttcatagtacatatctctacctagtagttcctggtttatttgttaacttattgattatatgtttctctccataggagtgtaagttccttgagagccagactgttttgttctgtgccatattcctagcacctgaaatgatgcttgtcatgtagtagatgtttagtaaatattttatggaataaatggacatttaaggggatagagtaaatcagaattgctaaaatggaacagactgcttgaagaggtagtaaatttccatctttggaagtgcccagggagagactgaaggatcattggtagtggagcattttgaacaggcttttttttttgccttttttgtttccaatgcatctgagagatgtgatatccttatcagtaacacaggctctggaaagttgataattctccatctggaggtggcttaccagattctgtaagtggtgagtatactttggaaagcttcccacgtgattagtacgcctccccaagcatggccaccccctaccacctcttgggcattgtatacatcaaatggggtgttggtgtttatgacctctgaggtcctttccaactttgtgggactctgattcatatgttttcattgaaataatctggttaccatgatcacaataataataacatcaatttattaccttatccaccttcatggataatttttctttttttccctcatatttcctcaaaactcaacaccgtgttctttactccaatgaccactattaatagttttctatttcttcagatttttttctagattctaactgaaatgacaagataattatgtatatcattatatgtaaataaaatattttactttttttttgagacggtcttgatttgtctcccaggccagagtgcggtggcatgactgtggctcactgcagcctgcaacctctacctcctgggctcaagcaatcttcccatctcagcctcccgagtagctggggccataggtgtgtgctaccacacctggctaattaaaacattttttttgtagagacagggtctccctatctttcccaggctggtctcaagctcttgggctcaagcgatcctcccaccttggtttcacaacatgctggggttacagttgtgagccaccatgccctggccaagtgaaattaggaatgggctgggtgtgggggctcatgtctgtaatccctacccttaggcaagcagaggcgggaggattgctgggcaacatagggagaccttgtctttaccaaaaacaaacaaaaaaattagctaggcatggtggtgcatgactgttgtctcagctactcagggggctgaggtgggaggattgtttgagcccaggaggtcgaggctgcagggagccatgattgcaccactgcactccagcctgggcgatggagtgagaccctgtctcaaaaaaaaaaaaaaaaaaaggattggctttttttcacttaataagtcttagatatgtttgctgtcaatgtacagagaatttaccttattcttttgaataattgcatgggatttcattgcatgtcagttgtatagtttaatccccttgatgtttagactgttttaatttttttttcaactttacaaacatactttcagaatgtctttgttctgtaagataaattcctttgtcaaaaggtaaaatcattttaaatattaatggatattgctagttgctctcccaagtggatgaatgaatctgtactttctacagcaggggtttacactggttacccttgcttcagtcattgtctttaatatttttaagggtctggatacctgaaaggatcaatggtgcttccatggtgtttacatgtttaagcataatgaaaactgttgccatggtgacaggctctggagaactagtctgatagttttctggcctttggattagatttgtttgttgctttttcttagttaatgatgggatgatgctagcctgaagcgagtttaggttttcttaagcaatgtaataatttatcacaggcataaagatacttcggaagagtgtattcctggaactgcctgtttttttttttttgtcaatggtgactgttagaatcttcaaggggatggagtgtggcagtggagagttctcatgaattatctctcttaggtcttctgccttttttgagacaaataagcagctgctagaacttcgagatcaaagatagtttatcgagaactgtgaggttctcaagaatgagcgtgctatctttataaactctgctacccattaaatgaatattctattagaaaataattcacatttttataactttttatcattcagcccggaccctttgttgttgcctcaagtgcatccccatctaggtataattagaaacctttaaatcagcagataagagagctttgtgggttttttggttatatatttttttctctgagaaagcctctaggtttcagtgtaactctgagaagtaatattttttttcctttaacagagtgcgaaatttaattgtacaacttgataaatttttaaatgtacctgtctaaccactatccagatcaagatgcaggacattaccagcaccatagatgcctccttgcatcttcccagttatcctctccctgtgaaagataaaaaccactatcttgccatagattggttttaccaagttttaagctttttgtacatggaatcatatagcatatacttttttgttttgttttgttttgagacggagtctctcttgcccaggctggagtgcagtggcgcaatctcggctcactgcaacctccacctcctgagtttaagcaaattctcctgcctcagcctcctgagtagctgggattacaggtgcgtgccaccatgcccagctaatttctgtagtttttattagagatggggtttccccatgttggccaggctggtcttgaactcctgaccttaggtgatccacccaccttggcctcccaaagtgcggggattacaggagtgagccaccgtgcctggcccttgttttattttttaatttttttttttttagatggagtttcgctcttgttgcccatgctagagtgcaatggcacgatcttggctcacctccacctccacctccaccaattctcctgcctcattgcctcagcctgccaagcaactgggatcacaggcatgcgccaccatgcccggctaattttgtatttttagtagacaaggggtttctccatgttggtcaggctggtcttgaactcccgacctcaggtgatccgcctgcctcggcctcccaaagtgctgggattacaggcgtgagccaccgtgcccggccttttttttgtttgtttttggtcaagataaaacatgacaaaatttaccattttaaccatttttaagtgtatagttctgtggcattaagtacatgtacattgttgtaaaatcatcatcactatccatatccagaacttttttgtcttccgcaactgaaattcagttcccattaaacagtaactcctcatcctcctctctgtcagtccctggcatctaccattccactttctgtttctaggagtttgactactcttgatgtcatataagtgaaaccacatggtatttgtccctttgtcatggcttatgtcacttaaaataatgtcctcaagattcagccatgttgtagcaggtatcagaatttccttccttttaaggctgagtattccattgtatgtatacatcacactttgcttatccgttcttctgctgacacttgggctgctctcaccttttggctattgtgactaatgctgctatgaacatgggtatgcaaatattgcttgagagcctggttccatcccccaccctcccaacctcccagatggagtttctctcttgtcacctaggctggagtgggacggagtgatgtcggctcactgcagcctccacctcctgggttcaagcgattcttctgcctcagcttccctagtagctgggattacaggcgcctaccaccacgcccagctaatttttgtatttttagtagagacggggtttcaccatgttggccaggctggtctcgaactcctgacctcgggtgatccgcctggttcagcctcccaaagtgctgggattgcaggtgtgaaccactgtgcctggccgagatcctgctttcacttcttttggatatgtacccagaagtggaattgctggattatatgatatggcaattctgtttttaatttttttgaggaaacgcagtactgtttttcacactggctaccctatttgattttcccacttgttagtgcacaagggtttcagtttctctgcattcttgccaactcttgtttttttgatactagacatcctaatagatgtgaggtgatatctcgttgtaattttgatttgtattgccctagtgattaatgatgttgagcatcttttcatatgcttgttggccattcctatatcttctttggggaaatgtctattcaagtcctttgcccattttaaaatctggttattattttgttgttaattgcattgtaggggtactttaatatattctgatattaaccctttatcagataagtgatttgcaaatatttttccccattccgtaggtgccttttcactgttgtgccctttattgtacctttatcacagaagttttaaactttgatatagtccaatttatctatttttactttgttgactgtacttttggtgtcatatccaataaatcattgctaaatccaatgccataaaacttttgctctgttttcttctaagagttttttagtttttggtctttatccatttcggatttaggtctttgatccgtttcgagttaatttttgtagtatatggtataaggtaagggtccagcttcattcttttgcctatggatatccagttttcccagcatcgttggttgagaagactgtttccccattgagtggttttgtcagtttggttgaaaatcatttgattttgtatacgagggtttttgtgtgtttcttaaaaaacaaagcaattaaattgattcattttttaactgtagtaaatgtatttttaaaataaacttataatggaaaacctgaatcattatccctaaatagaaggtcacactaaaaataccatggagctaggcagatgtgttcacccgtgcctgtggtcccagctgctcaggaggctgaggtgggaggatcgcttgggttccagtccggcctgggcagcaccaccagaccctgtctcctgccgagttctcagtggctctgtgtggctgcatcccagaatattcctcatctaattgagggggtacatttgttcccccagcatatacacttaggctctgccctgtggtctctgtgtgggagctgggcttttttgtctttggcttcctctgggtacctgccaggttccagctggtttggccagccagtgtgtattttttaagttttgtccgggcacggtggctcatgcctgtaatcccagcactttgggaagccgaggcaggtggatcacaaggtcaggagttcgagaccagcctggtcagcatggtgaaaccccgtctctactaaaaatacaaaaaattagccgggcatggtggcgcatgcctgtagtcccggctacttgggaggctgaggcaggagaattgcttgaacccagcaggtggagattgcagtgagccgagatcatgccactgcattccagcctgggtgacggagcgagactctgtccccgactccccaaaaaataaagtttttgattgtgttgcccaacttacttgtgcaattcatccatttttgtgtatagcagaagttctttttcattgcagtataatattctattgtttgtatatgctataatttatccattttactgttgatagacattagattgtttccagtttggggctatctgggtatcatttctgtgtatgccctttgatgtatatatgcattcatttctgttagagtagaattgttgggtcctcgggtatgtctgtgttcattagcatatttattttatacttctatataatcatttttttgtgttttgcttcttgtgcagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgtaagtgatgatcatagtccttgtcctataatgttgattttaggaagagaaattggatgggactggttttgatcatggttggccaggctcccatactgctattgacatttgcagaattttccattggtctgcaaagtatgcattaatatcatcataattcatcagtgctactgctcttggtcattgccttgtctttctgttcttcaaatcattaaggtaatagaaaattaatgtttgtagctagtacaataatttctgtaccaataactccacgaaaataactcggagattttggaagagacataaatggtaggttttgcctttagatttgttagttaatttttttctgattttgatctcagatgacttttaatgctggaccattgttttcatagcacttaaatttgatagcatccagtgtatgttgaatgaatgactgtgggcatttgctaatatgtgccttaaagtagaaataaatggggaaattgggttaacttgggagaagactttaaaatataagatgggatgctgcttggttcatttgccattttcacttttttagcagtagagttctttctcccttctcccaaacaaactcttacaaaaagaatcttggtatataaagcagaagtagaattggagttttttttgatggacagaaattgaaaagccctctctgcttggccttcatcacatatggtacgccctcccctaaatcgctccctcccaagcagagttctaaagctttaataaatatatggctgttttccataccgtatgtcaacactgttactttatatatgagacaacagaggcctagaacaatccattggccttccctggccacatagttaagtgtttgcagtgaagtgccctagtctagcggtgttcttggccccgtactccttccggtatcccatgtagcttactgatgaatgcatgcaatctttgcctttgcattgcaaaatgtaatgttctgggtggtagagaaaagagaaccttaggagatctcatcctatttgggggaaggatatcctaggaccaacctcttcctgtcaccacttggaaagctgtcatttttatactaaccagcagaaatctagtataagagttagagcatctatgtgcaaagtggatgcaataatgtggaagtgactatacttccttttctgacatgaattagtcatttacttataatatgttacctaaatcctttcctttgatactgcctcaaaaacagttctgttagttcaggtaaggtatcattttggtagtggtaagttgacagtgaggtttatttcagtgaaaaactttttttttttcttttctgtttttttttttttttttttgagatggagtctcgctctgttacccaggctggagtgcagtggtgcgatctcggctcactgcagactccgcctcccgagttcatgccattctcctgcctcagcctcccgagtagctgggactacaggcgcccgccaccacgcccggctaattttttgtatttttagtagagacggagtttcaccgtgttaggatgatctcgatctcctgacctggtgatccgcccgccttggcctcccaacagtgaaaaacttttaagaaccactttgttctgttattttaatacaatttaactcattagacacctgattaagacttgagttatcctcttcctcccttcctccctccccttctatgtgccagccaatgtcttgttgttgggaatataaacaatattgttggctgggcgtggtggttcatgcctataatcccagcactttcggaaggcgaggtgggcgattgcttgagctcaagaatttgagaccagcatgggcaacatagcaagaccctatctcaattaaaaaaaaaaacccaaaagtgtggcttctgccttcaagacatgtacagtctagtaggggagaatacgtaaacataacagttaaaatacagcccatttagggcctcgctataggtttgaacaaagtgctgcaaaaatccagagaagagagcagctgtaccatctgggagcagggacagcagatgagttatctgagcaatggataacagctattgctagttaaaatgaactgttaccagtggataaccttgaatgcaggtagaaaactgacccaccaacattgaccttctcacgcttgcaaatatgagtaacccttgggcttcctgatagagccttctggaaaggtcatgtcttctgattgcttactctagatttctgaagttctttttttctagatgagtcatggtgtgtacttaggaaggggacacagcaaacatttcaaggatgttttctaggctcagggagataccaaatcatggaaaattatttcttagggctgtcatgattggaggaggactctactgcagagagcttagtatttcaaaattatgacaaaagcaaagacaaaaaagcagtctcagcagaaactgtgtactgcagaccatattaacaacctaggaccacctgctcagctgggaattatgggcccaaagcatagcaaaatcctcaatcccagattgcagtgttaaatctttctatggagagtatgttcatagaaaaatctttctctctgggggattgcccagattgtttttcatagagatccttcatttgaattatactatactgtcctgctctcagtttttaaaaatatacatttatttgctccttttatgtgcttctaactcagctatatgtgcactgtgccacagcactttaaaaatagttccaagtaaattctcaatatttataccagctcagaaggtagaacaaaacagattgaatgtctttatattttccaactaagttgagagtttgatattaaaaaaaaaattctgtaatatagctgatcttacatgaatttgggggtgacaaactctaacctactctgaaagaggcaggtcaaaagaaaatggcattgggttaaaaaaataaacaattcaaggggaagtaaggaagttaacagataatgagtgctcagtgtgtgctatgctttaagtacttcttgttctatatcattttattttcagaataatttcacgaggataggcttgctgttctcatttacagatgaggaactgaagttgagagagcctggctaggatggctgagcacggtggctgatgcctgtaatcccagcattttgggaggccgaggtgggtggatcacctgaggtcaggagttcgagaccagcctggccaacatggtgaaacctcgtctctactaaaaagacaaaaattagctgggcgtggtggccggtgcctgtaatcccagctactcgggaggctaaggcaggagaatcgtttgaacccatgaggcggaggttgcagtgagcccgaattgcaccattgcactccagcctggcaagagtaagactctgttttctaaaaaaaaaaaaaaaaaaaaaaaagagccccttgctagaaatcttacaactaatgtatctatccaggtgatcaagaaagactcaatattttttattttttagactatacaaatgaaaatacaaaagcaaaaattctcccagtgagcttctgacccccagaaatccatgcacacctgaaatgatcagtttttggtgtgtaggtggcggcatatttttgaatgaatccatgacagaaagaagctcagtggatttcagtatttaaaaatgtatatactttagttttttccatgtttgttcttctgtgtttctttgtgaaattctttttttttttttttttgagacagagtcttactgtcttacccaggctagagtgcagtggtgcagtcttggctcactgcaaccctgcctcccgggttcaagcaattcctgccgcagcctccccgagtagctgggactacaggcacttgcccggctagtttttgtatttttagtagagatggggtttcactctgttggctaggctggtgttgaactcctgtcctcgtgatccactcgccttggcctcccaaagtgctgggattacaggcgtgagccactgcacctggcctgtgaaactcttttttttaaaaaaaaaaaaaaatctcagtccatctcaggtgttctgaagggtaatgaggaaaagaaggacagaactgtattggatcacagtttgagaattaaagttcctgatgaattgggccctgggtcagaaggaagggtgaactgggcccaaagggacaaaaccttgcttgaaaatgtgctcagctcccagggagatagttgccaaatgcctgtgccttgttagcattgttttgtttttataatggagaccattctctcacaagtcttaaaaaattcagtgtttgatcctagctggaacaagggggctacagggttgggcagaacattttaaactctgactggcagcactgtttacaaacatgaaattatgttggcttttcgaattcagttaaagtatagtaatctagaaaattacctcgggaaggggaacttgatgttattctgtgggctttgctgccacctagtggatggtatgtttcatgtgttgagcggctactacaaaacatgaggagttgagtttgggggaagaagctactgatacctgtgttaaaaaacctagtttctttccagtcattggggggcagcagaggtccaggtgggtttagatgctgggttgggggttgctttacattctggccagaagtgggcaatgtcgagttaggaacaaaagggcatagaaccctaaagtggccctagattttgttgtgtgggggaagaccaagactgtgcacatagacccgcaggtttcccgtttgatttctttttttcacctccttagtttgagagcttctttttttggtttgttctacgtcttttattctcaatggtgacctcccacgcaataatctttaattttttgttggtggaggggcccatttagtttttatttcattttctctttgatatttccaccttatattgaattaggtcctgccgccaaataagctctctcagagggaactgtcctacatttgtaggaaatctgaggtagtcacatcataacttttttcaactcatttttctctgtttagaaggtgagattaattatatatttttttatgtgctggggtctcgctatgttgcccaagctaggaactccctggggtcaagtgatcctcctgcctgaggcttctgtgtagctggacctacaggtgtgtcacagtgcctggctctgagattagttctttacctttcattcttaaaactttgaatctacttattttatttgctaaaaagtgctaattgatgactttacttgtttattgaactctattttatatttggtgtatttaaggctaccaaagaaaaaagaatatcgaaatagatttatatttatgaatttcattgctgccctaacttactgccttattttctccatcctcccagcttggatgactcctattccaagtcattcccacccctcaggttgcataggagcccttagtctactgcattcctccagtgctgcacttatcacattgttatgaaactattcattcactttcttctctctcccactggactcaattgtgaacagtaacagtgtgtgtttgttgaatgagtgtatgaatgaataaaccttttttttttttttgagacggagtctcgctttgttgtccaggctgtagtgcagtggcatgatcttggctcactataacctccgcctcctgggtttaagcagttctcctgcctcagcctcttgagtagctgggactacaagtgtgtgctcccacgcctggctaatttttgtatttttaggagagacatggtttcaccatgttggccagtatggtctctatcttttgactttgtgatctgcctaccttagcctcccaaagtgctggaattacaggcatgagccactgtgcccggccaaataaacactttttaactgcaagaaaaagttatgttattaagttacttggatgctaaaacatggaaagtggtacgaaagaaaaaaagccaaggcaaagattcataggagaggctgtggggtggggaagagcatgagacaagaagtcagaggaggggctggtgcggtggcttaggcctgtaatcccagcacttggggaggccaaggtgggaggatcgcttgagcccaggagtttgagaccagcatgggtgatatagcaagaccttgtctctaccaaaaatcaaaagaattagaggggcgtggtggcgtgtgcctgtggtcccagctactcagaaggctgaggtggaaggattgcttgagcgtgggaggtcacggctgcagtgaactgtgatcatgccacttgcactccagcctgagtgacagagtgagaacctgtctcaaaaaaaaaaaaaaaaaaatcagaagacttgtattgtaggctttgctctgttaactagttgaatggacaaataaacttacctctgagcctcagtttctctgtctgtgttgtgagaggattggtctggatgttcatcaaagtctcttgccactgttaatgcctctcagcatgattcttgatggttcttttgtgtttgaggaggattgtactgtttttgtggatcctcatttgggctttgctttctgttttctccttaatcgttgctttttattcatattttcagattcccattatccatttataggaggcagaaagttaaatgattataacaagatgcacatatttgtatgaagccttttacaaaaagtaaacatttgtaaaatgtcttctagttcccacgttaacaggcttgtaggattcacatacattccacatatacttttacatacatcagctcatgtgatccttccttcctacccagtgatgtggagacagacaaatagtagtattcctattttacacttgaggtaattacaccttggtgaaactttagttgatgtatccaggccctggaactaataagtgactgagggggaactggataacagacatttggactctaaacctttatattccttcctgttatgtttaggactctcagatgatggctttatatatatgtcatgttagagggttttcattaaaaatattaaacttttctttttaagaaatttttatttattttaaattttcatcagagccatcagactggattcttttcttttttaaatgggaaaaatttggcagagattgataggaaaggatgaaggccggctatctcaaatgtttctgcatagttggccatacttaatatggtccaggagaaatggaggagaatgcaggtcaggagacctgactttggctagggagggtgatcctggaccagcactgtccaacagagctttttgcagtggggaaacattcagggtctgcaccgcccattatggtaaccactagccacatgtggttattgaacatttgaaatgtggctaacagactgaagaactgaatttttaatttaactttgactaagtttaaatagtcacctgtgtctagtggctgtggtgttggacagcacagctctggacagatttgtcaacactatcaggttacagttttctcatctctgtaatgaaaggattaaagaagctgatctctaaagctcctttcattttttagaaatacacagtctgtgccttctaaaactggtgattcaaattgagctgtaaacctagaatttctgcagaatggtctttgattcacattatttctaatttcagttttaattgggtgactagaatccaggatgagatgaatttgaaggaaaatcagtatttgaacatatctgcccagtgctagtgtctgaatagagatattgctggagaagaatacagattccaaatagaaatgaccctggctggcattatcttttctatctctacagcgtcatttttaacagttctttgtgttatgccttgctttctttttagatgattagaacaaactgattaaatggcactgtcttctgcccaggtgaaatagactgaagtcacgctaacttttctcagtaggtgtcttcattttgcatgtcttgatatcaggggaggagattttattagtcagtttcctgaaacctttatgccctggttaatagttgaaaccattcttcttagctgttgagtagtcaattgtgtgagctaatatttcaaagaatcctagaacctctgcttttagaatagtgtctggtaaatagatctgctttaaaagaggggaagcagatctttgtaaacagaattttctgaaaaccactatcaaagagacttactctcatgagtcaatttttgcctttcacgtggactggcctcagcatcttagatttaaatgttttaatataataaaatctttaaactttgattttgtactaaactaggatttcttttatatttctaaaagtgtcaaggctttgttcactgaaaatggcattatgatctagtcctctctcaccttggccattagaaatgtaatgtagccaggcatggtggcctgtgatcccagcactttgggaggctggggcgggtggatcacctgaggtcaggagttcgagaccagcctgaccaacatggtgaaaccccatctctactaaaaatgcaaaaattagctgggtgtggtggcacacgcctgtaatcccagctactcagcaggttgaagcagagaatcgcctgaacccgggaggcggaggttgcggtgacccgagatcacgccattgcactccagcctggacaacaagcacaaaactctgtcttgaaaaaaaaaaaagctgtaatgttatattggctgatagtctattgccagagagtttgctttaagaaatttgatggaatgaataggtgagtttgaataggtctgtttggttttgtttggcactgtgaacaccttttgcttcctgttattgctctttcttttatacatttcttataataccactgattcaggaatgttctgcaattatgtagcatttctgtaaataccagtgttagtgaaataaaagcattctggctgaaagtccaaaatctctcctttaagttctgatgccagaatctccaggttacttacttgacccaatataccaaataaggtagtgccctttttcctcctggggcagcccggttcttctgaaaggtagtatttcccagcctcttttgagtcatggtacacgtaggagattgcagtatttttatggcacactgggaaaatcagttgcttatagctggagacattggagcccctaaggctggaggtcactttccaaccagagctgtgctggagtccagtaggtgggaggctgtgctttgagggactaaaggaagcctgtatcttgtggtgagggttccacctcacaagttacagatctcagttccatttggctctagcagcaatgtggccacttctgttgcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctccatatgcctctggctctgtttttattctttgctggtatcagaatcctttttttctcttcagtcctctgtgctgaactctttatgagttggtaacttacagctgtgaacctgcctccttgttttcattaagtatatttgaagttaatggcaaaaggcagtgctgacaaccctgggaaatggcagtcctttgtcttcttcctggagcaggtaatcctttactaatccttcgattgttacaggtgcttccactcttatgacagtgcattcctggaactgcatcattatgcactctgctagaaattgaactaagtatgtgctaccacatttacatctgtttcaacatgttttagtggtaaaagtgaaatatatttctcttaggcagtgtagacagagtgaaaaatgggggttatgtatgtgttgacttataagatacaatattttccaaagcaccttcacaaatattctctcattttattcttgcaattatcttaggggttcctgtcctcattagttaggtgaagaaattgaaactcagatttgtgacttgcttaagatcagagttcatgacaaagcttgggtggaatgtaggtctgctggctgaagtctgtcatgttcgcagccctgttttcatcttgggtgctgttgggttgctatatatggggcggaagctatgttgagaatgccactacttaaatttagccaactaccgagaatgatgagtttcaagcttctccaacttggctgcacgttagcatgacttgggtaatgtaaaaagaaaatcccaacgtccaggccacaacccacaccaattaagtaaaaatcgcttggggtggcttctgtagtttgtaaagctacccaggtgattccagagcacagcaaattggagaaacactgctctggattcttgctactcaaaatgtagtcattgactaccagtattggcatcgcctgggagcacaggcctcaccccaaacctacagaagcaacatcttcattttaacaaggtcctcaggtgatttatgtgcacaataagatttgagaatctctcatctacagcagtggttctcaaagtttggcatgtctcaagattacctaggaacttggtgaaaagcttgggcctgtatgtttcttattagctctctgcctaactgataacacactgagtcaggagtccgcaagcttttccttaaacaaatgggcatggctatattccactatcactttatttataaaaattggttgtggctatgtgggtcatggtttgccattcttaagtgatactagttcattgagattatgactgagcagtttaatctgcacttttttttttcttttttgtttttgtgagatggagttttgctctcgttacccaggctggagtgcaatggtgtgatctcggctcactgcaacctccgcctcctgggttcaagcaattctcccaccccagcctcccgagtagctgggattataggtgcacaccaacatgcccggctaatttttgtatttttagtagagacagggtttctccatgttggtcaggctggtctcaaactcctgacctcaggtgatctgcccgcctcagcctcccaaagtgctgggattataggcgtgagccactgtgcctggcctaatctgttttaaaacttatatacagatgtcacagaccctatcaggaggcttccggataatttttagtctagagaaattggaattttgaataagaaaagcatctggactttgagacacgggttgaaaactgggaataatagtaattttatgaaggaagacattgtaattgcagtctttaatacataggttttgtttaatttttcataatgatcttgagatacatgggacaggtattaaattcccatttaccaggtcagctattgtctcagaggttgtgatttacccaagccagttaccatcaacaggaaacattcttctttggtgtgtcttttcaatatttgcttcggggctaaaacctacagactgctttt

SEQ ID NO: 11937 - DNA, 15376 bp, Human
  misc_feature (1)...(15376): n = A,T,C or G
aggctgaggcacgagaatcgtttgaacccgggaggtggaggttgcagtgagctggataccgccgctgcactcctgcctgggtgacagtgagaccctgtctcaaaaaataaaattaaaaaaaaaacaaacctgatacctcccagtgttgtcagttggcacatactatgtctcaataaaatgcttgctgttaccctctattttgagacgaagagggaccctgtgtatgacaaccccagattgacctcatttgcattttaagtatttagaatgtgggtaacagttttcagtggaggaaactgccacatagggactaaagcagtcccagggtccactccaggagctgccaggcgcgctcggccacaggtgagccatccattcgcccaaccggtgctccaggaaggcaggaagcgggatgcagggcttcagcctcacttctcgcagcttcagcacctgggtcagaggagaggcgggcggggcgatgaagggaccggaagtcggccttttttccgtccgcttgaccagcgtcgactgcagccaatgaaatcagggatggcgagtgttcagccagtggtgaggctgcatccgggtgtgggtgccgaaaaggcagctgggggcgggacgtcgaggtgcggcacgagcggcgggcgcaccggccaataggcggcggggttcgtttcccgggggtgggcactggcgggtgcggtgacgtcggcgcaggcgcgtcgcggcggcaggggcgcggggcttctggaggcggcggcggtggccagcgcggcggcgccggccgtattctccgggctgcggagggtaaagagcgggctcgggccgaggctggagggctgggtggggccagagcggcgcttcgggggcccgcggaggacgagggagggagagaatctgaggagctggtaggtttggggacccatctgggtgaccgggccggggaaagggctcggccgggcgtgcgaggggcgtagcggccccagggatgctggagcggagccttagggatgggcaaggccttgggggcggggggaggttctgcaaagggagccactggggtctgcctaggggcttgtgcggagattgcgggcgagaaggggcagaggacggtggaggagactcagatggggccctttttggaggcccgttttggggggtaggggagacggcggttgggggactttgatacatggagcgtggaggaagaggttaatcttgcgaggacagtggaggtcagcgggggagggaggcaaagtgggctttcaggagcgtggaaggcgtcgtccggttcttggaaaattcagaattggagggagtcagagatggttgggggtgggcgggggtgttccatcgatgagggtcttaagagacctgccgagggcaaggaccaggaggggttaaggtagtaacttgggaattttgatcggaatggcagcactttgggaggcctgggacgatcgcttgagccttggagttccaggctgcagtgagccatgattgcaccactgcactccagccagggcgacagagcgagactccttctcaaaaaacaacaacaccaacaacaaaagaagtagacttgagaacttcgttaagacattggccagggagtaaggtagccctgggatttgaggttgaggagaacgtgcaggaatggtgggggattttggctgagcaggttgagagaagtctaggagtgagaggcaaaaaaagacgcaggcagcgtcggggaaatcagaattatgtgtctggagagagttttgcggggtgaaggtggcccagtggggctgttaccaaacttttgagtggttatggggctctaagaggtgacatgacaggacccagcccagtaaacacagcacctctttttgtcgagtttggagcttcagagtggagaggtgggaggcttgtgtttgctggacaggtctgtccattaatctaggagaaaagggtggtgtctcagttcctcacttctgtctttccctgtcttctccagggttgccattaggggactcctgaggtcctatctccaggctgcggtgactgcactttccctggagtggaagctgctggaaggcggaccggccgccatgtccacgttcaggcaggaggacgtggaggaccattatgagatgggggaggagctgggcaggtgagctgtctgcccgcacggctgggctccagggataggagagaggcgctgtggggttttctgaacagcagctctcctttcctgttctttatcctgtatgctgagaaggaatgagtcagtatcatgcggtgggggaacgaatttgggccgtggagtcagacagccccggctgtgaattcctgcttgggaatcctctgtgtgtttcctgtggggagaaaagtaattgagccgttacagcagccaagaccgtgcctggcatggggcaccagagcaacagatgccagctgcttttgttattaaaagatgtgtcttctgcctgggcaacatagcaagactccatccctacaaaaaataaaaatgaaaaaaaattaaccaggtgtggtagctcatgcctgtagtcccagctactagggaagctgagacgggaggatggcttgagcccaggagttggaggaggctgcagtgagctatgatcgtgccactgcactgtagcctgggcaacagagtgaaaccccatttatttaaaaaaaaaaaaatctccctgtgttaatcctcttttgtgggaggcactttagtttttttgcccagctcttggatgtttaaagtggggggagggaggggcgtgtctcccagctgggcccaaacctcggtcaattgtttaacatgcttgtgggaaaaagcagaggtttcctcttccagggaggcagctgatttcctgcctgtctgggccttggagggtccccctggggccccaccccctccagactagccaggcaccactaggccctgcctccttttgtagagcctccagccttatttggtgagtttgctactggccagcctccctggagcctccccatgatgtcaccagaagggaatgtaaataagtgagctctgtgtcaggctagggagagtgctgcaggctcttttgggatcctgaggtccctccttcaggaatttcctcgttagtggcagagaaagcatgctccctcctcccccttctcatgcttcagtgttgacccctcctgctaggggtcgtttggcaaaagtcagcaaaattcagccacatttcttttaactcgccgatttcacctctaggaattaattcattggaaaactgtacatacatggatggaatgacttaagactggggtagttgctagaacgtttaccagaataacagccttttttttttttccttgacactatctcattctgtcgcccaggctggagtgcagtgatgcgatctcgactcattgcagcctcggcctccagcctagcctcccgagtagctgggattacaggagcccgccaccacccctggctaatttttgtatttttagtagagacaggatttcaccatgttggccaggctggtctcgaactactgacctcaggtgattcacctgcctcggcctcccaaagtgctgggatcacaggcgtgagccaccgcaccccgctgggaacagcagcctcttaaatggccttccccaaaccactgcatcagggctggaataggatgcagcttgtaaaaagaaccaggcagggccaggtgcggcggcttccgcctgtaattctagcgctttgggaggccaaggcgggaggatcgcttgagcccaggacttcaagactagcctgggcaacataagttgacccccatctctcaaacaaacagaaattcataattttaaaaaaagtatttagccttctgtttttgccgtgaagccttggaggtctggtgtgtatttcatgtcgcagtttttctcgggactggccacacctcacgggtttgacagctctgggtggccagtgtctgctgttctgacggcactgcttcaggtagtggtctggaacattctcagagatacatgaagtgcaagatgaaggcccagaatgtagcaatttttgtttgtttgtttgagacggtgtctggctctgttgccgagactggagtgcagtggtgccatcttggctcactgcaatcttcgcctcccgggttcaagtgattctcctgcttcagccttccaagtagctggaattacaggcgcccaccaacgtgctcagctaatttttgtatttttagtagagacggggttttgccatgttggccaggctggtcttgaactcctgacctcaaatgatctgcccgcctctgcctcccaaagtgctgggattacaggtgtgagccactgtgcctggccccagcccacactttttttttgagacggagtcttgcagtgtcgcccgggctggagtgcaatgccgcaatctcagctcactgcaacctccgtctcccaggttcaagcgattctccttgcctcagcctcccgagtagctgggattatagatgcctgccagcacgcccggctaatgtttttgtatttttagtagagacgtggctttcactatgttggtcaggctagtcttgaactcctgacatcgtgatctgcacgcttttgcctcccaaagtgctgggattacaggcgtgagccactgtgcccggcttcccagcccgcatttttaaacatcatgaactctatcagtagaaattgtcggtgtgtaggccacgcttgggtcgtgtctgggttgtggcaggcacttaggaagtgggttgggagtgacacctgagaccatcactgaggagggcttgctgtgcccccacctgcactgggggctggggaagttacagagaagcgaagagggtgggctcagctcttggggagtttctttcccggctggggagatgaggcacgtttcacattccgtagaggaactgagagcctgccagtggccttgcctctaaggagcaagtctgtggccagtgagaccgggggctgtctggaggtgggcggctgtggtctgctgttgctgtaggaggactcagtggcagaacctgaaatctggttggcaatagcaaaacagggaaaggcgtggtttacagaaccaggttgtccaggtgtgcagcggccgcaggtgtgactgggtgctggtgcatatggtgccctgtgtccccggggccgaagtccactccagcatggaggaggcgccctggcagagtgaatgacggggcttatgtgccacccgcagtgcctggtggctcccctctcctggcctggtctgttcttaggcaggcttcttaggtagccttctatgtggtggcccctgccgcgagcctggatccaagcccagcagagggagagagagatcctctcttcccagcaggcgttcagagccctgtggactggaccggtctctttgggctggaaggcgtggttttctgcttgcccaggtccagtcgtgtccccttccacccctttcctgggccactgagtcccacagactgagagtgagcggcaaaggctgccctgggacagctgggtctgttagcaggagacagcgtggagccgggaggtaggcacgcaggaacccggtacccagcagcagctgtctgcttcctgttagagcacctgggctctggagcctgcagcacctggtttgaaggtttgaatcctcccgccactgactgactgcatgaccttgggctagttgctttccttttctcagccttggtttctttaaaatgcggatactggccagatgtagcggctccacctgtactgccaacacttggggtgggggagtgggaggatctcttgaggccaggagttccaaagcagcctgggcaatacggcaagaccctgtctctacaaaaaataaataaatcaggtgtggtagtgtgttcctgtagtcccacctacttgggagggatcacttgagcccaggagttcgagaccagcgtgggcaacatagtgagacctcatccttacaaaaagaaaaaaaaattaattgggtgtggtggtatgtgcctgtagtcccagctgcttgagaggctgaggcaggaggattgcccgagcccaggaggtcaaggctgcagtgagccatgactgaaccactgcattccagcctgagcaacagggccagaccctgtctcaagacaaaacaaaacaaaaacaaaaaaagcggatctggcacttgccttgcactttttatttttttgaggcaggatcttgctacgttgcccaggctggagtacagtggcacaatctcagttcactgcaacctctgcctcccaggttcaagcgattctcctgcctcagcctcccaagtagctgggattacaggcacccgccaccacacccagctaattttttgtatttttggtagagacagggtttcaccatgttggccaggctgctcttgaactcctcagctcaagttatctgccctcctcgaactcccaaagtgctgggattacaggcgtgagccaccgcgcctggccccctcagttccctcttgatatgcattgaactgttcattctttcacttttcaaaaatacgccggtgccatggtgttaacgtgtggctctgcactcccctccacacacctgctgggcatagccctgggaggggtgggaacgccgcgtctgatggtgtggggcgctaaggaattgctctctgagaaggcgcagagtctgcacccccgcagtggccagctcatgtccttcaagtgcctggtgcagggccgcgcccaagaggagcaagtggaggtgacggggagccagccacccccacttactccctccgcctcctccacccccactcactccctccccctcctccagcggccagtttgcgatcgtgcggaagtgccggcagaagggcacgggcaaggagtacgcagccaagttcatcaagaagcgccgcctgtcatccagccggcgtggggtgagccgggaggagatcgagcgggaggtgaacatcctgcgggagatccggcaccccaacatcatcaccctgcacgacatcttcgagaacaagacggacgtggtcctcatcctggagctggtctctggcggggagctctttgacttcctggcggagaaggagtcgctgacggaggacgaggccacccagttcctcaagcagatcctggacggcgttcactacctgcactctaagcgcatcgcacactttgacctgaaggtgagccctgtagggccctgtggggccggcctggccagtgtgggggtggggatggggcggggaagagcctggaaggcacctcctgcgcgtgggggtgaggtgtggggagcgtgggggtgaggtttggggagcgtgggggtgaggttgggggagcgtgggggtgaggttgcggggagcgtgagggtgaggtttggggagcgtgggggtgagggtgggggaggcccgtgctttccctgctgagcctcctcccaccccagccggaaaacatcatgctgctggacaagaacgtgcccaacccacgaatcaagctcatcgacttcggcatcgcgcacaagatcgaggcggggaacgagttcaagaacatcttcggcaccccggagtttgtgggtgaggccctgcccagtgggcagccccggcctggggagggtggtctggggctgcctgctgtgcgtggggtgggtcatgcccggtgctgggtgccgcgtcctcggccctgaagccacccctcttgggcccggctttgcgggaggtctgggcctccatttggtgcagccccgctgtcctacccgtcaggccctgagggccagctctgccgcattcatgcccccaagggctgcgacatgtgagaaccttgaccccatgcctgtgtcttgagcctcttccttggccagcatgtccccagtgcctgacccacatctccctgttctgcagccccagagattgtgaactatgagccgctgggcctggaggcggacatgtggtgagtgtaccacctgctcccaccgggcctccctgcattcctggagcgcaggccagtgctgcagctggggatgaagcggggccttgctgctgttggggtatggggggaccgttgccctagaacaggggcgctggacgccacggtcctgggagggtgggcggccccacgctgcgctgacccttgcctcttgtctgtccccaggagcatcggtgtcatcacctatatcctgtgagtacctggcgggggccccctcggctgtgcaacacagctggcatgggtccccggctccgtgtgtctcatgtggacgccaggggtccccagcctggctgtgacccatcgcgggtactcaggggataccgggtgaacggatgagtgattctctgtggctgctgtcacagaggcttctggagagttctgaaggcaggacactcacagagcggctgagcaggctccgggttgggggtcgtgtgtgctcctgtccctctggctgctagggagcccagcctcctctcgaagtgcaaggaaggggtccgaccccacgctgggttttggctcctgtccctgggccacacgtgggcctgctgttgtttattatttttatttgttgagacggggtcttactctcttgcccaggctggagtgctgtcctagctcactgcagcctccacctcccagacttaagcaatcctcccacctcagcctcctgagtacctgggactacatgtgcacacaaccatgctcccatgctcggacttttttttttttttgatggagttttgctcttgttgtccaggttggagtgcagtggtgcgatctcagctgctcactgcaacccccacctcccaggttcaagcgattctcctgcctcagtctcctgagtagctgggattacaggcgcccaccaccatgcccagctaatttttgtatttttagaagagacggggtttcaccatgttgatcaaggctggttttgaactcctgacctcaggtgatctgcctgcctcggcttcccaaagtgctgggattacaggcgtgggccgctgcacccagctggctaatttttttttttttttttttttttttgagacagagtttcgctcttgttgcccaggctggatggagtgccaaggccccgtctcagctcaggcttactgcaacctctgcctcccgggttcaagtgattcccatgcctcagcctcccaagtagctgggattacaggtgcctgccaccatgcctggctaattatttgtatttttagtagagacgatgtttcaccatttcggtcaggctggtcttgaactccagacctcaagtgatccggccgccttggcctcccagaatgctgggatgacaggtgtgagccaccgtgcccagctggctaatttttaaaagtttttgtagaggtggagtttcactgtgttgcccagccatattgaatgggcatagctcattcagtaagcaaggaaataaacaatggcgtgggcccagcccgctgtagcgcgtgagcggacccaaaggcttcaggagatgggctagaccgtttgtattctttttaaatgttcagataattcagacttacaaaggagcaacagaaacagcacagacgccccctgcagcttcctcctccttcagtttacatttttcatgaacacgaacgttatgaacaccaagacgttagccttggtgctacgctaatcacaaaagtgctagatgggccgggtgcgatggctcacgcctgtaatctcagcactttgggaggctgaggagggcagatcacgaggtcagggcattgagaccatcctggctaacacgatgaaaccatgtctctactaaaaatacaaaaattagctgggtgtggcagcgggtgcctgtagtcccagctactcaggaggctgaggcaggagaatggcatgaacccaggagatggagtttgcagtgagccgagatcgcgctactgcactccagcctgggtgacagagcgagactccgtctctaaaaaatttaaaaaatttaaagtgccagaggtggttagacacccccgttttccactcctgtcctctctgaggtccccacacggcatttagccattcagctccttcgccgcctccagtctgaggctgttcctctgtctggctttcatgaccttgaccctgacttgtgctcacgggtcaggtgttttgcagaaggcgtctgagtccacgtttagtctcgtgcgctgtcacgatcagacgatcagacggggcttcagtgtctctgctcaaaaccccagggatgatgctgtgtcaccctcccagcgtcaggctgggaggcagacgctgttggggcctctcactgccgggctgttgaccttgatcctttggctaaggtgttggctcgggctccccactgcagttaccctcccctcggcgttactgagcactgggggctttcgggctctgcgtctgcacagatacttcgagtctccaaggagacttctgcctgttcatttctgctgctgtcagtggcggggtgggggggtggattttgaatgcctcttgggtggtgtctgggatcgttgcaggaaggttctaagggctcaggagtgtgagtggcccaggcacctgccgtcagcctgtcttctgtgctccgcctgtcgtgggcagccggagaggcggcgcggccgtggtgggagcccaggaccccactgagcccccacgcctgtctcgcagcctgagcggtgcatccccgttcctgggcgagaccaagcaggagacgctcaccaacatctcagccgtgaactacgacttcgacgaggagtacttcagcaacaccagcgagctggccaaggacttcattcgccggctgctcgtcaaagatcccaagtacgaggggccggcagggggcacggggtgggacatgggacacaggcccactccacccacggaggctccagaggactctcctcccagcgccacctccctgcggctggggatcagacattgcttaccccttgggctggagagagtaaactgataaactggtggcccaagctggccattgccatggttttttttttttttttttttttgagacggagtctttttttttgagacggagtcttgctctgtctcccaggctggagtgcagtgcagtggcgtgatctcggctcactgcagcctctgcctcccgggttcaggctattctcctgcgttagcctcccaagtagctgggattatagacgcccgccaccacgcctggctaatttttgtatttttagtagagacagggcttcaccatgttgcccaggcttgtcttgaactcctgacctccttggtttgtgatttgcctgccttggtctcccaaagtgctgggattgcgggcgtgagacaccgtgtctggctgcttgctgtgtttttagcaaacttttaattagttgccggtgtgtaaagtaaggatccatgtaaaattccaggtcacttgttttcctgtaaacacttagaattctggcagtgctgagccctcactcgtaggcctccccgggcctccatggccgcccagtccctctctcgggcgcctgggtttgcgactccagcctgaggtctcagctctctccaccaccccccagaaaaccccacgctccctgcagtacccttgttcagcttctgtggttggctgagcagaggctggggggcgactttagggcttttgggggtcccgggagtcagttgttcacgggaggacgggacagatggtgcaggtgtacctaaccagagcgggggtcttccaggcggagaatgaccattgcccagagcctggaacattcctggattaaggtaagtggggaggtgggggagctccctgggcttcccaccttggccttctcgctggggtcccggggggccttcagcatttaaggcttgtggatgtgacaacccccagtggctggggagggtccccagaggagtgagcctgtgtggcgggggttgggtcctgggcgtgggatgtccagcacccgacagacctggtggcatccttggctggtgtgtgtccaacggggctgactcctggggccagggccgcagcgtttttctcgagagagcactctcggctttgcgtcgggctgggcagtctccgtcacgaggcgttgactctgctgccggatgagcccctgaacctcagttcacactggcaggtgggggctggcggggctgggtggcatcgcggggaccccgctcaggcttccctccttcctaggcgatccggcggcggaacgtgcgtggtgaggacagcggccgcaagcccgagcggcggcgcctgaagaccacgcgtctgaaggagtacaccatcaagtcgcactccagcttgccgcccaacaacagctacgccgacttcgagcgcttctccaaggtgctggaggaggcggcggccgccgaggagggcctgcgcgagctgcagcgcagccggcggctctgccacgaggacgtggaggcgctggccgccatctacgaggagaaggaggcctggtaccgcgaggagagcgacagcctgggccaggacctgcggaggctacggcaggagctgctcaagaccgaggcgctcaagcggcaggcgcaggaggaggccaagggcgcgctgctggggaccagcggcctcaagcgccgcttcagccgcctggagaaccgctacgaggcgctggccaagcaagtagcctccgagatgcgcttcgtgcaggacctcgtgcgcgccctggagcaggagaagctgcagggcgtggagtgcgggctgcgctaggcgcagtggggtgggccaggccccaggacagccggagctcggcctgcggtgggggcgcttcctgtggacgctgcgcctcccatcgcccgggtgcctgtccttgcccagcgccaccaggctggaggcggagtgggaggagctggagccaggcccgtaagttcgcaggcaggggtgggtgtgggacggggctgcttctctacacagcctccacgctggccttcaccttcacccctgcatcgtcggtgaccctgggaccctccaggcagcgtggcctgtggcaccgtgagggttgggacccaccgaggcgcagaggcggcccgaatgcagccctggttcaggcccggaggagggtttgcgggtagttgcacggacaattcggcggggtgctgcctgttgctgccattagcccaggaggaggtcgtgggacggggagggtgggatggacggcggacaggcagtccccacgctgctgggtggcgccgggcttggtggggtcttccactgtgtgcccttctcgccgaggccggtcccccgggtgtggggtgccctgctgcggactcctccgcgagccccatcgtcgcgcctgtggacgcctaggcaagagcggccctctgcagccaagagaaataaaatactggcttccagatacgcgggtgttgtgtgcctcaggccttggcaggggacagccagcccttggccaccggggatatgccctccgcggcgttcatgtttctctctgtgttccatgcctgccgctgtgctcaggaaggagggcacaaaccgggggtcctcgcagaccttcacggtgtcctgggagctgccggatcttggtctcagctgccccgagtgttttgattgcaatgaggtggaagctctgggcagctgaggtggatcagaagcgtttcctgtccctttgcgccttacgggatgctgctgtgtcccacgtgggagcccctgccccgtctggagccacatgcaggtggccctggagggggagcggctcagctcagctgctagggctcacaggtggtttcagagaggggccccgaccctgtccatcctccctggaggaagtttttttgctttttttttttttttttttttttgagagcgagtctggccctgttgcccaggctggagtgcagtggtgcgatcttggctcactgtaacctcggtctcctggactcaagcgggtctcctgtctcagcctcccaggtgtctgggattacaggcatacaccaccacacgtggctaatttttttttttttttttgaggtggagttttgctcttgttgcccaggctggagtgcagtggtgtggtcttggctcaccgcaacctccgtctcccatgttcaagcgattcttctgccccaacctcgcgagtagctgggtttacaggcatgtaccaccacaccgggctaattttgtatttttagtagaggcagggtttcaccatgttggtcaggctagtcatgaactcccgacctcaggtgatccgcccgcctcagcctcccaaagtgctgggattacaggcgtgagccaccatgcctggccgtaatttttgtatttttaacagagatggggtttcaccatgttggctaggctggtctcgaacttctgacctcaattgatctgcccttcttgtgctcccaaagtgctgggattacaggcgtgagtcaccgcatctggccatttttttttttaacttttttttttctttcattgagctatgattcacacaccctaaaatctttcttttaaagtgtgcaattcagtggttttatacattcacagaggcaggaaaaggtacatccacacaaaaattgtatgtgagccaggtgtagtggggttgcctgtggtcccagctactcaggaggctgagacgggaggatcacttgagctctggaggtggaggctgcagtgagctgtgatcccgccactgcactccagccttggtgacagagcaacaccttgtctcataaatgcacggtacaccgggcacggtggctcacgcctgtaatctcagcactttgggaggctgaggtgggcggatcacgaggtcaggagatcgagaccatcctggctaacacggtgaaaccccatccctactaaaaatacgaaaaaaaaaattagctgggtgtggtggcacctgtagtcccagctactcgggaggctgaggcaggagaatggcgtgaacctgggaggtggaacttgcagtgagccgagatcgcaccactgtactccagcctgggcgacagagcgagactccgtctcaaaaaaaaaaaaaaaaaaaaggaaaaagggtgaaagtggtgcattgtatgttatgtgtattttatttatttannnnnnnnnnnnnnnnnnnntttttgagatggagtctgcctctgtcacccaggctggagtgtagtggcgcgatctaaactcactacaacctctgcctcccaggttcaagcgattctcctccctcagcctcccgagtagctggaattacaggcacctgccaccacacccagctaattttttgtatttttagtagagacggggtttcgccacgttggccaggctggtctcgaactcctgacctcaggtgatccacccgtctcggccaccgaaagtgttgggattacaggcgtgacacgcgcac

SEQ ID NO: 11938 - DNA, 8514 bp, Human
gagccagggctccagccgtgcggttggcatccagcctgcctctgtggcttcccacctgctgggtgcactgcctgcctttctgccctggtcctctccaaattcaccctctaactgtatcagggacccagcaggaagtcaaaggtacactcacatggggcatgtttagtgagagtgtcataaagagattatacacaaaggtgagcgtgagttttagaaaaaagccccatgagagcgtgcggtatccaggggtgtcccggggcagctgctaccacccctaagcctgaaagagcagtggatggttatcagttcccagggagggctgtcgcccaggcgctgtggccttcagaagagggacccagcagggagggagctgggacgtcagcaagccctcccctcccctccctggatctccttctggagccctgtgggcagaacctgatgggcgacccaagaaagaggagcccaggacagacatcatgaggaaggcgggggcttctgcaggccacaggcaactgccagcccacccgcgtggggcttctcctcactgtgggcaaagggatatttctacatctgtgggccctgctttgaactctccatcccgcacccagccccagcaggcctcaaaaaattcccacaaagacaaaagccagccttgacttccgtgggcctgctgtggggccagaaggttacagagctcacatggtcttcacggtccttccctatggtccgattcccattttacagatgagaaaactgaggcctgggaccagcaagtgatggcatttgtggaatgctcagtatacactaagcactgtggcacgggctttacgggtgttaactcatgttgtcctcagcaccatccccagggaggtaccactactctccttctgatgaggaaactgaggcatagcgaggagcagttgtctcccaaggtcacacatgctgtaagagccaggcctagaacccaggggtcctgctgccaggccaggcccttccctgaactctgggctgctcccagtgtccacaccccagtacttcacaccctggggccactgtgcacctgtcctaatcatcctgagccaggtaccagacatccacggacagcccccatacccaggagcccatctgtagggagtctgccatctaatccaagtctccccacagtcctaagaggtggctgggatgggtatgggtctattttacagactgggaaactgagagtgtcccggagctcatcggagcaaagctgggataaggaggaatgtgtttctgtgtccatggtctgggtctctcttgggtggtgcagggaaccaagtgcctcttgcaggcggtactcatgttgcctgggtagttaaggagaagcccacctcatctgcgggcctggctgccaggggtggctgatgtttctccctaggtgctgtttgagattttcaacatacctgccctgtatttagctaaccgaggagtcctttctctgtacgcctctggccagaccttcggtgagtagccctgtgggagccccatagcctccgcctccctccggctgagacgctcaccactgcgcgcagcccactccctccctgaccagtaacgaaagacaaagacccacacagctcgcactctccagaccctttcatccctcctggttaaatgattcgctcccaggttttaacagtttactttactcacttttttttcttaatagctttctcgaggtgtaattgatatacgataaattgcatgtgtttaaagtgtacaatttgctaagttttgacacatgtgtctactcttgaagccttcagaaccaagataatgaatgtatctgtcacccctaatcttttccctggcaccacacagtctgcccctccagtctgtccccagagagccaccagctgccttggagtctgcattttctagaattttgtatgaatggaccagaaggtcagcacttttttggggtttcttttttttttttttttcacacagtgtaattacttgaagatttattcttgtgtgtgggttgagagttcatgtcttctcattgctggatagtagcccatcttatgaatacattgtactttatccacttgtgaacgaatatttgagttgtcggtttggggctattgtaaataaagctgctatgggccgggtgcagtggctcacgcctgtaatcccagcactttgggaggccgaggtgggcggatcacgaggtcaggagatcaaggccatcctggctaacacggtgaaatcccgtctatactaaaagtacaaaagattagccaggtatggtggtgggcacctgtagtcccagcgactcaggaggctgaggcaggagaatggcatgaacctgggaggcagagcttgcagtgagcccagatcatgccactgcactccagcctgggtaacagtgcaagactccgtctcaaaaaaaaaaaaaaaaaaaaaaaaaaaaaaaaagctgctatgggcatttgtatacagtataagtactgtgtaagtattatttgtcaattaaaacaataaaaggaaaaaaaatcctggtatgatttttcctcttctaccttttggaccactactgtgaaacctgcatgtgtggtgtcataagaaaacttgtgggccaccatccacaacagccagcccttttgttccttcttgtgcactcccctttcggggaagaaagctggctcctgagaatctttgtcttctcctctgttagctcccctctgccttctctcactgcagatataacaattgtaagggatgtcattggctttgcattatggtaccagcatgttctcttgtctaggcatgactgttgaatctggagaaggaatgacacacttcgtgcccatcgctgatggctgtcctttgcatcagtcaaccttccaggtggacatagcgggccaggacctaacctcgtacctcctgcaactgttgaaagacaatgtgcaattattggtgggcacaggtaggaaattgctattcttggctgggtaaactagtctctggggtataatagccttctttgctagctcaacctacagccctcagtgtgtaaagctaagactacttaaccatcattcaagttctaaaaacaactttatttatatttagggacatttagtggattgatgatgatgataaggacaatgataatgatgataacgattatggtggtggcaatgacggtgatagtgatggtgaccatgatggtgatgacagtgatgctgatgatggtgatggtgatggtcatatggtgattggtggtgatggtgatgatggtggtggtgatggtgatgatgacaatgatggtgatggtgatgatgatggttatagtaatggtaacaatgattgtgatgatggtggtggtggtaatgatggtgatggtgatgatagttatgatgacagttgttaagatgatgatgagctaaactttatagagaacttatcctgtagaaagcaccaggccaagtaaacatttcacatgcattttctcattgcttctcactataaccctacgagagggaacaattatttccattacaagaggaagatgcagccaggtgcaatgtctcatatctgtaatcccagcaatttgggaggctggggtgggaggatcacttgagcctaggagtttgcgatcagcctgggcaacacggcaagacccggtctctacaaaaagattaaaaaattagcagggtgtggtgatgagcaacctgtagtcccagctacttaggagactgaggcaagaggaccacttgagcccaggagtcagaggttatagtgagctctgatgatactactgtatgccagcctgggtaacagagcaaagcaacaccctgtctcttaaaaaactaataataacaggaagaggctcaggaaggctattagaagatttgcccaacattccataaatgataaatggtatagcagctgggatatgaacccaaggctccaggtaaggtgcctgtccttctctgcacccagttcctggactagattcccagcctgtataacctgcatgacacccattcccagtgagcctacaatcttgcatcccagggtcttccttgaagaccaagaggtctgtgtcaaaagcgatgcaaagcatggaatcttaaagaataacagcaattagagggaaagtgagaagggttgcagggcaaagtcatagcatgttattgatgcctcacacctggtgagctcttggtgagcatcgttgcctctcgtccttccaacagtcctgcgaatgatcatttatcccattcttgcagataagggaagggaaggtttaagaggttaatgaagtttcctaaagccaggcattgggtcaatggcagagatgggatttgaacccaaatttgcctcatcaaagccccaactacatgaagaaaggaacaaatatcaggagagtgcagcatcccagaagccgaggaaagaagggagtgattaataacctcagctgccgagggaaagaggtcaggaaagaaccaaagagtgtcctcaggtttttggatctaggagtacagaacagacccaggcaacagcaggttaggtggagcgagtgaaggtagaaggcagacgtcagggtgctgaagagcaagtgacatttccaggtgggcggtgcagagttccccgatccaactcaaaaagagtgatagaaaaagtgtaaaaccataagcgagaagacacagctgggtttaaagcctgttgtcagccatccaaaaagagaaggagtgtatgtaaccttccagatatttctgggtggggattttgatccactgtgggcaattctccagagaagagggcagctgtgagcaggcggcagctgggggatggggcaccaacagcaccgctcatagcagtagataagaaagtcgggtttgcttttccagctcccccccaccctcccccaaacatacactgtatgtagaaggagatcaacttctgaaacgctgaaatttcctaatcccttttatcttagttcaagacatacttattctactcttccacaaactcaggctcaacacatggcacaaacaagagtgccaggagtgtgaaatggaaatagaaatgacagctccagtggtgcagcctcaacctcaccaaaggtgcttctgtgaactcatctcattttcatgcctttttctgtttggcacttttcctttgtcccacaggggatcgagagtacatccgggacatgaaggagaaatgctgctatgtggctttggactttgacaaggaaaagatgaaaactgattcaccttcatgccaacagaaatatcagctgcctgatggccaagagatcaccgttgggcaggagagcttcttctgccccgaggtgctcttctagtcaaaactcataggtgaatccgcaggaaggggacagaaattagcctggacatgagcaagcgaacaccctgtaaggaagaaggggccaggcatggtgcctcacgcctgtaatcccagcactttcggaagctgaggcgggtggatcacctgaggtcaggagtttgagaccagcctggccaacatggtgaaatcccgtctctactaaaaatacaaaaattagccaggcagggtggcatattgcctgtagtcccagctactcaggaggctgaggcaggggaatcgcttgaacctgggaggtgggggttgcagtgagccgagattgcaccactgtgctccagcctgggcaatagagcgagactccatctgaaaaaaagaaggacagcaaggaaggaaggagggaaggaaggaaggaaggaaggaaggaaggaaggaaggaaggaaggaaggaagggaagtagggctgccaggagggggtgtggtttgagtagcaaacaggcacactgtttcaaaagctcctctgacaccagctaacactcactaggcacttacagtctgcctgtcacttcactgaccattgcgagtgttatatccttgaatccacccccaaatccacctctgtaaaattatcccattttacagagaaggaaactcaccaaaaaggtcttctctttcaaaatgtattgtttgtactctgcctacttacaaaataatctgaaatataaatttcaatacaatttaagacagacatgtaatcaccctggatttggagggagctttacaaatgtggctgatctagagactttgagttagcatggagctgcctaaacgcttcagctggtacatttgtcctggtggaacgggagaaatgacagagggtgaaatccctactggtggggaagatggaatctccctggtcgacatggaaaagcaggtgttccccggagtccaattcttcatttgttaccttcataaaggacaacggggaattaagggtggggaagtaaccatttccccaggttgaggactcagtgagtacctggcacttagaatcttctgtaagttagttggtttatctctgtgttcctctgttcaactgtgcaggggatggtctggtcacgtgcaccaccaatgtgaagtagagaagaaattgaggttcttcacccactgtggggaagttctccccggggtctggctgggtcccagtgaacaggagcaccaccccagatcggtgaaactagcagggcctttctgctgggcctctcttaaatgccccttggggttagccttttgtcatgagtccaaggttattcggcaatttttcctcacaggcaagaggcacggaaggcaccacgcagccttcccaggggctcacaattttgaacagaaaatattaggttggtgcaaaagtaatcgattacatttgcaccaacctagtaatacaaggcacacatctcttcagggcagttctcattatatttgagtttattcatgtggccaaatgatgagccaagaaaggagggatcagtgtcatttctcaaagactgcctgaaggaggatgctgcctcgacaggaatctttttatacaattgatatcaaggcattacatgttaagaactgtcaataacagttgaatataaattctcctggaggagagtggagaattcctatttatttcctcaaccaggagcagctgagtcctgtcatctgaccgggtggctccctgcattccctgatgggagcccagctaagctaaggtttgcctaccttgctgggtgttacctaaggctcagggaggtttccagcacccaaggccttccgctgggaggcaggggcccaggtgtgcagccgccaagcctctggcttccaacattctttctccctctgcctgtcctgacagggaaaaacacccctggcatccacacgaaggccatccagagcatcacttcctgcaaccccgacctccagaaggttctctttggccacatgctactgtccggagggacgggctcctgccccggcttgcgattccggatgcagagagaaatatctgagctggtgtcccctacagtttatgtgaaggtgaggcttccccaacccatcccctctgggagcgcttcaaattcattccacagatgtaccttgaacgcatcagatacgccaggcacggctcctggcacctgggaagtccttctgggaagtctttggagctttcactctagttgccgggggaagcaataaacgtcatgaataaacatgaaggggacatgagtggcatgtcaggagggctgtgatccatggggaaagtgcagcaaaggacggggtgggagggagtgtgggcagggccgggggtgctgaatacaaggtgggccagagtgggcctcctcaagaagaggacattgggtaagcacttgaggtaagggtgagccatgtggatatctagggaagaacattcagccatggggggaacagcccatgcagtggctcagaggcttgcttcctggaggaagggcaaggaggggttggctggggccgagtgagcaaaggcaacaggaaagcaaggtcagagatgccgcagaaggacatccattccaagaggggctggaaacccccggcagggttcagcagaggagagacattgtccaagtaggctctggagaactgctcaggctcctgtgcagagagtagatgtcatagggacacaaggtgtggacagtcaggacattaggactgttgggatgttgggactgtcaggacattgggactgtcagaatgttaggactgccaggatttggggactgctgagatgtcaggactgtcaggatgtcgggactgttggaatgttggggctgttggaatattgggactgttgggatgtcgggactgttggaatgttgggactgttggaatgtcgggattgtttggatgtcgggactgttgggatgttggagctgttggaatgttgggactctttggatgtcgggactgctgggatgttgagactgtcgggatgttgggactgttgggatattggaactgttgggatgttgggactgttgggatgttgggactgttggactgttgggactgtttggatgtcgggactgctgggatgttgagactgtcgggatgttgggactgttgggatgttgggactgttgggat

SEQ ID NO: 11939 - DNA, 6100 bp, Human
caaggagaattccctagcccacctgaaagacccctacccagagtggtgaggggcagcttaggagcactgacgcaagggggagagaccaggctggcttccctctacgtagtaagttcctggggtgtgcgcccctgccccagacagcagagaaatcgcctgactgggagatggagaagaggggccaccttctcatgccaccccgccgccaatcctccaggcacactcgggcgcttgacctgctgaagcctgtagcctcaggtccagtgaggagctcacgggacagagggccctaccagagccacgaaaaccggagggggggacctccgcccaaggcaggcgtctctgcgcgcccgctggggccctggtcctgcagttggcttctcccgacacgttccttcgctgccgaaagcgattcgcccgcgctctaccgagcccagccagctcctacctcggcccgggcggcgagcgctgtctccgtcccgagaagaagtttcgcggctggtcccggggcggcaggcgcacgggacgctggcggcggcggcggcttccgacttgggctcagaccccgccgctccagacaagtccccgcgactgcgacagtgtctcgggcagttcagctccccagacgggagacagaccctcgcgacctggttcaggccttgccctgggggacactgcagtccaaggcgaaaggagacttgctcccggcctctgggtccctaggtcaaggcacctccccgccccgccgcccctgagcccaagtcgccaaccccgcgccgcgcgcagcgagggatcagaaggtctcggacgccgcggcagggccggccagggccccacgagttagggagttgccccgcacccctaaacgctcagcacccatttacggttgaaagtacgcacttgacgcgtccgggcgcctccgcggtgagtcgcgccgccgctctcggggtccgcgaaggtggctcagttcgggcgctccagtctcgacgttcccggggtagagagcaacgtccggggacgaacgggacgggtgcgcccagcggccggggctgcgctgggcgaggcaagcggcgagaggggagcgctccggcgttcaggcaacagctacccctagtgggagagccgcccggggccggcgccgccccgcgcccgctgccccgcgccccacgcccgtggcgccccgcgcccgggtcggctgggggcgcagggccggcgccgctttccccagctctccggtctccggcgcccggcggtaacccgcccgcgggctctgccctccgcacctctcagcccggccccggcggccgctgacccaggaaccgcggcgccccgctggaacgagatgggacggggcgggcgcggccagggcggcgcgggctggggcggcgcgcggcagcctcgggcagcggcggggggcgcggagcggcggtgtgcgtggcggggcggtgcggggggcggccgtgtgcgaggcgcgagtgtgagcgcgcgcgggaggcgggcgggcgggctccggcaggcgagcggcgcccgcgggcgagccaggaaggcggcgggaacgcaaagttgcctcctcgctggcccgcgtcctcggtggggcgggagccggggccaccgaagcggcggccgcggacccggcctcccgcggcacctgggcagcggccccgcacgagcggcagcggcgtgggcggcgttggcggcggcgcgcgggaagcgaaccggagctccggcgcggctcggcggccgccggggagctcggctcaggtgcgcggcgaggggggcgcgggccggagccaggcggcggggaccagggcggcgcgcagcgctcgcgccagctggaggacctccccagcggacgcccaggtccctggtcgggctcccggtccccagcggcagcggctgccggagtcccccgcccccgagagctggctgcggggcccgggcccgcccccaccggccccaggcccggccgctccgccctccgcccgcctgcgcccgccctcagcccaagatttctagggcattggccgcgctgctgggtgatccctccgggctcaagttgcaagggggcgggccgggccggaggtggagtctcccgccaattgaagcctccgctataaattgaactccctgcactgctgaagcccagatgcctcgccaggccacgtcgcggttggtggtcggagagggcgaggggtcccagggggcttcggggcctgcagccaccatgctccgctccctgctgcttcactccttgaggctctgcgcccagaccgcctcgtgcctcgtgctcttcccgcgcttcctcggcacggccttcatgctctggcttctcgatttcttgtgtatccgcaagcatttcctgggccgccgccgccgggggcagcccgagcccgaagtggagctcaacagtgaaggcgaggaggtgcctcccgatgacccgcccatctgcgtgtccgacgacaaccgcctgtgcaccctggcgtcgctcaaggcggtgtggcatggccagaagttggatttcttcaagcaggcgcacgagggcggtccggcgcccaactccgaggtggttctgcccgacggcttccagagccagcacatcctcgactacgcgcaagggaaccgcccgctggttctcaatttcggcagctgcacctgaccaccgttcatggcgcgcatgagcgccttccagcgcctggtcactaagtaccagcgcgacgtcgacttcctcatcatctacatcgaggaagcgcacccctccgacggctgggtcaccacggactctccctacatcatcccacagcaccggagcctggaggaccgggtcagcgcagcgagggtactgcagcaaggtgcacccggctgcgctctggtcctcgacaccatggccaactccagcagctcggcctatggcgcctacttcgagcgtctctatgtcatccagagtggcactattatgtaccagggcggccgtggccccgacggctaccaggtctctgagctgcgcacttggttggaacgctatgatgagcaactgcacggcgctcggccccggagggtgtaaacatccaacggacaattgactgaacttggtgggctgggccttcgagccttcgaagcccacgtgcaagcgcctcaaaccaagtcacgcttggcgaggccccagtgacactgatgtgctgagccaccatttcagactgagtctgcaccctcagccacatgaacaatctcccctacctccctgggactctgcttctgtaactgtctcattcacacctgcctggctcactggaaatcctcttttgagcgcgggatatggcttgcccttgtccgtgtgcccccaggactttgcctctacagcattttcttacaccccctccccagcgtgccctcagccaagtgctttggcccggtgcttcccgcagctgcacagagaccttggccacgcccgcgcgccctgagcgcagctgggttccaggagactctcagctcagctgagctagttgcctggcacccacctgtcgcgcgcggagagggggttccctgttgcttttgtgtctgtttcctgtccctggtaggggaagtgatgtcgtggatggggaggggtgggcagggtagtttcccccgcttgttttgggtgcacaggagccccactgctgatgacgaactatctctaactggtcttgaccacgagctagttctgaattgcaggggcctcaaagcagcacctaaaccttgagggggagggtgctctgggtttccgtgaggtaaccaccttaaatgggagggaagttggggtgtctgctttgggaccagaggaagatagcttgagaggcattggcgaggttcgcagcgccccagggagagagaaaaagctgagactcctggggaatgacgttggggtgatggagtccggggaaagagaggtggggggagagcctgaggtccccaagtgaggggagtcctaggcagagctgctgattgtggggctgggaggtggagggcccctgattcgaaggccatttggtgagtgttttgctggaaatatttcctgtatataaacttctttcaatctacaataataaaggcttgaggtaaactgctttctggttgcctttggtccctttattttcttttccctctgaatagcggcaggaattaaacacaaatccctccctcgcgtccccatagtgaccttgggaagcgggacgggaaggagcctaggctggcaggggcgctggaggaggatggaggaggaagagggtctgcggcggtgcccggggcgctcctacaaccgcacgcacccacctggacggggaacttagctgcgggagaagagcgaggtagcggagcgccgcgggatcctggaaagcggcgggagaggcaagggggccctctcttgctcccgcgcgcgcacacacagaccgaacagatgcagctgcccctgcagccgccgatccaacttaactgagtatccggcggtgtgtggagggggttgggtgaggtggagggcgagaggggctttggacccggtacagcctggctcccgaccgctgcaggcaccactgcgcacctgactcctccctggcccccttccggcacctgcaaccttgcctcttgcccacccgctccaggcagctgaggtccgctggaggcgcgccttggcagaggggcgccctcactccagctgcggctcctactgccgggccagcgtgctgctgggtgcgccccctgcccaggacccccctcctcctgtccctcctccgcttccccaagctccagtcaaaccccaccacccgctccgtgctgggaagcagaggtgggaggccgctgggatgaagagagagagaccagggagaggtgaatggtggattccagggctggggcggggattcggggccttaggcacaggtcccctcttgcagtcacggccaggggctcgctctcgcgcaatccccgccctcactgtctcgcctgttgcgcccggagtgagggcgacccgggggacgcgggattagcttagcccgcagcccctgtgccagcgaaaccttgaacattaagtgaaaggtgggggacacagtgaaagccgctgaggcgggagtgtacggatccaggtgaggggactgggcacggcaacttccctggcgcgccaggacaatgcctgggaacccaggattgtcagggtcgccgggggtgggggtgagtagtgtcggtttgcgcgcttggatgtgagcgcgggtgtacatggcagggttgggtaggggtgcagaggggcgcggcaggcaggatggaagagacgcccccgttcagccaacggcgtccctaattctgcgcccagcccccgcgctgctcctccgtaaaaactttttgaaactgacatcctaaatttgtggatttttttttcctttaaaagtatctcaattgaaaaataactttaaagaaaactttggcacccacgaaatttctgcatctcctccccactaccaccaacccctacctacctccgcgaacgctccttctcatcccgaaaccgccaggaagcaaaggagatcgcggcagggacgcggcccggcgcctgggagagtcctccctgacctccccgcacgcgcggctggccgggactggagcttggtggcgcggagggtggcctgggacagcgtcagcctcccggcccagcagagaccgctccagccgctccgcgtccctaccggtggcttgggggtccccttggacgcgccaagcgacctctcctacccggaaagcctgcgccccctgggcttcctggagcttcccagatcgaaactccaaaaagcgctttcgcgccgcagcgccgggacctgcagcgccagccactccccgcacgggccgcactcgctctggtcgcagctccagggaagtcccaccacccccactttttttatttctctcttcttccttcccttcctccctgcttccccttcatctttccttttctttctctcttactttcccctccttctttttctgtttcttcctttcctttcttctttctctcttttccttgaaaatgtcccctatgaaagcaatgcaagctcattgccgatacaacagaactccgagaagg

SEQ ID NO: 11940 - DNA, 481115 bp, Human
  misc_feature (1)...(481115): n = A,T,C or G
tgtgggtcattgaatagtcggtctggtaaatccatatgaaagacatctaaattggttaggctaaataatagctaggcttacctgtacagaaagaaaagcatgacgtttagtcaattctgaagctattgcttgtgtgtgtccagtctatatgcaggaaattaatttaggtttattaatgggagtggactaatttgtatacttattatttgtatttgcatttgagatacagatttataaattaggatgaagcaattggcaatatgcatttatcttggcatccttaggatgtcctcatgttcaaagggaaactcagaagcttccagttcatgccaatagtgtttcccttatgatggatagacttaaaaactaagtctaggcccggcgtggtggtgagtgccaggtagtagctgctagtagcaggtactagggaggctgaggtgggaggatccctggagcacaggaggtcaaagccgtagtgagccatgatcacaaccactgcactccagcttgagtgacagagagagaacctgtctcaaaaaaaaaaaaaactaagtctaaacttgtagatcatctcatgatagattcatagggaaatgatacagttgaccattgttctggcaggttccatgtgctgagtcctcgggtatatatctcacaggaagtgattctagcttgggtgggtcatctgcgttctctgttggccgagtaatcactggccgcgctgtgggcaccagagagagagagagtatgggcggttatcagtctgtctcgctgtctttagcctgcagaacctgtgtatcacccggttttgtcactgtctgcagggatgcgcgtcttctttggacagcgcagagcctgtcccatcacccagcggcctgctctgctactttctcatagctcgttggactcctggaatccttatgaaggatccaggcaggcgatgccaagttttcctttgagctgggaaggtagcaggagtccactatgtctgcttctagttccttcttccccagaatgttctgtaacctggggaggcatttgatgagggtctatggtgaatgcccatttgtggggtttgcttactgtaaatgaggtcttacttctgtgctggccctggagtaacgcacttgaggtgtacttgggagtgaggctgtgggagtttcgccctgtcacccgggctggagtgcagtagcacgatctcagctcaccgcaacgtctgcctcccagtttcaagcagttctcctgcctgagcctccggagtagctgagattacaggcacgcactaccatgcctggctaatctttttattttaatagagacgggggttcactgtgttgcccaggctggtctcaaactcccgagctcaggcaattcacccacctgagcctcgcaaagcgctgggattacaggcgtgagccactgcacccggccttgaagttcttttttgatgatggtgtttgtgccttgatagaatttttaggctgagagatcatggagtttatgccttccttatcagtgaggctgtttagtggtgctggccttggaggctaagtgacttgtccaaggtcacacagcaaatgagcaacaagtcttggttgggtggccttgcacctgcccctcgtcctgtgctccacggttcttctcgtggtcagtatcagtgggcggcagccgcgcctccttccacacagctactgtggctgtggtggcaacccactgggattatgatgataatgacttttaaatgaaagcttaatttaatagttggatacattaaaagccaaaatagagcagtttaaaagaaaaaaaaaagccaaaacaagaaagcaaggagcaaagagagttattttccttaagggatccttggtcttcagccagaatgggcatttgctgctcttgacggaaccgctctttggctccttgggagagcgggtggtcagggcgtgggaggtggccaggcaggcagcagaggagcagtggctgggaacgaggcttcctctaaatcatgttactaatgaagcttgtgaagttctcccagttgggccattaccaggggcttcctatgttctcagtaggaagaagagtcttgagctcatttcttgcgttttttttaccccctacaattaaaagcccatctcactttaaaacagacaggtctgttttgttcttctctctgtggtccccattcgggatcctgatagctgcctgccagaagggaagagccatgcagaaagtttctccctagacccgtttttcctccctgattctaggctggtgatcctcattctttttttctttatttttattttattttattattttaagttttagggtacatgtgcacaacgtgcaggtttgttacatatgtatgcatgtgccatgttggcgtgctgcacccattagctcgcttttgagacggagttttgctctgttgctgaggctggagtgcagtggcaggatctcggtttgcggcaacttctgcctcccgagtagctgggattacaggcctgcaccaccacgcccagtagctaatttttgtatttttagtagagatgagggttcaccatgttggccaggctggtcttgaactcctgacctcaagtgatctacccacctcggcatcccaaagtgatgggatcacaggggtgagccacctcgcctggccggtcctcattcttaatcagcttttagttcaactcttggagtcatgcttttaagaagaatgcataggaggcaaccttgccagttacctgggagtgccagtggatactgcgatagtccttggctactgaggactcagacagccgtagccagccgtctaacaagggacaatggtgtgggctgccatgggtcatggatgccatcaatagtattggagcccctctggttgtcggctaccctgagaggggtagagtgtcctctgcccagatgataaccaagcagatcattggaaactttgagatttttcctctttctagaaaactttatcatgatgaaaattgctcttgtcatgtatttaaatggtgagactgttttgtagaaaatatttcataatcatctaatatgtatttgtaataatctatgaggataggtagacagtcttgcaaaattcacaattacgctattaataatggattgttttttaaatgtatgatttctcccccctcaggtgatgttcgaaatgatatctatgtaacattagttcaaggagattttgataaaggaagcaaaacaacagcgaagaacgtggaggtcacggtgtctgtgtacgatgaggatgggaaacgattagaggtatttattgtggcgagggctcatctgtagtgtttcagttttacttgccaagtgctcaccttggctctgctacagcatagatgtcgtcagggtggggctttggagtcccgtttcttgggattggcgttggttcttgtttccttttctccagcttgccatgcagggcctggggtcctctggtcctggcagctggcctatctcaggaggtccctgtggtcttttttttttttttttttgagatggagtctagctctgttgcccaggctggagtgctgcaggtgtgtgccaccgtgcctggctaatttttatattttttagtagagatggggtttcaccatgttgacctcaaataatccgcccgccttggcctaccaaggtgctgggattacaggcgtgagccacagtgcccgagcaggtccctgtggtcttgaccacctttgcccaaccttatcgtggagtctcatttgctgtcacaagcccaaggcctaaaggtctagcagtcacactagaagtacagataccattgttacgatttgagagatgaagaaaaatgaaggccctaagaaatcaattaaattgctcagcgttagagagctctaggggtggaactgagcacctgctcatgacagccagagctctgacctcgtgctctacctaccggcgatcatgaagatctgcttccgtggccacagcagcctgcagggtccacctgggaggtacttagaagctattgcctcctctgatgaccagaggtcaaatcagagctgctgtccctgtgaggtgcctctttgcaccagtgctggaggactgggcttttctgggcccatggggttgtgcctaaggctcagtgtcgccaagagaagcatgatgtctttctctctgggtgaaccccgtccagcatcactgcctgcctcgtctccctggaaacataggtgctgcccttgccactggtctttctggttggagtgaagcaaacagtgttcatggctggaggaaggggaggggagggttcccactttttagtctacagtccctcaccctagacctatgggacggatcaggcaacttcctgcagatcctaatgttaaagttattagggttgagggtctggggaactggaggtcagtgtcatccccatgtgtcataaccatcaagatcttcaatgtgtgagaacaggggttggagctggccgctggcttcaggtggatctgtgcttcccttgctgggaacgtgttcatttgtggtgggggtgtgttggtgttcttggagcgtacctgtccccccacatatatagtgggagatgtatatggtgtcaagctctatgaggtcttacgtgagctctttatgtcttcttttaaagcatgtgattttcccgggtgctggtgatgaagcgatttcagagtacaaatctgtgatttactaccaagtaaagcagccacgctggtttgagactgttaaggtattatttacatggtcattttatcacatggcgctgattatgaaatgctcatttgtaacccaaggaaacatcctaacatcctcctcagcccgggagctgctccaggcaggcagagtgtctcccaacaaagtcattcaaggttgctaaggaaccacactggtgtttcttagaatacatttactctcatctccttttggacgtaaaaataggacgttcatggagacaaatgacagagtctttttaagatagctattgtctttctcttcccagtactgttttatgtgtggcatgctgtctttacaccaaacaaaaaaaccgagctgccagcctgtggaggtcattgctggggagtgggatcctgttctgtagctctgatatggtgccttttcataatgcagcgtgctcacatctccacgatggagtaaacaccgtctcaccgccaagagcttgaatatttgaaaaccaggccaggggttggctctggaatacagatgtttgatgtgagaattagggacaatttttgcttagaggcagcatgtattaggtcttttttctttgagtgtaatgtgacaacaggaaagcttttttggcgcagctgtgggcaggtcaccacagctgtggaaggaatatagacccttccaggttggggctaagaagaaaaacggcaacttttctttttttgagacggagtctcactctgtcacccagactggagtgcagtggtgcaatctcggctcactgcaacctccacttcctgggttcaagcgattctcttgcctcagcttcctgagtagctgggattacaggcatgtaccatgatgcctggctaatgtttttggtatttttagtagagttggggttttatcatgttggccaggctggtctcgaactcctgacctcaagtgatccaccctcctcggcctcccagactgctgggattacaggcatgagccaccatgcccggcccaaaaacagcaacgtttaaaagtagaatcttggccggatgtggtggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaaaaaaaaaaaagaaagaaaaaagaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagtcaccttcggtttaccttccgccacaggtcatcacaggactgtgagtagtcaagcactttcttcccccaagtatttttaagggagaactgggggaaagcgcgagaggccactctcagttgttctggaactcgctatcataacacaataaggctcatttcccaccggaacctattccttggaaacattcttctctcttttccttgagcagatctcaggaggagatcttaatttccttctccagttcctcctacccagtgttgctggtccccttctttcttttgctttccagtcttccgtgttgacttgccatccatccatgccatccatcagaaaagttactgagctgtaacaaatacctctcaaacatgggctcttaaggtgcctgtcttagaattggaaatcttgaaccctttttgtcttccttggtggcccttgctgtctggagctcagggatggcttttctcatagacatttttgtgaatactgaccatggtgccaagactttaggaggaaagaactgctatttgaatcactctccttcaaaaagaatttattattgatgactgaaatttgttccatcacattttgttaaattaattgtcaactaaagctgtagccctgtgctagacagtaagatatcacagaaggaaaacatgattcccatctttcagggtgtgtgtctctttggcattgggaactgagacatattcatatttgggacaataaatgacaaagagagttggctacaggcttgtgtgccgcaggcagttaaaggaaaagagtggtgtggagggcagaccgccctttgtcactgatgaccccgtgggggtcacaccgtgcagtgggcagtttcaggttctgtgtgctctggatggagcttaagcatgagcctcttctgtatcttcatttgaggataagaatacctttctggctggtgccgtggctcacacctgtaatcccagaactttgggaagccaaggtggaagattgcttgagccccggagtttgagaccagcttgggcaacacagtgagacccgatctttactaaaacagttatcctggtgtgatggtatacctgtagtctcagctgctcaggaggctgaggcaggaggattgcttgaacccgggaggcagaggttgcagtgagctgtgattgcaccactgcacttcagcctggggaacagagtgagaccctgtctcaaaaacaaaaagcaaaacaaaaaaaacataaaccttcctcctagggtattcttgaaggtcaggcaaggtggaggctggccaccttctggcacgctgcctggtatggataggggctccattgtagttgctgctgctggaataatgtgttcattcacctgactgtttctggggcctggcctgccctgggccctccatgtggggtgggtgtgcctggacaggggggctgcaggagagcagcctggagagcaaatgcacgagcacggtcatgatgttatggtgtgcagatcatcgagaagcttgggcctgctgttgttcaggggagttggagaggcctggtgtgtggtctgcagagctggggtgccggcccatgactgtcaatggcagatgtgtgtgtggtggggcccggcctgggatgtggctgactggaggggtttcaagcagcatggagtgcctggtggtgggtggtgcatggcgggggagtgcggggggtgggtggtggctggcagctgccgaaagcatcattgcattcctgtcctgtcccaacagtgcatgcaggccaggggttcagttacaagggcatcaggtttatgtctaacgggagaagcaggggcaggaaggccgccagcttggaaggcagttccctgccatctcatccttgccccaggatcagatccaggctaccagaccccagaccaagtcggatctgctaatggtgcacaacatccttggtggccgaagctgtaggataataacaactatcagcagatgttggccatcgttcactatgctcttatcatgtgcccgacacaagaagtttattgtgttatttggattcgtcctcgcaagattcccatgtggtatcagtattattacttcccacattacagatgaggaaactggggcttggaaaccccaggtcaggggctgaaaggcacccaggtagtcagtggaagagctttggttctaagccaggtccttgtgcccgagccttatgctccaatgccttgggggagtggcgaggccacttctttcctttggcttttattgagttcctgctgtatacacaacaagctgctggggtttctcctcttgcagagcttaggtttgagttgaggtttgagattagtttgcaagaaccagctggggcgtggcagcctgtgagtatcacatgaattaggcagaggtatgatgtgagcggagggtgctggtggaatgggggtggctgtgggcacaggtgtgtcctcgaccaaggcatggagggcatggtgggggccagcctagtgggctgcagtgtgccccagaccctctagggctccacgcatatatcaccttgaggcccacggaggaagcaggttaagaacggggttctggaatccacagaggactcgtctcaaaattacgctcccgtcttttaacaagctcattctctctaattaataaattacactagggcagagcgatagctcctgtagcattttaattttcaaaatccttgcttttcttgtcagttttaagtactcattatagacaagatgctatcacccaacataccaggacacatctgcataataaatgaagtctccgtggccacagcttgtgggattttggaaacatgttgagcatcgcaggtgcgatgccgatgaaagcctggatgtcggccgctgaccatggccttcggggcctccccagccagccctgcatgcagatacctggggcagaaacaggtagaaagagctgaggccacattggtccccacttgctaccctgaagaggaggctagcaaagggaacaagtgatgggatttctcacctgggatctgaccttgggattggaaagtttggtgtcgatgggttaacataatacctttccagcaacctgtcggcaactccagctgcaccagaccgtgtggtccacggagccaggcagacttgcagctctcaggcccagctggccaggagctgagttttccttgattgtagtgggcttgttgggtagggcggcctagagaatgggcagctctacccacactccagaacacacaacccctactgctgttcctaaggttctgtaaacttgtcatataaaccatccatctcatgatggctgctagtgagcatgcagtaaaaagcggtccattcctcggatgtgaagatgcagaatgttaataaaaggtgcacttactgtactacttactggtagggtcagtagaagccttctgctgaccattattgtcacacgtccttctgaaccctggctgttttcctggaggcatgtcttttttgttgccgttgtttccaagtccacccaaacttaggaggaactgttctgttctttgccatttgaacattgaaatatttcatgtgctctggtgcccttttacagagttatttttttagaatcctagggtacatatattttacttctgtttcttcctgtgttttttggctggttgattattcatggaaccatttaatttgccaggatgtattgagcacaaccaggaaggcaaaggtgataagccatgtcgtcttgggtagtgggatccgacggtaaatattttgagccgtggactcaaggcgggtggatgtgtcattctccctctctgatctctgtcctttcatctataaagagaaagctcggaatctgtaattgtagagatagtttccagctctggtcctctgtttctgtgctctgctgggattgcaacttgaggaatttctggcagatccatttcttcagtccatgttcctcatctgtcctggcttatcagtccttccccgcctttggccctcgctgtctgtcaccagccacactggacttctgtccccagatgtgccacactggtcctcgtgagggcctctgcgctaggtccccctcttcctgcagcattgacatcttggcttatgtgctgtccagcttctcagagagatgtcttctgactaataaattggattgtccccgttgtcactgtgaccccttaagaaaccacaatgttttgttttctatatcatctgaaagctcatttgtttgttgactgtctcccaaagtggcacaaatatggattgagtacctgttgggcaccaggctctatttcatgtactaggaaatggcagtaaaacaaaaggtcacttacattccagggtctagtggatgaaaccaacaataaatagcaacaagatcaacaagattctctatcaatctatctctatctctgtctctgtctctgtctctgtctctatctctatctctgtctctctgtcacacacacacataaacacaacatctggtagtgataagaattatcacgaaaataaatcaggtgagaggaaagagggtgattgggtgactaatgggctattttagacaagatatggtcactttggaggaggtgacattttggcagaaacttgaatgaagcgagtgagccccacatgcagatacctgggggatgaactttctcgccaaaggcagcacaatttcacattggggtcgttagtccattggtaattcacatgatggatattgcaaggcaggaattgattttagttttctgtattgacccgcagtttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacgggaaaagatgatatacaatataacaataggtgccatctaaaaatgccgtgaacatgaattatgctgcagtaataagggaaattattaaaatgtgtatttaatatgatacaaagcaattacgatggttacaaggattagggataacaaagggtggcaaaaatggtgtgttgctgtttgtgaattgcctttgacatacggcatgactaaatccacaggccgaagcaaagaagctggaagatgctgccacgtacttgagtctgccctccacgaaggcagagttggaagaaaagggccactcggccaccggcaagagcatgcagagccttgggagctgcaccattagcaaggactccttccagatctccacgctcgtgtgctccaccaaactgactcagaacggtgcgttcgagaggagaaacacactcaccccaggagctctgccccagtcctgtcttttccatgctccttcctatgtggaggtgtgctccgtaggtgcatgaacgtcacccataaggcattcattgcatcgggctgtgatgatttatcaatgcatagaaggtggcatttgttcatttgttgtaatttaaaattcacacttctactctggtctaagggttattcttttatttttatttttattttttaagacaaggtctcagtctcgctctgttgcccaggctggagtgcagtggtgtgatctcaactcactccagccttgtcctcctaggctcaggcgatcctcccacctcagcttcccatgtagctgggaccacaggtgtgcagcatcacgcttggctaattttatttttattttttatagagatgaggtctcactttattgcccaggctattcccaaactcctgggttcaggcaaacctcccgcctcggtctcccagagtgctgggattacaggcacgagccactgtgcccagctgtattactcttaaagggagataaagcaatggatttacttcttaaaatgatttttggccaaaggaaggtagcgtgacataaaggaaagtgcacaagatttggagtcagactaaaaacctggaatcggaacatagccctgtgttaaccctggggatgcccttgaacaagtcttctgcacatttctgggtcttatcttccttgtctgtcgatacgggaatagtgcctgcctcaaagggcttagtgagggttacatgaacagtgggctgggagctcacctccctctttatgtcttccccattctcagctactctctgagataattactagttatctttatttttaaaagctggtttggatgttactttctagccctactcgtgttgtgggataagcaccccctgctgactcccacaccccaaagctcagccctaatgtggcagatcactcatccatcagctggtgccgtgcccttgtgtggggttcggccgatgctttgagtgcctgcaccaccactgcttgcagcctctccagtgacattgctgtccagccaggggtacttcttattcagagcacactgatgttgttgctgtcactccgtctggaagaggcagaaatcctacatttaaaaattgaatcttccaaatgcagccgtatcacagctgtgcagagtgactttatgctctcttgaagcagagcttgaaaatccaattttttcctcttaactgcccgatacagattttgattattactgtctgttgctatcatgagttgtgtctctgggggattgtccgtaaatcatggcagtagttttggatttgcccaagggacagtcatcgtttggactttaataggataaacacaggacaaaagtaaagccattgtctggaagtcaggacattgtagtggagcgtgcactgagtgtgctgcatgtttgggcatgcgagccctgggtcaaatgcttttggatctttccgtttctgcactttgcactctgttgttctgggctacactttcccactgctggtctgctgagtaaactgcttggtgtgggagcagtaagtctcttaagtgccttaagcctactggggcacttttatattccatttgcatgcatttctcgaaccatttatgaagggtcctagcttgtggttgtgtagtggtctccatgagcatatgaaaagccttacctgggtgtgggatctatgcagccgtgcagtggggaagggagagaatgcacagggagcctgctagtggcatgcccgaggcatgtgcagtgtatttgtccctgttcatgctgctgataaagacatacctgagactgggcaatttacaaaagagagaggtttaatgtacagttctgtgtgactggggatgcctcacaattgtggtggaaggcaaggaggagcaagtcacatcttacgtggatggccgcaggcagagagagagagaaagagagagagagagcttgtgcaggggaacttctctttttaaaaccatcagatctcatgagtcttatcactctcatgagaacagcacaggaaagacctgcccccatgattcaattacctcccaccaggtccctcccacaacacgtgggaattcaagataagatctgggtgtggacatagccaaaccatatcatgtggtcagcagtgcggggctcaacttgggacttggttatggaaaggatgctcccctgtgacatgttagtctctggatgtggccttgatagctccactcgcctgacagatgacagcatccagagcctaatttaacccaaaggtgacatctccaggtgggccacactttagcatttcagtaggtgccatgtgttgcagtgctcatggtgcaggaagccatcatctcataattgggtcatgttccgaaagcatgctcggaagtcattacttaacttgctcatctttccccattcaaagcaatgctctgagctgcggttaggtgatgaggcccatccacagaatccttcttaacccttatgaccctggagaaaggggactgtggaccaggacatccccccggggggtggggtcagtggcaatccctcctttcaccctcaagctccttaagtctcaccagctgcagagtaatcccctccccagactgagggagagggcaccctgctctcagcagcagctgttgccaggcaacaaggaaattccgatgtgatgccactcaccaggactgatgggaagtctgcctttcatttctcaccagccacggttccccttcttgggattgtggcatgtcaggtgtgtacaagatggagctgccccaaatggcgtctaagcatcgactcccacattctcatttgagggaatcatttttctgaaaccatgatttgttcctgcgaagttccattacttagggaaacgcagtggctgaattattcattgaggttggtattaaacttctctgtcctcagcattatgctagatgctgtgggggatatgaaagaagtacaagatgtgattcctcttctcaattaactgactatataattagaaaggagtcatgaatatgggctgtgagtcccggtaataagggcctggggtgggactcatctgccttgggcagcctcatgggggctggacaagccctgttttcttccagcactccctttgctccaaggtgttttactactcattagcccaattggactttgtctcaaacttacaatacagcgtgccaccaactttgaatgaaggggatccagattattactgtctattaaggaaatactggtaattcttgtgagatggaaatctcccttaaccctaggaccaagagtgtgtctgggcaggatggagccttttccattacttcactttcacttagaaatgaagacatgttgcccaggtgcagtggctcacatctgtaatcccagcactttgggaggctgaggcgtgaggttcacatgagcccaggaggttaagaccagcctgggcaacatggcgagtccctgtctctactaaaaattagctgtgcatggtggcgtgcacctgtagccccagcaacttgggaggctgtggtgggaggattgcttgagcctgggagttagaggctgcattgagctgtggttgtgctcctgcaccccagcctgtatgacagagtggggccgggtgtcagaaatgagtgaataaataaataaataaataaataaataaataaaaaagagtagagtgctcaattcgtcatcctctcctgggatgactgctgccatttgtgctttggactaggcattctgctaagtgctttctacacgtcatgtcagttaattcttacaaccaccttgtgaatcaggcaacactgtacccatggttcagatgagaacactgaggtgaagttacctccccaggccaagtggttgctgcatgctggtggttaggcccacacttgggcgtcttccacgggatctttgggtgctccttttttgtctccctatttttaactcttccctttgtcagctgtacttgttttggagcttattgcctgcatgccttttgtacaatttgatgctgaagttataatggatgtctgtatttcctgattttctacctatagtcacaattagagtttgttttttttttcttcttcagtattaactagagttttgttttttgattctttcttttatggagacagtttctgtagctgaagttggttcatgagcataacggtaaattagatgtactttgttaatggtattttttcgagtaatgggatgttaatataacttcaggtgaaacttgggtaggcatatgtactttcctagagagcttttggatcctgacttcttaccttaaagaatatcttgggccaggcatggtggctcacacttgtaatcccagcactttgggaggctgaggcaggtggatcacctgcgatcaggagttcgagatcagcctggccaacatggtgaaatcctgtctccactaaaactacaaaaaaaattagctgggtgtggtggcgggcgcctgtaatcttagctacttcggaggctgaggcaggaaaatctcttgaacccaggaggcggaggttgcagtgagctgagattgcgccattgcactccagcctgggcagcaagagcgaaacgccatctcaaggaaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtgcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagaattcccaaatgcacttttaaagcttctacatggaaatcatttcatggtaaatgtcgttgggaataatgaattcaagtgtactaggtgttaagtatgttgctacaaaggaatggaatatttagcaggtgaatcttttaaaatagggttgatttctctgttcacaaaattttatagagaacctcacataatgcatgattaacagagacagaacagagtttcttgcttgtgaagatctgattgtcattttctgtttccagtggaccttctggggctcttgaaatggcgctccaacaccagcctgctgcagcagaacttgaggcagctgatgaaagtcgatggtggtgaagtagtgaaggtaacatggagcccaaagggactttttgggtctttttttttttttttttttaatgtatgttaacagaagtaggcagtgacttcaaaggtagtataggattgtggttatactccctttaaaaaatagtgacatacggattgggtgcggtggcttacgcctgtaatctcagcactttgggaggctgaggtgggtggatcacctgaggtcaggagttcaagaccaccctgaccaacatggagaaaccccgtctctactaaaaatacaaaattagccgggtgtggtggcgcatgcctgtaatcccagctactcgggaggctgaggcaggagaattgcttgaacccaggaggcggaggttgcagtgagttgagatcgcaccattgcactccagcctgggcaacaagagcaaaactccgtctcaaaaaaacaaaacaaaaaaatagtgacatacacctctaggtgcacagagtgtttcttggcttctggtttggggggactctctgggttagccgtgaaggggactggctttgcaatcaacctcatcgtgggttctgcgtcctcttcccataggtcctcactacaggactcacaacagttcagtgacctctttaagcctctctttcccctgccatgagaagtggggtaacagtagtgccttctgcagggtcgttgtggagcctcaggtctttttactgttgtcatgatccttgttactgccatcagcattcgtactagactccctgagatcccctttaagtgaccaggagaggtctgtggtgtggtagaaagatcacgacactgagaggcttgcctgggccgtcttcttcccacgggacgctctgcagcagtgtcgggtataattattcattcagacccttgtggcctcagcatctttatctgtgagagagggcagtcagattacatggccggaggtccctgggagcactcagcttctggaattctttactctgtaattgtttgtggttctgatattttctgcagtattaggctcttctctgctctcagataccccacaatttgctggggcaacttttccttgtacgtgaggaagcgaatttccatttttagtcgattctgtttttggctatgggacgataagggggtcactggcatgtggcgttctataagcatagactctccagcaaggtctgtgtgttgccgcctcagttcctcactctctaggagaggtgattgcagaaagagacgaccttatctctgtaaaaactaattacttaaaatggccttaattaaccagcagtgtgcttcacttcagtatcaattaatttggtcgcaccagtttcctgaatcgtataactcttcagacatatactcactaatcttaaaattttaatcatcttctcagtcctggtgttctcccaatggcttggacaatgttaattgcattttaaacttccctgtgttctgtaaattccctaattcaggtggaaactaggtgaatacatgaacgtagttgagaagaatccagttaatgaaattttgtcctctttcattttgaagtccctgtatcatattaggaatgagttgtatttctggcgaccagttaccacagttacctggaagaatgtagaatgatcttgtcccgtcattctcccccattcccctcatctcatagattctcacatttgattattcatccctagacgtggcctttacacctttcctttcttcctgtgcgtgctggtaccacgcaagcctgggtgacctgtccagcccttacctaccttgcctaactttgtgctttttctctgctggcgtgtctgacatgcgccgtgagcctagagagtggaactgacttgaggccacggggctgttaatggccagccaggacttgaggaattcctgcctgcacggggctccttttgctgatagggatgctgatagattgtgggtttggttccatttattcaggacctcccttctgagtattgatgactgatagcagagagatggcattgcttggtagattgaggaaggtatttgtgtatttagcaaaagatacgctgtcccattagatggaaaatggaaatggtgactttggtgcccttgaacatggtcttagagagagggtggggtgccagatgaagccctttcatggctccgtgtgaaggccctccttcaggtgctcgcccctgccccactgcagctccgcagcccaatacgtgcagctccatctccctgtggttctgtttctgtgccactgaccatgtcatgtgtctgggtgggaccaggtggtctacttcagggactttgcatgaaccgtgacaggccaggtcctgccacctgggagcctgttggcagggaaatattcggctgttagcagatggcatcaagttttgaccttcgcaaagaatctacattctgaaaatgatgggaaatggtgcaaaagtaacaaagtggtacagatccacatagttaggagttgattaatcccttgacatccagaccagcatgccttttggtcaggttggttttgtttcccactgtttgcatgtgacattttctggtataaagtaagtggtggctggcacagccaagcatggagaggattttactccttaaagggtctctgatctcatgctgggcatgctgggcgtcctctctcccaaaggaaacggatgaggctcatgctgggcatgctggacatcctctctcccgaaggaggcgggcgaggctgttgctgctgctgtggttccacagcactcctttgcgagcaggagtttgtggtttgcttctttaatcttggggctatagcagtttgagatcttccatgccatcccaaaagccccctgggtgttgggaagaggctgcacagtccaggaggaatctgaaccaaacacctgacccagcctttcctctgatgtccttgctgtgtgatcacctcacccatttatttttatttttctttaaattacagtttcattgagatataattcacataccaaaaaattcatccttttactctgaagtttttagtgtcttcatggagttgtacaactattaccactgtctaatttcagaacactttcatcatcccaaaagaaaccacatagctattagtagtcactttctcctcttcctgtaaccactaatctgcttcctgtctcgatggatttacctgttctggatattttatgtaaattgaatcatacgccctgtggccttttgtgtctggcttctctcacttagccttgtgtcttcaaggtttattcatgccgtagtgactatcagtgcttcacacctttttttgttttgagatgaagttgtgctcttgttggccaggctggagtgcaaaggcgcaatctcaggatcttggctcaccacaacctccacctcccaggttcaactgattctcctgcctcagcctcccaagtagctgggattacaagcgtgtgccaccatgcccggctagttttgtatttttagtagagatgggggtttctccatgttggtcaggctggtctcgaactcccgacctcaggtgatccggcctcctcagcctcccaaagtgctgagattacagatgtgagccactgcacctggcctgcttttatgcctttttatggccgataacattccatcacatggatagaccgcagattgtctttccattcattagttgacacacatttgtattgattctgcttttttggagatgatgaataatatttgtgtacaagttattttgtgaacatatgtttcctttcttttggagagatggccaggaatgaaactgttgactcatatggtaaatctgtgtttaagtttttgaggaattgtcaaacagtttttcatagcaattgcacaattgtacatttctaccagcagtgtgcaaggtctccaatttctctgcgttcttgcccacttcttattagtcatcttaaattgtagcccagatagtgggtgtgaagtgatagctcatgatggtttccctttgtatgtccctaatgagtaatcatgatagatcagtacttcatcatgtttatggccagtatttcgttgtgtggcgttctgcctcttcttgaccttctcttctaatacgaatcatcacttccaacaccgtgatcttcagtccgtcttacatttcctgcaggggaggatggggtgggacttgaagctgacttgtagtgtgacatgcctttgaagtctcttcctaattacatgtatgatgctttgtccttctttgcagtagtatttatttggtaaattttagtcaactgtaactgtaatttcgacattgttgttgaataaagtaagcaccttctggtctcaaaactgggatactgctgtgtattccagtttcagaatcacgatcctcttccatgcctgggcaccctggttggtagaaggtccttccttccactcagctgggtcctgtccctgtgtggcttctgcccattcactagctgaagtcctgtacccagtgtgtagaatgagtgagatgcatcttcccagagttgccattcagcgctttgtcaccagccttatgaaaaccggaaagagggttggaaaggccccctgggggaagcagtaggccctctccttgctttgaccctctccatttaacactggtggcatttctttgttctgaattcactcatccaaaatttttgtcttgtgtatctagtggctgaaaaggatcccgaatggctttataggtagtgctgggggcaaagtgggtatttggagtactgcagagatgatagttattccagtgtgtggggggagtccggtgggttcacattgtcacccgaccttctgtgtctatgcagtttcttcaggacacgttggatgccctcttcaacatcatgatggagaactcagagagtgagacttttgacacgttagtctttgatgctctggtaagagagctttccttctcatatgcttggataacacagcgttcttccatgctgcagcgtctgaggctggagtcgggggcttcgtcacagtgaccttgaacgcattttcagttgtaaatccaatcagagatgaattggggtggcagattttttttctcttttttttaaatgtaaaactgtagttaggcaaatgtcatttctagggtaagaaaaggtaaactagccaccaacttctatctgaaaatgttatggttcatatcctaacacaggggtgcagatggttctgatgaagattataaaatggcttacattatgttgctaatgaaaatattattgattaatttgacaggtatttatcattggactgattgctgatagaaaatttcagcattttaatcctgttttggaaacttacattaagaaacactttagtgcaacgttagcctacacgtaagttcctactttgttttaaaaccaatacttctttttttggtatttgtgttatttagagtctttttcatgtacttttgtctatgactgtgtatttactcctgctcaaaactctgagtttactggaataatttttagtattgtttccctcttaacatacctaaaaaccttgttgaaagagatatgtgataaatcatcgtaatattctggaataaattcttgttctccctcacaccttccatttatctttgaaatcttcactttatgttcgatgaaactgagctttggatgcggagtgtctgacaccgcggcttcctcgcgagcctttgatgaatggataaatgcatgtgttcccgtgttaaggagattggttgtttagtgtgaattagatgcagttttgtactttgcaatgtatctccttgctctttaaagagcaccttcccttttctttgacaagcttcagctgtcactgtcttggattccttctatccacccctctgcccgtctgtgccccagaggtctaggaagacaccagaggctatgcatggtgcctgggccagcttagcagtgtgcctggtattgaagagcagagccctggagtctggagtcaggctgcctgggcttgatgtgcagctctgtccctcacaagctctgtgatcttgggcaagttgcttaacctctctgtacctcagccttcttgtctgtaatcagagcatgattgtaggcttgtgtggaaattttaataagttattacgtgtagagtgcttggactaatccctggcacttagaaagcactaagcaattattgggtttcattatcattagatttattatgatgacttaccggctctttcttggtggaatttattggcatttattcagactttttattgtgtgagttacagcaaaacataaagatttacataatttctttaagaacatcccgcttagaatcagtagaaaggattctttttagtgtgagtaaatttagttaaaactcccttctgtgtcttcaacatactttgcaaaatacctgtttttcctccctgtgtgcagtcatgaactcaggtcagaggactctggcctcctgaagccagctgttaatataccctggtcctgcacctggattctttcatatctgcctcgtgtgcgtgtttactgtaaggtggtgggtggagctccaggaaggctaagagctgtgaggtcctcaagcctgcggaacaagctgtgactagttctttgcacttgcttgctaataaacgtttgtttaaaacattttgttcgctgagtggagatgcccagtgtgtgggcatgtcgagtagttccttacagaccgtggggagggtgcattgcagggcacttttcctggctcttgtgaccaaaacaggagcttgtggggtttgcggaagtggcctgtggactgcagcaaacgtagcacggcctccacgtgtgctcattttcaaaattctgccttttgattgaaatgtggccaaagaactcttctcagattaggctccgtgcttgaatttcagaagatgagaggcatgaatcagcttaccacactgcagccacatctcttcattggcgccagcctttccatgctgtgctgttggggaaggagtgatgcagccattctcataggtggagaaagaaaaatgggagattttgatgagtttcctaatgagacaaacaaaaagtaccattttttctttatgctgtgatgggactgagataagaatagtatcctcatggccgggtggagtggctcacacctgtaatcccagcactttggaaggccgaggtgggtggatcccatgaggccaggagttggagaccagtctggccaacatggagaaacccccatctctactaaaaatgcaaaaattagctgcgcgtggtggcacgtgcctgtagtcccagctacttgggaggctgaggcaggagaatcacttgaacccgggaggcggaggttgcagtgagccgagatcgtgccattgcactccagcctgggctacagatcaagactccgtctcaataaaaaaaaaaaaaaaaaaaaaaaaaaaggatcctgtcattcaatctatggaatctgctgaaaaagaaatttttattgtggaaaataagtattgttagcatgttttggtaaactggcaacctcacgtggttcctcagcagcctgaatttgcatgtctgcaccttgaaattccaaaggagtcagtggcgactgagatagctctgaccacatcatggaaggtcgcctccgcattggtgatatgcttacagtattctctgggccaggcgaaattccagtaatattatcccagagtgtccttgtcctcttctcctctagaaggctttggtaggtacaggcttactttagactcttgtccatgtagcctctctcctttggtaaatgttgagatctttagcccttcttcccaacaacaccaagagaaggaatgaaagattttggcaatggggagtcctcttccgcacctcgagctgtgtctgcggctcccctgcgtgggtagttcatggatgctggagccccactggactgaccagcactggtacaagtgagaatgaagggaggcatcggctttgggggctgctcttccataaaaccagcatgactgggctcctttttgtccaccctatggagctgctgcaggctcctcactggcaactgatgctccatctgctccgccccctctagccagtgccaaggggttgctttttgtgcaggtataagatggcctggcagatttatttttatttattttctttttgctgtctaattccaggttaagattcatttgctggttctaggtccttcttttatttattttctttctttttgctgtctaattccaggttaagatacatttgttggttctaagtccttctctttgcaaatcattattatttttctttttttaattggtttgaagaattcccaaaatgtgttctatggaatgtttattccctgggatattaatatatgtaataagaggtgcgtggtccagtaagtttgggaaaataagtaaaactgagtgaagcaggcttcatgccagggtgttgcatgctctcttgtgcagtgagcaccacccgcagaggcctatatggcaaggtgtgttttccagccaatggagatggacaccgtagcaggaggatctgcagacttcgcctcttcagaacagcgagcaggagtgtgactctgagagcatcagggctccctactagagctctggtgcctgatcggtgttagaaatggcttcacatccactcagtctcccaaaaagcttttcaggccatgcatggtggctcacacctgtaatccttgcactttgggaggctgaggtgggcggatcatttgaggtcaggagttcaataccagcctggccaacatggtgaaaccccatccctactaaaaaataaaacccaaaaagttagccttgtgtggtggcaggtgcctgtaatcccagctaatcagaaggctgaggtaggagaatcgcttgaacctgggaggcagaggttgcagtgagcagagatcacagcactgcactccagcctgggcagagcgacactacgtctcaaaaaaaaaaaaaaaaaaaaaagattttcattgtgatgtattggtaaaataggtactcttagctcatccataattgcagtgaaggttgctcttctgagtgtcttattccataacctgagtgagcagtctggcctttactggctcacaactgaaccagacatgctgtcagtaccccagcagattgcttttatgaacataaaaatctttcatgtggcttttaaaaagcctcagtgaattttgttggatgcgtaagatgttggtgactggagaagtttgggtggcggatattcttcctggtgtcttactggctgcacgcatggtgctagtttttggagagttgcagtgcagctcagtacattaaaaaatgaccgtgtgttgttgttaattcagttgttcttttattatgtgtaagctattgcttgagggtcatccttatgaacaaggattattatttgatgagtcagtaatggttgaaagtgtagaagtgtggatagaattaaaaatggcagatcctcactactgcctctatcatttaaaaataacacatgctcaacggataaaaaatagtaaagaaatctcacattactcaaatgttatagtgcagacgataaaagttcccttgtatgtaatgctacatattggagatatctactgtgccagcatttattttctatgtttatattaacattgttattaagattatgactaatatgtctgcatattttacaaaacagcattgttatttttgcttgcttaaaatttaaaaacttaaaaattgttataatttgcatacaacaaaatgctcattttaattttgtttggacggtttttgtatgcccttggaactactgcccaaaacaagacataagacattgccattccccacaaacatccctcttggcctatctgagcccatcccactcccagacaagcagccactctgtggtttctgttaggaatgtgttttgcctgttcttaaactttacaccagtggggtcatgcactctttttgtatctggcttcttcccttccacataattctcttgagattcatgcatgttgctttgtgcatcattaaatatttgattttgctcctctctatttctgagcagtattttattgtatgaatatttcatgatttgtttagccattttcttgttgatggatacatgaagtgtttctagtttttggctattccgaataaggctgcgatgaatattcttgtccaagtctttggtgaagtttgtttttgtttcccttggataagcacctagcggtagaattgccgggctaaaggatacgtgtatagttttctttgtaagatattgcgagacagttctccaaaagggttgtaccatattgcattcccaccagcaatctgtgaatgttcttttgctctgtatcctcatcaacatttagtagtgtctgactttgtagctattgtactgggggcaaaattatatctcttggtgattttaatttgcagttactggataactgatgatactgagtacctgtttattttattttgatttgccatttgtgaaatgtctgttcaaatctctttttcattttatattttgttgtctgtttcttattgatgtttatggtatgtgtgtgtatgtgtttgtgtgtttatacacataaatatatgtatttttttttgtcagacatgatttttgaacattttcttcctgcctctgtttatcccttttcttaatggtgtcttcgatgagcagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataattttactcaatttttgtgtattccaaagtgtgtaaacttttttatcatggaaaagattttaaatgttttcatattaggatgttacttgattttagatcccaatttataaataaacagactaagagtatagtagtcattgtgtttttaaaactaaatgtttttggggaatcttattaggaaatgtcaatattttaaaatcttcatgtgtccactgatagtattcttactattcttatatattgtttatagtcttctctataaggatttttacaatattattaaaaatttaagactgcttcctatttgaaagcccatttgtaaattttaattttcggtgtaagaactctagttttagaaaatcaactaaaatgaataaaagtgtctgagatgctttccaataacaaatactgtttcatgcctttaaaaaaattgttgtaaaatacacataacataaaattcaccgaatcattttattttattttatgattttttgagacaaggtttcactcttgtcgtccatgctggagtgcagtagcgcgatcttggctcactgcaacctctgcttcctggactcaagtgatatctcttgcctcagcctctcgagtagctaggactacagccatatgccatcctacccggctaatttttgtattttttctggaggcagggtttcattgtgttgtccaggctggtctcaaactcctgagttgaagtgattcacctgccttggcctcccaaagtgctgggattccaggtgtgagcaagagcacctggcccctacctaatagttttaaagtgcaatgttgagaaaatcgtcaccactatccatcagagagtatttttggtgtcatgcctttatgaaaaaaatttttgtgtctctgtttggctgtaatgaaaatctcttcgattttattgtttaaccttggggaagctagtgttttacctgtggaagtcctggtttcctcatccattaaataggataatactgcctcatagtgttgctgtgaaggctaagttagataatgcatttcacctgcttagaacaacgtctacacttagaaagggcttattaaatgctcagcctttgctctcagaggtattttatcaggcacatttactgattagaaaacgttttacaggccgtgcagtggcttacgcctatgatcctaacactttgggaggccaaggggggtggattgcctgagctcaggagtttgagaccagcccgggcaaatggtgagctgctgtctctactaaaatacaaaaaattagctgggcgaggcggcgtgtgcctataattccaactacttgggaggcggaggcaggagaatcacttgagcccggaaggcagaggttgcagtgagccgagattgcaccattgcactccatcctgggtgacagggtgaaactgtctcaaacaaaaaaaaaaaaaagagaaaacgttttacagatattcatatactgatagacggaaaccaaataaaagtaacctacttgtatatttccttagcagttaagatttgagatattttcctttcctgagcttatttgtgcgtgtttgcattgtgaataggaagttgacaaaagtgttgaagaactacgtggacggtgctgagaagccgggagtaaatgagcagctgtacaaagccatgaaagcgctagaatccatcttcaagttcatcgtgcgctccaggatcctgttcaatcagtgcgtacctatcccctccatgcccgggctctcagaggactggcaggagatccttcacttctttccttccccttctctcgtccccttattctttcctttcttcttccccctttttcccccttgctttctaggctgagagagcactgttgatcctggggtgagctgcccactctttccttacccgcctgggtccctgccggtgctgaggcgggagccctgttcctggtctgagatgtgtgcctgtgagtcgagccttggctcctgaaagcattggcgatgacgcaggtgcaatcctgggcgtctactgagggctcagaagcccttttcaggatatctttatatggcaaaaagtcccaaaagaaaaacaacaacaaaaataggccgggcgcagtggctcacgcctgtaatcccagctacttgggaggctgaggcaggagaagggcgtgaacccgggaggcggagcttgcagcgagcggagatcgcgccactgcactccagcctgggcgacagagcgagactccatctcaaaaacaaaataaataaataaaacaacaatgaaaaggcaaaaccaagtgaaattgcctcacttgggcagactctgggatttcctcctcctcttttcctcagtagagtgatgtttcatttcgggagaactcttcctacatagggtatttccgtgaggaaggatactcaggtgctttagcctagtgacagttttcacacgctgtgtggatgaacttatgaatgatttttgagctttaaagtaaatcgaagggttaaaggggaacaaaaaatgtatttattaccattgaactgtatacttaaaatggtaaagatggtgaattatatatatgtatattttgcctcaataaaatacataaattgggatatttatggcttattttatagagagccttaatattgtatagatacagatgcaggttaagagctgcgctaaaatgaggactttctaagttggcccacgcctcttcactgtatgattcaaaagatgtgaaaagtaagtgtgttgagggtggggtgtggaatttcactccctctgcttggttttttgggggatggctattttgtgggtgacctgccatgagtgatgtcaatggatgttggtggttctacgttgttattgttcttgttgtgagttccacacacagatgggattcatgaacctgtgtccctctgaattagcgaatacatttgcctttgaaaagcatggtgcccttgtaacctattagcgagaataaggaattgaaagtgtgggcccacatcagtgccttcccgtttcctcctcactgtgttttcgtttctctgaagcagtcgtgtccagaagaaggactcaggagaagggggaagaattcaaaatctaaccatgtgtctaccatgatagtaataaggacaaagcaacaagttattgactgtgtgttgacctatcagagtcataaacagggtggtaaccactagtgatgtgttactggtcagggactggagtgtgcttctgttcactctggcgtgtccatggtcaaaaccacagtcctcgtgctgccatttttgcatacaaatatggcatgtttgagggcatcatggttttgtccttgacttagatattacactcttttattttgcttattatggatatgcatgacctttggtgtggattgaagttttccctcaaggatctaagttgtgatttattttctctttgttagggtgaaacacagcatggtaagctaggttatgttttcttgtattttaattctatttcagtaaagttaattctatgaaaatgaacttcctggccccccctgccttgctgttatattttcctcactgattttaaatctctgattatgctaaacccaagtcagtactagggtgggaggatgaacttgaaagatgttacagatttttgtcatgttttatttgaaaaatgttaattttgtgcagtttgtgatcaatatgacattgactcaggcatttgatgatctgcatattctcacccgataacactggactttccctttcattcagaggtttgtacttaaaacgatcgtgcattgataatggtgtttctgctatagtagtaaatgctatagtcttttatacaataatgctgctttagaaaagattgagttacccaggttgaccagtagcaaattatttctctgcctcgttctttaatctctttcaatttcaaaatacaaatggcacaaaatcttagattcatggtccataattttttttttcgtttgatcagtctaatagtgcttaggaatatgattggctgcatgtaatagaaaaacaccatttatgtgacttaaccatatggggttcactttttttttttagtcacataatgtgcagcccggaggaagagttccgagttcatgcacctgcgtgaggactcagcgtcctgatgtccttggctcctttgatctctctgccccaccatccttagtggggtctctttatctcctaatcctaagatggcttctgcccctcccagcatcagctctgcattccaggtggaggagaggggaaggcaaaggagaaacagctgtgccagctattcttctttgaaagagctttcctcatccctagaaagtgtcatgtgctttcatcttattggccagaaccatgtcacatgaccaccctacctgcaaggaagctggaaaggatttttagatgggctggttgatgctttctacaataccagagtgattttagtaaaggagttagggagaaatagataatggatgggcagttaacattctcttcctcataccttcaacccagatggtctgttccctgagagcttccctaactcattctgggttactaaatcctacttaactaggttttgcagagcctttcttctccattagtttgggagtcaatctctgagacttctgtcaccagtatctctttggctttaagtatctctttaggccctaagtgatccactggcatggtttagtcctaccaggctacatagaaatggactgaagtactcagctgctcctcgtgtttgggacaggaagtgtttagtgctaaagtcctctgaatgcctgcattctggtgctcaacagcatggcacagaacatgatcgctctacctgcctttgtcctggtatggacccagcaggagccaggcatggtccacaaactgagtttctttgctggtataacttgtttgttagaagagttgagactgttgaggacacaaagtggtcacaagacaagttgtagcaattgttacaacttagtgaggctccctaagcctctgaggccattgtctgggcattcctgactttagctaaccgagtactgcagtgattctggagatcctgatgctgctgctgctgctcctgatcatgatgatgatgatgatgatttgagacaggacctccctctgtcactcaggatggagtactgtgatgcagtcataggtcactgcagcctcaaacccctgggctcaagccatcctcctgccttagtctcccaagtaactaggactacaggcaggtgccagcatgcctggctaattttttgtaggacatggtctcgctatgttgcccaggctggtctcaaactcctggcctgaagccatcctcctgctgtggcctcccaaagtgccaggattccaggcatgagcccctgtaccccactgattctggggatgttgatactcatgttccttctctccctccctcttttcctcccttcttccctagcttcttccttctctcctcgcttcgttctttcctctctccttccctccttttttctctcttttgtcccttccttccttccttccatgaatacttaatgagtgtatgagccccaagtgtatcccagactttcacagtttgactttattattttttctctgaacgtttcctgaatgtggatcctggctgcctaccctcattcctgaggggagagaaggacataacgttctttgagatgtagagcacctagccgcattgtgcagagacaacaaatacttcaatttaaatctgtgttctaaaatggctgagaagatatttcatagattttatgagaggaaaaaacccatgcccttagaatattggacggtagggcagaagtcttctagtaatccctccccttctgtcctccccatcccacccctgctccccatcatcccaccacagcatgtcagttgttacttcatctgtgctatcacaggtctgaaatgtagctgaaatcgttttcctagcttgtataggctacttaaaggaaaaagagccccacgtcccacacagatatctaggatgtttgatccgtgacaagctccaaatgagtctcctgtgtggtgctgtcagaggtggggaagaaaacaaactaggactctcatcttcttacctgcagcatgtttattaccttgagagaaaaacaattgtgctcacagctggaattcatgagtgtgttttcctttttgcagctgggataaacttttgagatcttatttttctttggctttcaaaatggtctattgtgttttcctatagtgcaatagctttgttaaattccagtataattgacagtaattattcttccaaagaacaaagaggtgaaactttgaagatgaagatattgaagcttatgttgttaacttactatctttcttgctatgcagtctcatattttttgttttgtttagaaagctcattttgttttgaaatgagaacaacagtttaaaagctatggcccaaagacatttggttcctggggaacccactgaaagattcctgacagccgggggcacttctctactggtttttgtttgtctgtgttttctgtgtgggtggatcacattaactagaaagccagaaaacagatattctgcatcagaatcaaattactaaatctagttattgcctgccttctcttctgggtttcttgtgctttgtagagtttttgcctgtcatctggtgttagctttgtaaataattagttattgatcatgaataagttgtacagacctttttgctatcattccctgggtcacaaaatagaatgtagttaatagacaaagatcctgtcattccttgttaatgaacacttatttaagtagagcaaggaatgagcaggtcttattcatctgtttatttatcgataagtttctgagttgttttttctcagttttttatccacttcagggtggatcaaaaaagtggttctccctggtttatctgggaaaatgaaaagggaagattctagagactttaacagtgatcttttgttacagaaagatgcttcaaaaggatcacggcaaaatgctatgttctaaacatgttggttggcacaagagaaactgttttacatttttactcatgagaggttctggtagaatttaaaaaatattaaagattcattaatcatgccttatagattttgaagctgtgttattgggggcatacagatttataatcatgatgtctttcctgttggtctattccttaatcaatatgaaaagtttctcttaatcttttggctagtatttgcatggaatacctatttccatcttttattttcatgctttctgtgtctttatacttaaggtgtgcctcttataatacaacatatagttgtatttttctttcatccagtctgacaagcttcttaattgagcatttcatccatttatatatagtgtaattaagtaatgttagatttatatattatttttgcattaattttcccttctccatctgtattattttccccttttcctccttttttgccttcttttataccagttacactttttttaagcatctcattttctgatttttaaacatattatttgaatattcttttactattatttttaacaattattctagagatggtaacatccatgttggacttattttagggtatttcaaatgattactcttaccaatccactgataatgctagatatggccagaaaaatagcacgctggaattgccattttcttctcctctgttttatattattattgtatttcaattctatgttttatattccataagacattactgttattttatacagttagtattcatttgatgtgttttatgtttgtaattgtttttcatccttcaatttcacttttcctttgggatcattttctttctgtccaaagaactcacttgtattatttcttttagtgttggccagttatgggactctgtttgtatgaaaatgatttatttcatctttgtgtttgaaagatattttcactcactatagcattctaggttggaagttattttcttcttccatgtattctattctattttgatttccttcatttatagtaagtcattagctttcagacttactgttacatctttgaatttaaatggtattattttctttcttgctgcttttagtttgtctccttttctgtggttattgacaatcttactatgggttgcataggattgtttttgctttttatttatcctgcattgaatttctgaattttttgattgatatctttgatcagttttggaagatttgtggccattgtctgttctaatgttacttttgtctcattatcttcctccttttctcctggcacttcaattacatgtatgttagatctcctcaatatgcctgcacattcctagccctcttctgtattctcttcctcagtacttctgtttagttattttctgtggattgtcttccattttactaattctgcctcttgctgtgtctactctctattttgttaatccatctaataaatttttaattttagagagtatattttgtagttttagaatttccagttgattttttcatagattcatttctctactgaaatttttctcttaccttctatttgtcatttttttatcttattttccctgttctcaaatatgattatagttgttttgatgttctaggaaattgtaatatctagattatctgtggggctgtttctgctctctttttcctctttcacttggactgtggtctggttttctgctgagtttaataatttttgtttgaagtcaagactgtttgtatgtaaaactgtagaagcttcagatgatgtgatcttcttccagagataattcatcctgccttcttctagacaaagtggggctgaccatcttattttaatcagagactgtgctcagtttcgaggctacactggacctttagtatgcctcagtctccatttactgtgcctctggctttctaggattttcatctgagagtcggctctgttacctggggactctctccctggcgttttccaaactgcgagtcattttctctgatgattggtgcaaattccactttgctttatagaggttttcgttttggtttttagtcttctatcccatacaggtctaggaattacagatgtcctgaggggaaaaatgattgcagcttgatggctcccgaagggttgcaccagtctaccaggtgttcttcatgccacttgcaagcagaagttcatgattccatcattttaattgtttggtacatcatttaagcaaaccccatttgaaaacccttatttacaaaacagatccactaggttgcaatttcccattttacacagaatttgttgctttacagtggaattcatttaaatatcagactacctctagggtaattaattatcacttagtttacaaaattttccattgtacacaagttttcaggtatcgtatatttttaattaggcagcaaactagtattagtaaacactgtattaataaaacatctgagtcacaatattttaaaatgcaaatgtgttgctttttagtaacacagcaacttgaagtaactgctaataaataatttacaaacgagacttattttcaattagtaacatatattagcatacatgtaaccaatgcacaacttccttattacctatttattgaatatgtcccacctcttgaatacttttcagttaccactgatgttgaaatgaatgcgtttgtaaagcaccattactctggaataaaaaagcaactcttgtgatatcattttaaaggattagaagatcatggtaaatttaggcaatggagtgtgttgttgattttcaatttgtgacataatgggtttaaaaacattggtagtggccgcctggcggctcacgcctgtaatcccagcactttgggaggccgaggcaagtggatcaccttaggtcaggagttcaagaccagcctggccaacatggtgtaacttcttccctactaaaatataaaaattagctgggcatggtggtggccacctgtaatcccacctacttgggaggttgaggcaggataattgcttgaacccaggaagcggtggttgcagtgagccgagatcatgccattgcactccagcctgggtgacaagagcaagactccattacaaaaataaataaataaaataaaaataaaaacactggtagaaaacacaactgcatcttaatagtgtaatttttgtggggtagaaataaagctgaatttccccatcctctttccctccttctcttcctcggccctttccaccctccctttctgtatattttctgtgtttttcagatttataagatgtagtatgttacaatgaaaaatgcagtgagtggtagcattaagggtcagcctctgtatgtggaggcacgctgccttggctgagtggtctgcatgagtctcactgccaagttaccttccttgcttcatagatgttgaggatgtggtctctcattctaacttgtcacccaagtgattcccttcatggctatagacatggattcaaaaaatgttgaggtgtttctgccaggcccccacagtttgtgtgtttctttgcagactgtatgaaaacaagggagaggctgacttcgtggaatctttgctgcagctcttcaggtccatcaatgacatgatgagcagcatgtcagaccagaccgtccgggtgaaggtgagtgccggccactgccaaggcagacttctccttctttttttctttcattatctcttttggaggtaggtattttgattacagttaattaacttgccccaaataccatagttgttaatgtcagagatctcaatttgatttcaagagctgtgctttttttttttttttttttttttttgagacagaatcctgctctgttgcccatgctggagtgcagtggtgtgatctcagctcactgcaacctctgcctcccagcttgaagcaattctcctgtctcagcctcccgaattgctgggactacaggcgcatgccaccatgcctggcaaatttttttgtatttttagtagagatggggtttcaccatattggtcaggctggtctccaattcctgacctcaggtgacccacccacctcagcctcccaaagtgctgggattataggcgtgagccactgtgcccggcctttttttaattttaattttatttttagatgacacataaaaactgtacatatttatgggacatacgctgatatttcagtacaggtatacgatgtgatcaaatcagggtaattagcatagcatcaccttgaacatttttcatttctttttgctgtgaacattcagaatcctttctacttgctttttgaacatatacactaaattattgttgaccgtcttcactctgcattgctacagaacactggactttattcttcttatctagctgtagctttgtatcaaagtggacttgtagatgaagggcttcctgtggctgagctaaggggctgtgggccctgccaagcctgaactcgagggaaaggccccggagcctcttttgtagtgaacataatcatgctccatgtgtagtgaaatcccttcttcctcctccctaggtgctcttaaatattttcattgcttctctctttgctgtttggcaagacagattctgaattcactttatttaaatttgggggaattgatgagaatcatgttttacacctaatttctcagggtgtccatgccctggaaagggtggtgaaccttcatgcttcagtggatctttgcctgtgcagaagagcgagccttccagtgcccctgtccttctgtccttcttccctcttttgatgacctggtctcaccctgttgtcctttggaagaaagatcccttccactcacatgaggcctgagtgttctttaggatgctcactggtgtggaagtgcctgggaggcccatggagcagccgcaggacccccacactcttggttatcctagttatggcggttttcactgggctgacttattgcagaaggagctgtacaacttgcaatttgctgcctgcactaattccttcaaagaacaagaatcttccaaatgattagcttacatctttcactcgactgatcatggtagacgcctctgttcttcctcttttaatgtttgtttaacgtataattttagaaggcattcttatggctagtgtcttaaaaatattttggtcaagtcgcttcccagccttaaagctttgccatatgccctggaacaaagatgtatgtgtgctgagacgtggctgatggttgctgtgaccaaggaaaccagcataagtagacatgaatcaagtcggagcctacctttcatctcagaggtggtgcagctgtttggtggagccatttggactcttcactacgatttcttgattttttttttacatgatttactataaaaattggtgatttatacagaaagaaatgtaggtggtgcatacattaaaattttaggttatttgggcaacttgatattgcccaaagctgtcttattgtcccaaggttaaaattagcaatgtgtttggtacatttactactgaattcagtggcattttagaaaaacagacgtgtgtagtgtaagaatagataaaaattacaggaagttttgagcccagcagtaattttagattgctaaatatatccttacattattaaatttgattgggcttgatttgtgtctgcctccctcccttgaagtcagattacttagtgactagggaccgggaagaccgtgcttcagtgggtgttttattataagacacaagtgaattgagtgacgtgtgtgcattgatgcaaaccttacatctgcaagacagacgcacggcgttttattaggcatgtcacctcccttctggtaattggtatcgtattatttcacaataggtgctttctcgatgacgttggaaatttaaagattcccatcgtgggagcctgacttttgtgttgttttaactctttcagttttgctgtgtctaaatggaaggaaataccttgtgaaccatcttccacagacaaagtatattttcagactgtgacatttaaaggttaaacattgtttccccaagtgtggccctcgttggtaccaaacggttggtaccttcccggttcaagtgattctcctgcctcatcctcccagtagttgggattacaggcacccgccagcatgcctggctaatttttttgaatttttagcagagaaaggctccatccccttcttggtaccaaacctgccactggcatcaactttgcggattagagtcagccacggggttttacgcctcattgaagagggagggcaggaggaacttcagaagtcatttattgcaggataagcatggtctccagctagaattttcaacaggactgttttcattgatttagtgacaaaatttttccaaggtcatttaagtgagaaaacacaaatggaggacgcgtgggccagtttttatgttaagtcaaatgtccaggaaactccactgagtgtgtggatgctgcctgccttcactccccttcccagcggccgtctcccgtcacccccgctccccaggcgcccgccgtgcccagatgtttcagtaccgcctcaccgtccctcagtgaatggccctcagccctggggctgcagccaaatactttttgaaaacatactgccgtggccaaataacatgaaattccccatttctaagtgtcccgttcagtggcattaagtacagtcacactgttgtgcaaccatcatcaccatccctctttagaacttttacgtctttccaaactgaatggaactccagccccatcaaacaccaactccctgcagcccctggcagccaccggtccactttctgggtctaagaatttaatggctctgggaacctcatggaagtggactcataccacatttgtccttttgtgtctggctttttttcttttttttgagacggagactcgctcagtctcccatgctggagggcagtggcacagtctcggctcacagcaacctctgccttcccggttcaagtgattctcctgcctcatcctcccagcagctgggattacaggcacctgccaccatgcccggctaatttttttgaatttttagtagagacggggtttcaccatgttagccaggctggtctcgaacacctgacctcaaataattcacccgcctcggcctcccaaagtgctgggattacaggcatgagccactgtgcccggccgtgtttggcttcttttatatggcataatgtctgcaaggttctaccaggtggtggcatgtgtcagaatcttcttcctttttaaggttgtcatgttgctgtgtgtctcgtgcacattttgcctccgcacctgtccctggatagaggctcggcctgttcccacctcatggtggttgtggttcatgctgctgggaactggggtgtacaggtgcctcttgaagaccctgctgccagtgctccagaagtggaattgctgtttctcgtggtaattatgcttgaattttttgaagaatcatcctgtttttcccagcaccccaccatgctaccgaaacctcacttgaaattccatattgactttccctcagcagccctttccgcagctcctccagctccaggcatatcctctgccgcacatcacctaccttgagtgaatgatgcggctccgactgctgcattgaaaaggcctggggtcagaggcggaggttgcagtgagccgagatcgcgccattgcactccagcctgggcaacaagagcaaaactccatctcgaaaaaaaatgataaaagaaaagacctggggtctctcggtatcacctcttcctgtctgttttcctctgaagaggagaagcccacctgctgtgcagtgctgaccgtccccctccctgagacccgctccacccctagctgtttcctcaccatctcagatcttctgtcttcaccttgagctgccccttcacccggcccagatgttctggaaattcaacccgtgccttctggattcttctttgccctcggcgtttctctctcctacctgacaagagggtccttggccccattgcctctgccctctagtcgtgttctgtgttctgccccaagagattgtggctgctgttcctcccaggtgcccccgccgcccccagctgcggtgtctccagtcagcctcggaattcccttctgctgtcttctcttctctgtgctactgtgactgtggtttcatgaaccactgggcttgctaggtccccagttcttcgtcttgaaattagggcagaaaagtcttggaaccgtttcctgcatgctgatgctggacctgccccttttttcctcggcatctcttttggtgttttcctgaaactcccatctggtgatgacttgctgtttctcagaaaactgtgctgttcttcagctgccaggagaaatgggtcagattccagtgtgtgacatccagacagcttcataggcagcccacctggctctccaagcctttttccctcgtggagacccaagtagaaccagtgcgttccccaggaaacaccaaacatctgggtgtgaggagcctcctgagggttagctcccccaatcagtggttgatagaaatagcatgagcgcctagtgccagagtaactggagctgatacttattgatcgcctgctgttcaacgtgctttgtatttctcaactgatttagtctttacaatagccctattaagtagatactttgattgctttctgatgaagacactgaggcctagagaccttaattaacctacccaaggccacaagagctgggatggggtaacgcgctggtttaaaccctggttggctagttccagaaccactctctttcccatttggctcctagagacagtgttgctaagtcctggctatcccgtggtgtttggaaacagggcccatgcctgccatccacatcaatggagaacaggctggatgctttgggctggaaagatgccgacattatccctggtggagctttccatcgaagtggacatgcataaagcaacttaaaaactctggtgaaatgccacaagaattgggtgagtgtgaaggggagggaggagagttagaaggggctggtcacgaaggcttgtgggaggagaccttggcgatggccccactgtgttggcagcaggtggctgtatcttggccactcgtggattgcagtgctggattgaggcgtttggggctttgcagtcagttcttacaggcattgacatcatttcaagtccacaaatgttactaccttcccttaggatgaccctgggaaaagactactgcatgcaggaccttggcatagtctgttccatctggggctgagaatgccagaattttctatagaaggaaactttgaccatgatccacagtaggaaattgatgcttacttggtatatgtgtgtgagtgtgtctgtgtgcattgtatgtgtgtgtgtgtatgtgtgcgtgtgtgttgtgcatatgaagctggaaaatgctcatgaagaagttctacactgattccctgtgatgcattctggcattttctagtctagtctcctttagtctattctagactaatgtatttcagttaaaaaaaaattgctggttgacaggcactaaatttatttcatgagcactaatggatctcaacctgcactggaaaaacactcctctttattcatctcaggactctgcccctctgtctcctgcttagtttattatgaaaatattgtcagctttctgcatttcttccattgtcgtgtagagccccaggcccctgacgctcaggcaactttcctgaccagcatgcggattgaactggggtgaagattaattgaatttgaggccccccaagctgaggttggcacacagatgcagaaggtttgtcttccttctggggcactgtccccagggagcaggcttccccatctctttccattctaaccatcacatggcgccatttccatctggctttcttagagaggagctgtgttgaaataagctattctgtaatctcagtaaatacagctgatgggtgagttctgccctccaagaggcacattttttgattcccttaaaaataatttcctgatttgaaatgaactgtattttcttgccttaaatcttacccagaattcttccttatgaggagtttttgctgctttttgtgtatttatttccgggctagcatctgggatccacacggctactcacagatttgtacacatagaactttactgtcctcagaacaaatgatctgaatgtgttagggatgatgataatttaagatcagatggaataggatttgctggcaggtgaggaagtcacgtttcactgagtaactttgggcctgtctggcacctctcctacagcagctcctgccttcgccccttcgtctttatatgtgtgttccagattttcataaaggtatcaagtcctggtagttgcattaaacaaagcagccatttattgtgtccttgccctcagtttaaaagtaatatgtgatctggttagaaaaatgccaaaaagttaattaagaaaaataagaatcatttatcaccctaccttccagagattacactgttagcatttttgtttttacagtgatgagctctttttgcttatttagcattatcctatatatatacacacacatatgtatacacccacacctatatatacacacatataaatgtaacatatgtatagtataaattctcatgtgtatacacacacacacacacttttacagtgttgcatttttctgtatatatctacctgtgtccttcagtatttttcaagcacacattttgaaaggttacacattgcctcatggctgtatgataacttacttaaccagttttccatttgagggcacatagctggtttctagttgtcagttttcatgaacagtgcttggctgacctctctgtctatggcaaaggccttgctccatctggtttgctctgaggcatccagattttcaaatgctctaaagtccgatgaaagtcatgatcaaggcgattagggcttgattcctgggtgatgactctgtgcttctttcattggcgccgtgtgtctgccctgccttggtttccactagagctcccgtctgtttcttttccacttccttctatgcttcttgtcattgggctatgcagctgccatggtggatgagtcgggagccacttccctctctcagaagccacctgcttctgtgacctttgtgtttcttggtacaggattgttggccaagttaggtaaggagacgagaactccggtgcgttccactccctctgacctgacgaatcagggtctggagcaaaccaaccaatgagatgttggcaccgtcatagaccagcaagcagcttaaagaaatttgggagtattttgagtcagaagggtttcccaagagcaagtaataaaatattttcaccttcttgattttgagtggaggagggggtgcactgatggtgttaattgatctgaggatgtcatgggcatgagtcaggagtctatttgagagtctctcatcattcgtggggacacagatgcggtggtttggatgaggaccgtctaggtcacattgtctgtatggagacagacttgttgaattagaatattgggcagctgaggctggcaactcaggtgaagccaaccatgacaggaaggactacacttgttgagaatcagcaacaggccaggccttctggagagttctcctgcaacaaagagaagagagggaggtcccagagtcgaggaggtgagtaggccaagtttggaagttgctctaacaaaatactacaaacttggtagcttaaaacagtggtttttttcttctctcagagccttggagattagaaacttgaaatcagggtggcggcagggcaggttccttttggctgctccaagagatgatgtgttctgtgcctttctctaggtttctggtgatccttggtatttcctgacttgcagatgccttgctccagtctctgcccccgtcttcacgcagcactctccctgtgtgtctgtctttgtgtctcttctcttcttatgaggttgttaaattcagggccaactctactgtggcgtggcctcaggtcaacttgattatatctgaaaaaagactgtttccaaaacattcacaggtcccaagggttggaacttgaatttagcccttttttttttttttttttttttgagatggagtctcgccctgtcacccaggctggagagcagtggtgtgatctcggctcactgcaacctccacctcccgggttcaaacgattctcctgcctcagcctcccgagtagctgggattataggcacccactaccacgccaagctaatttttgtatttttagtagagacagggtttcaccacatttgccaggccggtctcgaactcctgaccttgtgatctgcccgcctcggcctcccaaagtgctgggattataggtgtgacccactgcacctggcctgaacgtaaccttttgaaggacacagtttcacccacggtagacgtcatcgtggacgtcagtgtagagttcactggcaggtcagtggtgaacaaaggactggagaggaagtgggtccttagccaggcacccacagtcagtttgacatgggagctgcaggactggaaacttcttagaatctagtgtgcacatgagtcacctggaggtcttgttaaaatgtgattccgactctgtagggagggggcctcaagatgtttcattataatcaactcccagctgatgctaaggttgtgggtccctggccatatattgagtcagaagtggccacgcctcgccttgcacagacagctgctgtgtgagcagtagtgtttgtgggtagggcacctggtctcagttcttgcagccttcaaggctggcttcattcaggctgcctgccctcagctgtctgacgttctggactattttgatttgataagtttgccctacacacagatgatgacacacttgcaagtgtgtcatgttaagaaagactcagcagaagaaggaacgagggaagtgaagaaaatattttatggcttgctcttagaggacctgtgggtccaaatgctccccatttcactatactgcttgctggtctgtggccctgcagagggttgggtagtctggctgagatctgaactcaccaggtgctgcagcattccagtcttcttggttgcttcctaggattcttcctgcccgctctggagggaacaataccactcacataggcaagaattaatcaggagaggtctggataaatacacttgtttccttgagcacctctccacccacatttatactgtgcacagtactttgcaacagtagcagaaatgcagcagtagcactaccttgcagaaatgcaacagtagctgaaatgaaaatcatctctcttccaccgtttcttcagcaaaccaagtatttctattggttttcttccaattctagtgcatgcccatcaaaatgtttatgcttgcaacctgcgtagtttttggtttactgatttttttatcattttatcacaacacctttccattattaatgtgtagttgtaattgtaatggctgtatgccagttcagaacatgtgcctgaattgatgtgcaatcatttgcttaatcaaatgatttttcctcaaattaatttttctattgttgaatactaccgtgttgcttttagcattttaagcctgcaacaaattatttcattgataagtagtgtgtgtttatgttttctttaattttatgatccatttttccatgttgattccttcacattgccacttgttagaggacaatgctttaatttgagattgcagaattctaggcacttgcttgccatccctcctgccttgtccccagtaatgatgctcactggtggaaaatctctcctttggccatggtggcttcagtgctcaggaacctgaacttattttcttctcccacccctgatcttgttcagagatctctcttgttaggtgctcctcccacatctgtgccctcggtcttggattctgcctgctgccaacatgcaaggtgccagtgagcccctttctccttcctccatcatggtcaggatttattcagcatttctctgaaagtgagcaggtctcagagttatgcttagtacctcattgttgagttatgtattcacctgtttaaaaaattccttcaatcatatgttcattctcctgtgtgccaggcactgtgctaggcactgaggagttacagcaccaatcacacagatacgctctgtattctcatggtggttccattggagtgagcaaggcaggcgtgaactcagtaaccatcccctatgtgtatagttgcatagttgcaatatgtgattttaagcaaatcacagacataaaattatcattgtggattgtagtcactcattttaagaaaaagtaaaggtcagggtgacaaggtatatcggggcattggaagtagtttaggggttcaaagaaggtgctgatacaaaggtagtcaccatgaggtgcttggatatgtaatacagcagaggaaaatgccaaacccagactctcgtatggtttggagagaactgtgctgccacttttgtccagaggggttgtggagcatgaagtaatcctaatcccttctgttcgtgcagtactctcaggcaccaaagactttgatgcgtgttatctcttaggatcctcccagcactgccatggtggttgttaaaaataatgagaaagctttctaaagggacgggcagagaacatcatcatgcaaagtctgtgcgtcttaatagctgactcattgatggaaacatttatatcccacatccactggctcttgtctggcttcttcaaatgcacctgtccctaggaccccttcctagagataccagcatttagaacagaccagtctaaacaaggtcttctcaagtgaactgaagatactaggcctgcaaacgctcatctgcacctcacttacgatgtggcatttataaatgcattcaccgtaggtgtttgtagattctttttatgttttaagttttaagtttgcagcattgaggcctattttgattgcaaattgcataaacctcaaataagatctaaatcaaaggaaaggtattgcatgcttataggtgactcaacattaagaattcagttcttcccaacttgatctacagattcactgcagtcccaatcaaaatcccagcaagtttttttgtggctattgaccaactgattccgaagttcatgtggaaaggcaaaagacccagaataatcaacacaatatttatggagaacaaagtcagaggactggcactactcgacttcaagtctgctggaaagctccagtagtctaattacagaaacccaactccaattcacattagaaagaaggaaattaattgattcatgtagtttgggagtccaagtgttaagcatgagtgagtttaggatttagaaggtatcctcctcttggcttagtatttatttctctccatttgagggaaaagtggctgccagtagccagaggcttgcaattttcttttttgtctaatagtcttcgaggacacagagtgaccgtctccctctttaaggcaatgttaatcttcagacagaaccatcgttaaccttcttttaagcaggaggctatccctgaaaggaaaagactgtgaagttgaaacagaagtagagcttcataatgcagaaaatggagaaagagggatgagaggactcacaggaaggctgaagggacatttgtaaatgcagctgaagccagtgcaaattggcgactttgtgaaatgggttttgcagctattctttggagctgtctgctgaggtgatggaaagggtagttaaaagcttcatttaggattggtgttctgccagcatgccaagtagcccaaaccaaggcctgggaggagagcagactttaaatatgtcccaggaaacgttttattgagaaacatgtcaactaccactatagcattatcaagagggaaaaaggaatatttcatatgtgagcttaaaaaatcattagctctgttatattgaatacttgcaaaatttcattaaaattgtttttgcagaattttatgatagaataaattacttttgtgtatgtattgatgaaatcatggagttatatgagtttggatttctcaagcacccaaatagtcaacatcaagaatcagggaattaggaggttagaaagtcacatctttagtttttttcaggaacttgcccaggaacagaggggtcctaggtgggatgaccagaccccagttctctgttcttcagcccagtgcttttttcatgacatcactcaagtcagattttaaatttgtgcattacactggctttatttagaatcctgtgccaggcaatatagttttgattagaagctgaacagtattattctccatgaactgtgaatgtgacacttttataattcaagtagaattatttttcccttgggaaatcctatacattcaatatggtacattgaattagcaaagaggtagaagaaaaaaggggctataaaaagtgtatcttattaaaacaaagtaggttttcttcttgcctgtgtcacctttagatagtaattcttagcatcactattttttaaatcacaaattgtcttctatctagtgaaatgattaagaaagaacagtagtcctcatttgattaggtgaaacgtgacacaagtctcgttgatttttgaaaaggacattttcatataattccaagaaatacacattctgacattaaacattttatatgatccctattgaagattaaaaggagaggtgtttggccgggtgcggtggctcacacctgtagtcccagcactctgggatgctgaggcaggtggatcacctgaggttgggagttcgagactagcctgaccaactgaccaacatgaagaaatcctgtctctactaaaaatacggaattagctgggcttggtggtgcatgcctgtagtcccagctacttgggaggctgaggcaggagaatcgcctgaacacaggaggtggaggttgcggtgagctgagattgcaccattgcactccagcctgggcaacaagagcgaaactctgtctcaaaaaaaaaaaaaaaaaaaaaaaaaaaaaaggagagttgttatgtctgggaaattaggtggccatcaagttttttcatggtttttgtttcattgattgattgattgatttgattgacgtactgagaccgagtctcactgtcacttacgctgtagtgcagtggtgcaatcttggctcactgtagccttgacctcctgggctcaagtgacccttccgcctcagcttccaaagtagctgggactataggccagcaccaccacagatggctaatttttgtaatttttgtagagatatggtttcgtcatatattagtctattttcacactgctataaagaactacctgagactgggtaatttataaagaaaagaggtttacttgactcacagttccacaggtttaacggaagcatgattaggagacctcaggaaacttacagtcatggaggaagacgaaggggaagcaaggaccttcttcacatggcggcaggagagagagcggagggggaagtgacacacactttaaaccatcagatctcatgagaactcactgtcatgagaacggcaagggggaggtctgcccccgtgatttagtcacttcccaccatgccgctcacccgacacgtggggattacaatttgagatgagatttgggtggggacacagaaccaaaccatatcactccatgttgcccaggctgagtgctagattcctgtgtgttattttagggcactttatacttttattatttaccagtgtttgagaagtttatgatggttcacaaaactttctcttcctacgtgggtcttatgtgtgtttttgagtgagctgatgatacactcgtggccagcactgttctgtgctgtgtttctccacccagtgtgtggacatcttgctatgtgcacaggtaatatgtccttcttacacagaggggtgcaaaggttgagtcaaatcagcatccaaggagttgctgataaattgagaacttcctgacagcaagtgacaccaaaacctcaactaaaatgatcagcaaagatccattaagaaaatatcggccaggcacggtggctcgtgcctgtaatcccggcactttgggaggccgaggtgggcggatcacaaggtcagtagatcaagaccatcctggctaacacggtgaaaccccgtctctactaaaaatacaaaaaattagctaggcgtggtggctggcgcctgtagtccctgctaatcaggagactgaggcaggagaatcgcttgaacccgggaggtagaggttgcagtgagccaagatcacgccactgcactccagcctggatgacagagcaagattctgtctcaaaaaagaaaagaaaataccaagaaccagaaaacgggtcgtggcgtaaaccttggtgaggaccttggaattcaaggtgaaaggcagagtgtgccccagggagtggtgagggttcctgcagcatatgcagctgcatcccccaccccagcaccctgatttctcctcactgctcagctcctctggaatccttgccttcccacctcattggtggagctgctccattgaaacccaagactccattccaggcctggcctcagccccatctctgcccagggctgacaggggggctccgtcatctaccccagggcctgtgccttccttcttcctcctggtggcatttccatgttgggggcccctgcttgtccctggggtgcaggaattcttaagcacctttggcattttgctcctgccttcttgcctggagtttcactgctgtctgcaggcctttgagaacagaggcagggaggtgccagaagcccttgagagtgtggtgattaggggttggatgccctgtgcgaatggcaaggaggatgattcttgaaagaaaatgtcagggtaacttaaatttctctgaggtcagcttgcttgttgttaattaagttcttactacgagggccgagcgcggtggcttatgcctgtaatcgcagcactttgggaggctgaggtgggtggatcacttgaggtcaggagtttgagaccaacctggccaacatggtgaagctccatatctactaaatatacaaaaattagctgggcgtggtggtgggctcctgtaatcctggctactcaggagaccgaggtgggagaatcacttgaacccaggaggcagaggttgcagtcagccgagattgcaccactgcactccagcctaggtgacagagcgagactgtgtctcaaaataaaaataaaaaaagttcttaccaagaaagcagtgctaagtacttctccagcactgcttcatgtcggttggcttctccagacatgggcctctttgtggatgttattggaaagggtagtgttttaatatacgtgcgcttttcacatggattcaaggatggcatgggtgggtgggattactcgactttatagcatattaagtgcttatttggtgccagttatggactcgtactgggcagatgccatgaggaatgtacagtggaagatgttggattctgactgcaggagaggaaaccaggtattcgaccccccaaatagatgacagattgtgtggtacatcactgcatcattgggtgtccagacgagagattgcaggcaagacaaggacctaaagaaagtggcaagtgcactgaaaccaccagttaaggcctcctcagagcaggttggactgccctgagctttgaggggtgggtgtgagttgagatgggggagcattccatggaggggcaggagggtatggatgggagggagaaggacagtggaaggaggtggtggggatgggttgttctcttgggagcccaggggcaggagtggaggcaggcagcctcgttccacccctggtattcagagccgagaaaaggaatttggacgaggaggtgctgtgctaatgagaggcagtattagagatcctgagctgacacactggaaattgacatatgggcttatttatttatttattttatttatgttttaaataaaggttaagatcttccagagaagacataggaggagaaatgggcattatttttccaggggtctcttagtatgtaaataacctgagttcttaaaagttttatcttatagaatttttttattagttcttttatttttgtcatgggaaaaattcagaagctttcctggaaacttgcatgtctgctttcagagttttgtggctcttacaaggagcccctttgggggtgtggggcaaccttgcatcccaggaagccgcctgggagattctagggctggtacctcctttccactcagctgcctgggagattctggggttggtacctcctctgcattcaggctgcctccatcagctgaagaggcgagagtgtcataacatgacattctgtgtatgcgcaatgtatttgtagaagatactgatctttggatccggcaatcccattcctgggtatctacccagaggaaaagaagtcattatatgaaaaagatacttgtacatgcatgtttacagcagcacaattcacaattacaaaaattgtggaaccagcccaaatgcccatcagtcaacaagtagataaagaacatgatggagtactacttagccataaaaaggaatgaattaagggcatttacagcaacctggatggagttggagaccattattctaagcgaagtaactcaggaatggaaaaccaaacatggaatctcctcttcatcctttttctgtctgcctttccttgttctcatacttaaagacagcgtgttgggagcggtatattgctgttgtttttgtcttctccaatctgaccacctatgtcttttatttggagtatttaatcccttgctttttgtttgtttaataatccctttataaaacagctgaattataaattgatggataaatttatagatgttgaaaggcacaaatctgaagtatgcagcttaatcaggtttgacaaatgctgacactcatgtaacccacactggcatgtttgcaccagattaaagaacatctccatcaccagtctctgaacattggatgcatttaccggtggtgttgggtatatttcttccatactcccgtctggaatctgaacctcttgatcccatttgcctcagcaactctgactccttcagactgaaactttctatcccacagtattttcttgtttccatcaagaaaggaagagatttaaactctgttctgcaattctgtctgcatttcctctctggaatccttctctctctccaaacaaagtggttacctctttaaaataggcagtgaacatcaaggaaaaccttgcataggctgaaaagggcaaagtgctcacctttgcttgcattgggaagtaatttcttttaagtgtgcatagagacagactaataaaaaaatctgttgagtgtgtcatgtggcagtcagtctttagaagtgttgttcctttgtcttttaatcattctcagaattagcacaccagttgtgtgatatgtaaaagtctattcctggcagggtgaggtggctcatgcttataatcccagcactttgggaggccgaggagggcggatcacctgaggtcaggagttcgagatcagcctgaccaatgtggtgaaaccctttctcttctaaaaatacaaaaattagctgggcgtgtaggtgcatgcctgtaatcccagctactcgggaggctgaggcaggagaattgcttgaagctgggaagcggaggttgcagtgagccaacattgcgccactgcactccagcctgggcgacaagaatgaaactctgtcccaataaaaaataaataaataaatcttttccctagctcatttttttttgactgtgttaaattcagtggagcaaggtctcatttatatcctccttattcataatttggggtaattagcatagtggttgggctgccattcacctcttacagctaggaaaatgaggctttgcgagaggaatgcaaaaatataaacaggattaagtcattgatggcatgctcatacttcctaggagaattaagtcttttcaggtaccacagtatgtatgagtccttcttaactctcatttccaccagatctccaccaaggagtttagaactgatggactccaagtctccctctggatgagacattctgagttcttgccaatatcatgctaagctgggttgataatttcctttgaaaaatttcctttgaaaatgagtagcatttcatcttttggaaatttatcattcttcagacttttcactgacctgtcccctcccatagccgaccccctcctgtaccccagggtttgattgatatttgcttttgtattgtaattactatttaatatccagccctcctgaggtttgcttcactgcagtcacattgtattgcaagcagaaaatgtcacgtcgcctggagctgttggggtagtgtggttgtggtcctttgggtatttcctggcacacctggctcatgacatcgtgcagagctgaacaggctctaggaggaggaaggaaaccttgcctgggtacttaaaattatctatcacagtggatcctgagtctgcctctcagcctgtcttgaatgccaggctattataaatcagctttatttattttgtgtttgaattttgactttcctgttcaataatttaatattttaaaatgacacctttggtcttttatttgtcataagcgagggccgagttagccaccctgcaatttgcctctgtactctccgccccccagtgtgtagtcgttagctcataattgttttcttaacctcctcagagcctggtgtgatcttgctctcaaccttcttgaccttccaaggtagttaaatgaggttttgctttctctatgaattaattatgtcatctctatttgaaatgttcctgaacccatggtgctgtattttggcaaaataaatactattttcagagactgtaagacccatccattttatttccttttattagaagatagaacgattttcttagatgagcagttatcagctgatgttcaccttcttggaggaagggactgctggcggttttacttcaaatgcagccatttgaagtatctgatttggaacattccatacctggtgcagaggccacttgtttctacaggtttgtcctggtggtctgtcctctgtgccattgaactcccagagtcctctgcagaggacatgtaataattcttgcctattaatttgtggaccctgtatgtggggctttttttttttttgcctgtttgagacttcctgcctttaggagtagacaatgacctttcatacgtttaatgcttctgttgttctcaagtttgagaatgtggtgtgtcccctgggtcccctccttacatgaaatccaacccaaagggtcagtgtgtttcttgtgtgtttctgtcttcactcctctgtccgctttcatctctttcctggtgagtctctgccctgtcataagcaaataaccttagttgtttcctccccagtaatggtggcttcaattgctgtggatttcctggcctgatttcaaggctaggggaaaatgcctgtgtcctggttcagaacaggcagtctctttatttcttctgtcttgccgtggacaaatagaatcgtggcccttacgagttctttctaaaaaaatcacctttattgaggtaaaatttatatgaacaaaaaaatagaaccatttgaagtatctgattttggatcattttgaaaatgtcccaaatgtcctctcgtcaccaccgtaatcaagagctggaacatttcgccaccccagtgatctccctttgctggcccctggcgatgctcatacatgtggtggttcttcacgcgaaagcagctgacctcaaagagggtgaacatgagccctgctttcctttcctctttgacttcctctctgatccatccctaaactacaggattttgtcatgttagttcctattttctattaccatgaatgactgttggcgcctcaggctggggaaggttaattgtagtaacaaagaagaggttttcctggcaggaaccatttccttactcaggaaacaaacgctttcctttctcacagtcatcttctccttcttatgtaagtagaaatattaagccatactcagtctgtccaggtcctgagaattggtgtctgcccgggtctgggtttgtattagtctattctcacgctgccaataaagacacaccttagactgggtcatgtataaagaaaaagaggcttaatttaagggactcacagttccacatggctggggaggcctcacaatcatggcggaaggtgaaggagtagccaaggcatgtcttacatggcggcaggcaagagagcgtgtgcaggagaactgccctttataaaaccgtcagatcacatgagacttattcactatcatactgtcatgagaacagcatgggaaaaacccatccccatgattcagttacctcccaccgagtccctcccacaatacatggggatgatgggagctacaattaaagatgcaatttgggtggggagacagcccaaaccatatcagggttgcagaggcttatgtgggaggatcaagagtgacagcaactgtctggctggaggggaaggagacagaacctgtccctgggccttcgtctcctttccccgtgccccacacctagccctggggagcccgattccctcctcacactcccttggctcccttcttgtctctgtacacagccccaagcacaaaacgactgctcattttcctggccatgctgtgctttgctgtctccatgtctttgtgagcagggatctttctccttggaaggcctgttctcttcctgtcttccaggacatctgcctgtcagcagtcagccttctatatccactgcagaggccatttgtttctgcagatttgtcctggtggcctgtcctctgtgccattggactcccagagtcctctgcaaaggacaccatgttttcattaaacacatagaggaggcatgttggcaaatgtcatttgcagatctgtcttctctagcagggcaatgctcttggccattgaacattttgcctggcatgccacaggttccaacactttctggacaaatgaataagtgaactggagatcagtaagttattttgaaaatgcacctgctgtggcatttgaggagatgtaaaatacctggtgccctcccttcccaggacccctccaagctggacgagcagtcctggctccttggtggggcattgtctggtgagccttgagggcgtgcttgggtgccagcgatctccccaccctttgctttgttagtttttgctcctgacctactgctttgatttgagaaacccttcggctattaaaatatgagttaatcatctaagaaactcactaactgaacttcatagtgaggaagtatgcttcctgttgatagataataaaacagagtggaataatttgaattctttataatggatgtgattataaatgatttccccatttactcatataaaaggctaaatggaagatgattagtgagttctgttttctgtttttcctaaggtgattttttaatcttcccaacaaattcctgcgatacagggaagaaaaagaaaaacccattaaaatttgcttaaaatctttaagaagccatttaaagcttcagaactgagtaatctttctgcccccttagtatattatggcacaggagagaaaacaaattacaggcaaccactctaccttgctttaacgtagggttaggattgcttgacatcttctgatcacattattgtgctgctgatacttgtcataaatgtagtgatgagattctggatgtaaaaatatttataatttcccatctcttgttatccctaaaaaattaatatttgtaatgggtctaaatccttctaaatcccattatttaatattgttctgcaatttgatgattaaagaattgttatttttttacctcctttatccttaaatccttcacccataatctcctgtttataattgcaggtgtctaatgattcataattagttaattcttggttggtgagtgattgtttcatattgcaattaggaagatcatgcataaagccatttctagttaaatgtgtgtatgttctttaccaggcttgtgttcaagagttctgtagttaccacgttatagtaatctctgaccttatttttgttaagcaaagacatctggttcaaagaccctctctcaccagcaagcggttctcattcaatctaagcatgttgaaaaaggccctttccctaaatgggcttgggagcaatactggggtcgtggctgtcctcagggtgtctgagcgcttctttggtagtctgcaggggaaaataccaacactggtaatgccccattcagatgcagtattctgtccaacaaggcacaattgcctgcctgggaataggaggctgagataccattgattgtttcctatgtcacttgtcaagtggaacacaacacaagtgaatgtctgcacaaaatgtactttgctatacctttctaacgggtttacatgagggaatggagctcaaacttcacaggatattctatgcagagtaggtcttaccctagggatgctcctgctgctctcactccacctgtcctccacccaccaaggcacagagactccagcaaatgtgaggaagagggtggggattggttgatgggcagagctggctctgtgaaagggggttaatctgaggcatcttacctcctgaagacttgggtgatgggagggagatgtttctggagcccagggcagctactgtggcattgagaccaccttagcctgggttggcatggaagactggaaatcttgcctttattcctgtcttgttcgttgtcctctgattgaatctctgcgttttagcccattgtcttcccaaagcttgattctcacctcttcctctcaactcctggcctctgtaataatggagaagccttgggcctggaatttggaggggaagaaagggaggttaagaatccttatctttttgctttcttcattatgtggcttcctcgatctttttgtacaacagtaagcaggcttttatgaactagtagatattaaaaaccacatcagtgccaactaaacaaattatatccaccagatacttttgagccctctggtgtgtgccaggcaatattctaggcatggagctctatcagtgggcagggggtacaggtggcagtaatatacagctgaccttatgttctcatcatggcaaagagacagtagagaattgcattatccatcagttagggataaaacaacaaatacccactgctgtttattatctctgtcctcttatttaagaaaggaactcttggccgggcgcggtggctcatgcctgtaatcccagcactttgggaggccgaggcaggcggatcacgaggtcaggagattgagaccatcctggctaacatagtgaaaccccatctctgctgaaaatacagaaattaccagggcatggtggtgggtgcctgtagtctcagctactggggcggctgaggcaggagaattgcttgaacccaggaggcggaggttgcagtgagccgagattgcgccactgcactccagcctggcaacagagtgagaccccatctaaaaaaaaagaaaaagaaaggaactctttgccttcttagagcaggagggaactgagttcttcatagagaacagatctaaattatagaagccattattattatttttcaccatttttcttattgtatcacagtccagttgtgggacattgtggatcactgcaggctgcacacaggcatttgggaggcatgacttctttctgggtactgtgcctttttaaagcctttggtgattttattcatacttgctttcattcaacaaatgttttccagcaccaactgaaggccagatgctatgggaggtgctggaaaggtattagagcctcatctcttcaggagttcgtgactcggtgcggggatgcaagagggattcagtgagggagacacaccccccgccccttacagtcctgttctgtgctgctgttggatgaaactgctctgcaggtcttaggaaccagccctggaaaccccacctcccatccccccacccccggtgcaggaagggaacttagtcttcattatgtgaccacccacttatgtagacttcccacatttccccccaaattagtccccaggagctgagtaaccttctctttgagtccttataacatttttatctgaaatgcaaaaacacatttgcttgaaacctccatgctagtttggcatgattttagaagttacctggcagaatgaatacaaaagaagcaaagaaatttaacatgaacttggcattttcttgctggcatgaacataattattggatgtcattataaataaaccttttaaaagtcactttaaaaatagaataattggctacattgcagagatcatgaaagatcatgaatatgtatataacagttaattaaaaaaaactgctaatattatttaaatgggtgattgtggcttgggaaaaatttttctgtggttcttaaaaagtcccgtgtcttaagcacttcagattgacgtaaaatgatgacgaaaatgggtcttggtgatgatggagacactcacgtcaaagggacatgtaaaaagttagtgtaaaatagttttatgaaatggagagtggacgaaactactttaatattcctatacatgaatattagataggcatgcataattaaattaataacgtgttttagtaggcacttggcttttatctgtatctataaaagtgtaaatacttgaggtggccaaaacttgacattttctcattgtaatgcaattcttatttaatccagagtcacctcactcatagggacagaaagcatttctatagagcgggattggtagaagaggggttcatggactacataagcctccagaaggccaggggatgtggtcaggctggtggaaggaaaagcactctgcagcttgttcttagagcaccaggtttattaaatatctaagtgggcatttttctaaacgagtgactttcttcatgatatgtgtgtgctgaattcaaactatacttggcaaagtaatgtgagttttcaggagatgggcttataatttttcatgcagcagagggagcatcagcttctcaagtggatgctgagaagttctgtgatgtttagagaatccagttagatggctcactgttttatgacattgaacctagttttgactgagtcacagaaattcatgccgggctcagacgctgatgctaacaggggcaggggagtggagtagaggggtgctgctttgtggacctatcttggggagaatattgggtagagtgttggtccccggagcctttagggtagattgtggtcctgcgggcacttccagaaaacagtcagcggctaacctggggtgggcgagggagactccttaaagttagaccacagtccccattctcaagaaacatcccccactcttgctgaagtgtccctgtgcagtttagggtagtagccaagccttgatgaggttactctgatgaaatgtaagtagcattgtagaactaggaattggcatcatttaggaccatttacccgaagtagaaccaaaataatttggtattaattggtcattaaatagataaggaaactttggctacaaatacacatcttggaattacatggggactctcaccctggacttcctttgtcatagctttatttttatacacaattgtattgatcaaattctagaccttacaagctccacagctgaattatttaattctctctgatgatcgtctcaattcattttccaataaatgtaattattttcttgccagcgttcgtatttaattgctaagttttctctgatttgctctaaatcatcttttacaaatgcgtagtgaaaggcagcaggttttctcttctgatggtggcaattataaatgtaattttatttaacttgataaccagttcgctgccaccaagggcctcatatttttctttatcatatgtttgggcacactgtgaaatcatcaaacaccaaaccttttataaattggatgtgcatgcttttgtccttttcgcttattattgtactgtttaccgtcgtcttctgtgacattttctcttgccttcagtcaattttggaagcaggcacattcttctgcaacaaaacaccatttttttcttgattgtaagcagagatgtcattcccgtgcttgtgttagatatacccttagaaattattaaaagctgtccagctgcctagtggttatgtgcatggtagatacctcaactgtgtttgtttcgtttgtcctggatatatgtctctgaactcttgcttttattgaaattaatctcttgtttctgttactgtctctgaaaataacaatgattatggtgctttttaagtaactcacaatgtgtttaaactatgtgggaaagagaatgtgaaaggtatgttatatttattttaatgttgcccctcaaaatgaactggaagccgggttttgggaggattccatttaaatgcatttatgctgaccttttcatgattctcatgtttaattgtattgcacttcagagtcacccagcctgaaagggacttagaatcccatggttgccagttggtgtatgactgcgcctccctcagtggtcaaaactgagattaaaaagaaagggaaagccctgtatttggaaggttatatccagaggagttcagcacccctcagagtctaaggggcttcctggtgatacggccccaccgctgcagagaaatgcccccagcctccctacttagtgcaccaggggtctggaaccctctctccctaacacccaagaccatccatagctcggtcactccccacagacttcacccgcagccatgccgcagccaccagcacctaacctccagactcctgaggaagctaggcggctcccctgtgtcacctcggctctgccatccttttccctgcccatacacatggagccctggacacggtggcccgcactgcccttgatggagtgccttgtccctggacccctcccgtgactcagctctgctcctgttggccttcttgtcttctgtctctggtcagcctcttttggtctctcctgtggactttgcttcttgcccctgttctctgtgtgtttcttgatgctctttcccatggccactccctggaggcccccacatctggattcagaccccctacccctcgggcctcttgcgcctcctccacctagccccttccttctttttttccttggcttctcctgtgcacccactttgtttccttccattctgctgttcactccagcctcaatctccactctcagtgacttactgcttccttctcctggggacctcaggaaaacggaggattctgacccccacacctaagataataggaaagagcctccctcccccaggagagggggctgcccctgcccactgcccctggccaagtccaggcttcaggctggctctgcctttccaggccatggatgatgtttgaatgaggccctgggcagggcgtggagatggagtgagccctcgagtcctgggtggtggatgctcttgtctccaggagagatgctgcccagtgctggcgtgtggacaccgtgccatttagtcttccccaactagcttttcctttggaggagaaaagattgtctgacttgtggcaatacttttagttccataactgtaaacttttctttctcttttttggtggcatttataaaaattccctgtcctacatatctgaccacatttttaaaacatttattagtttggatgttcatgtttaaatcacatgatgtaaaatgtttgttgagacacagctgaaggattgttgaaaagcaactgtagagaagcagcaggagcttgtttaaggggtgggaggtgtgggcggcagttctggacagtgattgctgttcgggacactgggatgcttctcctttctggcttcctgggattttttttcctgggcaggttctattaaaccttgcttaatgaaggcactggcactgatagtggcttgcatttggcaagacatggctgttcctgggtaccaggcagtggcaccggaactcattaagaaggtgactaatttcagggccgtgttaacatagactgaggctccatcatggttcccaggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatataacataaagttaatccttttaaccatcttaacacgaacaattcagtggcatggggtacatttacagtacatcaccactaggtagttctagatcatttccgtcaccccagaaggaaaccccacagccgttacagtcactctgtttcccccttcacactgcctggcaaccacgaatttgttttctgtctctacgattagcttcttctgcgtatttcatataaatggcactatagaatatgtggctttttttggtatatggcttcttttacttagtatattctcagggttcatccatgtgttggcaccccattactgttcatggctcggtagtattccattgtatggacagaccacaggtgtttatccatttatctctggatgcacacctggcttacttcaccttttggctgtagcgtatagagctgctatgagcattcctgtacaggcttctgtttgaacgtctatttggttttttttttttttttgagacggagtctcattctgttgcccaggctggagtgcagtagtgtgatctcggctcactgcaagctctgcctcctgggttcacaccattctcctgcctcagcctcccgagtagctgggactacaggtgcccgccaccgcacctggctaattttttttgcatttttagtagagacggggtttcaccatgttagccaggatggtctcgatctcctgacctcgcgatccgcccgacttggcctcccaaagtgctgggattacaggcgtgagccactgcgcccagcctgaacgtctatttttaattcttttgggtatacatcgaggagtgaaactgctgggtctgtttctgttgagttgactgaagaaaggatattcgttttattgctctatctacatggacctctcctgcattacttcagtgagttgtgaaggttggtctggatcgctttccctctttcctttttgaattgtgcctttagctgtaggttgaacacaggtgctatctttcacgttttcagatctctgagatcttcactggggatcaaggtccaaggaatcaaagctcatgctgtgtttgctcctgagcaggagagagcgttgtttagagggagggagaaggggaatgcttgaggtcagaatcacaggacagcaaatccgtcttgagatttcagaaatcaccataaatctgtgtcccttcccagagaagagcgtgtcaaaatgcagcattcgtaattgaagaaagcaaaatcagctgactaagtcgtaagacctaggatggtgaagagtctcagagtgaccaaaaacacacagaccctgttctcagggaagctcctgtgcaccgactgcatgctctatagacccctgccctgtgggggcccattcatgcttacagggtacatcctctgggagaaagcatgacaagttggtaccggggaacctgagggccgggatgaatttcaggataaaaagagcagacttagggatgctgccatagtatatcgtctagatttgtactgccctattgaaattcaaataaaatacagctaaatgttccatttctcagtcaccctacctgtatttcaagtgcctgatggacacctgtgcccagtggtgactgtactggccagagctgctgtagaatagtcccatcactgcggaaagttctgctggtcaggtctggctggaccgtagacacaggagtggccatagcagtagtgctgggagctgagaaggtgcccagtgcacagaggaggatgagctggatcggggaggagaggtcaggatttgatcctggaaaggtgtcattgtagtcctggctctgtcatcgctcagcaaggcatcgctcccgccacagggccccagcctccctgtgtgcccaccacgggcctggcactggccgccctctgtgccactcagggcaggagagtgagggttgtgccacacatgggtccgattgcttctccatggcgagaagaggacagacactgggaggaaaagttgaggaaccttgacatcccatgctgctctgtcatccaagtggctttttggttttctaggcattcttttttttttgagactgaggatcgagcagttctcctacctcagcctcccaagtagctgggacttggtacccaccaccacgcctggataatttttttgtatttttaatagagacagggtttcaccatgttgccaggctagtcttgaactcctgacttcaagtgatccgcctgcctcagtctcccaaggtgctgggattacaggcgtgagccaccgcgcccggcagacattcatttttattacaatttacaaaggtattggtcagaaacagaatgaaaatggaaggaaatcctagtctttccccaggtcatgggagaatccttgctttaagtgtctcatggggtggggtgatgtattcgtccctcagggctgctgtcacaatacaaacgaggggcttcaaacaacatcagtgtgttctctcattgttctggaggccagaagtccaagagcaaggcatcaccagggccgtgccctctctgaaggctctagaaggctgtagggcagaatccttcctggtctcttccagcgtccagggctgctggcagtcctcgatgtgctgtggtttgtggctacatcatgctcgtgtctgcctctgccttcctgtggtgtgtgcagctttgcatctgaatctccctctccttttttctttctttctttctttcttttctttctttctttctttcttcttttttttttttttttttttggagacagggtctcgctctgtcatcccggctaaagtgcagtggcgtgatctcggctcactgcaacttccaccttccaggctcaagtaatcctcctacctcagcctcccgagtagctgggaccacaggcatccaggctggagtgcagtggcatgatctcagcttactgcaaacctccaccttccagggtcaagtaatcgtcctacctcagcctcccaagtagctgggatcacagacgcgtgccattgcgcccacctaatattttgtatttttggtagagactgggtttcgctatgttgccttggctggtcttgaactcctgagctcaagcgatcctcctgcctcagccttccaaagtgctgggattacaggtgtgagccatcgcacccatggcctttttttttttcttataaagatagtcatcattggatttagggcccactgtaattctaattggagtttatctgcaaagattctgtttctaagttcatttgtattcacaggcaccagaatgtcctagtccattttgtgctgctataacaaaatacctgagactcggtaaaatacctgagtaatttataatgaacagcagtttactggcttgcagttctggaggctggcaagtccaaggtcaaggtgctagcattaagggccttcttgcctggtcatcccatggcagaaggtgagagtgtgagagaggatgagagggtgccaaactctcccttttacaatgacccagtcctccctatgtggctgagtcctcatggcctaatcacattattcctaaagttcctacctctttgcctgcctgtagtcccagctacatgggaggctgaggtgggagtatcacttgtccccaggaggtagaggctgcagtgagttgtgatcattccgcagcactccagcctgggcgacggagtgagaacctgtctcaaaaacagaaaaacaaacaaaaaatcccacatcttaataactgttacaatgtcaatgtcgattaaatttcaacttgaattttggaggggacagatatttaaatgatattacacaggttaggtcttgaaatttttttggcagggtcacaattccatgcactgcatatgggagtggaaggggtatgcctgcgggtggggagccaggggcttgagctccactctgcattcactttttgctctaccccaaagccttcccttcccctgtcctgctccctctacctgtgagtgtctgtgtaccctggccatcctcgatggcagtgagtctgagtattggtagggtgggctagagcctgggacagcgaggcagctggagggtggttgagggtggacgggtgcacgctggacaggcagaatattctgcgccattttgcctcgttcctgcatctttcttcctctgctgtcctgcacacacttatcttctacccacttctgttcccgaagggctccattttgtcagattattcagaccatgaataaaacacaagtgtgatgtgcttcattccccactcactgtttgcaaaactattttcctgcagttcagacccttaagatactgtggaactggaccgttttcctgtctgtcgacttctgaattttaagtgtttttcagaaagtctccatcatttggaagtcacgctttgcctcctggaagctgtctagacaggtgaccagttttcaccaatttgggggctatggaggcctcttccaaggctctctgccctctccatgagccactttagctagatgactgtgctggtatcaagtgaaaaaacaaaaagaatacttcagtaatttaattcaaatttgttcttgcctagattacggtaatgctcctatttagaatgacttaattcctggcaagtggattgtgggaggttaaggagagcaccctggctccagagcagagagcagaagagggtgttcttgctgtctgtgctgaggttggctaagtctttctctttttcacgcctcgtgctttttgctacgtggtttctgctgcctagctagtcatctgcaaggcatcactgtagccctatcctgatgccctgagtcctggtagcttctactctgacccttcctgttcttttatagattattccatccttgaccacattttcttctgttctcctgtgtgcctagctttggggaaataaggatgagtcaggtgcaggcttcggttgctcatttgaacagtgattctgactactgttagagaagggatatgggagagaagtgcaggggatttacttagccaaggctgaaggcagagaaaacggtcattgctgcatggcacagctacctgtggccagagaggagccatggcccagctcttgctgggctgacccaaaggccgaggaattttgtgtgccaggcacccatctgtgacacaaccacgtgggccaggaagctgtgtgtgtgtgtgtgtgtgtgtgtgtgtgagcaattaatggacaggatccagagatgctgagagcagtcctgcacagtgaagacagtatcaatatccctctccctgagaaacccaggagacccgttcctcatcatcgatatgcttcaaggaaggcataacaaattgatttgtgtaggaacttgaactggattcactgaagaatctcaggaagtttgtacttttttcagtttgggctttgtgatacagaaacacgcagatacttgtgggaacaacgtccctcaggcgttaaattgacatttgggattgagtgaaccgaagcattggtggtagagatggggaatgctatctgaaaaaccagaatcagctttaaggaagctgattacaaagagaattgattacaaaaagtatttttggatttaaaatacataagatgtaggcagtcctaatttaataagatataagggattgaagcaattgttgccatcgtctttctttttgttctggactgctgtcacacacaccatagagatgcctccttgagtgtcttcaaagtgctgtggatttcctttcttcagccgcctccgaccatcacgtccagccatctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattcaagaaaaacttattttgtatcacccataactcttctaatcttatataaagatatgctaatggatttaattaaaataattatactgaataatgtagcctgaactttattctaaaatagcatctattaatcatcatcatcagtaatatttttagccagagagacacttacaaccttaagctgatactagatggaaagtgcatttattgttttatttttcagtttggattaagttggcattctcatgagatctgggacaattacatttgcttagagacgagtataaaatttatttctgggccgggcatggtggctcacccctgtaatctcagcactttgggaggccaagacaggtggatcacgaggtcaggagttcaacaccagcctggccaacatggtgaaaccccgtctctactaaaaatacaaaaattagctgggcatggtggcacacacctgtaattctagctactcaggaggctgagacaggagaattgcttgaacctgggaggtggaggttgcagtgagccaagattacaccattacactccagcctgggcaacagagtgagactctatctcagaaaggagaaaaaaaaaattattttatttctttaacctgaagtatttcagcaattagaaaacttttagcctcttctgccctttcctgtttcttcttttccctctaaagctttggtttcagtgtgttcttgtccttttggttcagttttgacctcagtttccctcccaagagttgtgattgctgaatacgatgagttcctgattgcctggatattaagaggtgaaccaaatcttaagagggacactcagcagcctgcctgtcttaatataaatagaaatagttttaccactggctgtgattctctctgattttgtttgtgttatctttctgtggcttgctggctttccatcagtgctcaatgaatggttgggagcccttatgcatttggtggtaatttcagtttctccttaggcctctctcatgcctgagtgtgcatgggacccaggtatgtgttcttggtgtgtcagtgggtcctgcacacgtgttgattggtccgaggactaaatgcaggtagaatcagaccgtccccccactggtggacagacgaaagctttaccaagttgatagaataacataagccaggacttaaactgccattaagttattttacctaagtttaaaataaaatctgaagaaattacttgcttaaatagcaaacatttatttggtaagttcacttataacttaatgaacaggcgaagagtaaagaaagctaaaatcagtgacttcctctaaattgtgtatagagtactcttctctgttcttggctgggccaggccataatggtgtattcgtacagtttcatggtccatggttcatacctctggggttggggagcataagtgggcctcactccaaacgcagctctgtcttttggggacatcccacggactttgtcctccttcccactttcgtccctcacccccagtgaactgattagtgattatcccgctctgctgcagggaaccttgccagtgcctgggaggcaccgtggagcagatacctgctgagggactggcatcctggcctctcacccacaattcaaaacagctttgcacattctgagcacagttttatttaaataaagatcttcactgatttacaaaaataacaaaaggcaaacaaaaacaggaaaaatcttcaatgtcctcaatttctatcaccctgatcttttttgtgatttgggaactgattctactcagtatttgccacaatgaagatggcactttacaaatggaagtttgcaccgaatgaagattcaggtttgagagatgtgcacgctgaggaggttttccatgtcaacacgtgcatgggtccacacgctgtcctgccgccactgctgctggtagctgtggccaacgtctgttgagcaggagcaatgagtcgagcttatcacatgcacaacacgtcattccattctcccacagccccttgaggcaggccctgttgatcaccactgttttgcccatgagaagcccgataggaaatgctaccttcccaaattcacatagcgagtgatggaggagcccggacagcaccccagagccctgaccttgtctaccatggtgctgccttcctttgatggtgctggttagggtcccccacatgcattcatagatttttatttttggaggtgtctttcggcagataagattccacgcagcaccatctatccacagggcagatgtcccctgcttcgtctgttgggtgctctgtgtcttgacaagctattgaggcaggagctgtttccactcgaaagagacctgaatttagtgaagcagccagactccacagaggaaactgaaggtttttcctgcaagcacaagcagaatccaaaacacttgaaactctgacaaataaccaatattagaaatgaatcaagctaggtgtggctcttacaatagtgggtaatggaaccctcctgccaaggaaagccagagcctgtggtaggaaggaatctgagttccctttgcatcttgtccttgtctggctaatcaaactggatggggaagacaactttttcccttagttaaggaggtgatttctgtggctgaatgcagagagaggaatgcttcttgaaaataaagaggtcacgactatatatgaagtttgcagtcagtttgggagtcatggagggtcgacttcccaatgtcctctgtgaggacagaaggagacaaagcagactgaaatagtctctgtccttacctgtgaggagcttattgtctatggggaatacggacaaattgaccttccattgcagtccaaataggaatgtctctagatgctgtattcatctcttttgcgttgctataaaggatacccaagcctgggtaacttatagagaaaagaggtttattttggccccggttctgcagggtgcacaggaagcatagtgcagtcatctgcttctggtgagggcttccagaagcttctgctcatgacagaaggtgaagggggagcaggcgtgtcacatggcaagagagggaacaagagagagcgcagggaggtgccattgtcttaaaccgccagctctcacgtgaactaatagagcgggaactcactggttactgcgaggaaggtatcaagccattcatctgaaaccctcccctatgacccagacacctcccactgtccccacctccaacactggggatcacgtttcagcatgagagatggagaggacacacatccaaaccatatctgattcctaacctggcacctgtgtgtcctggacgaaatgatgtctaagctaaggactgaggggtaccagagtctaactgtgtgtttggggtggacttgggtggggcggcagagcagtgactccagaagagggaatagcatgtgctcaagcctctgagctggcagaggggcctggcccacctgggaaactggaagaggctcggcttggtgggagagagtcctgcaggtaccaagggtgagtctggggtggtggggccagagcccatggccctccatgggtgtgggataggttccctgtgtcccatgagcaggggacgttgccacagtatctaaattccatttgcattttcagaaggctgctctggctgcccagtgaggagtgtccttgaggggtcagcgtggaggcagggagggcgggtaggaggctgtggcagcaaagccaatgggaggcagtagccgtgcggcccaggtgctgtttgttccggggggagttaacagcctgaaccgagggctctgtcgctgcctagaagggggctgtgaggaagagagaacacccggtgtgatgcccaggcctgtggcatgcagctggggcttggcggtgcagcgcctggcactggaatccctagggaaggcgaggcagcggtggcttccaccaaggcagggggagtttgcaatgtctagggtcagccagggtggaccccggtgggtgtggggtgtgggtgttgggctcaggaggaaggggagccctggagatggatcagaattgggagtcattggcatggcaggaggtgaggtcccttgtgggatatgtggagggaccccgaggaacccacaggcaaggggctgggggagcagggccctgcgcagggagctggaaggagggtggagaggcaggtggccaccctgggagtgagggccacgcgtgccccagaggtgaggtggccaaagtgtcatcagaaaggccacttgagaacagcctgaagtcatcgtggccttggcaggaacagagctgtggtgcgggccggagtcaggctgcagtgggagtgaggaggggtcgtgtgggaagtggacgcaggccttgcccacactgtggggtattgtccgatggagcagaggctcgcagggcctggggctgcttttccgggtgagaggctggtgtgggcttcatgatagaaagcaggaggcagaggggtgagaactgaaggctctgaggagagagagaggacaaagggcaggagggccttgagcagacagcaggggaagaggttggagccccacagggcaggcaggtgccccgaaaacccaaggcaggggcagaggttgggagctggagtcttgtgtttggtttgggtggttggaagcttagcgagttcctttcttgtgggggcttttgtttttctctgaaggaggtggtgacatgagatgggaggggtgggggtcaggcttgagaagagcaaagaaagactgagtcagccacaggggagagtggagaaggagaggaaacccggcccttcaggagaacaggtggacccacagtgtaagacgtgcctctcctcatgtttcttctgaattccgttctctctgtcctgtctttgttctgtcacccaggactgatagcagatgcgggttcctcccagttcttgctaaacctcatttaccgaaagacacaaaatcatcttggtcggttaagcagaattctggtttaatcagcattttgggatcactggcattccatgtccccgcctcagggggcacaaccccttctctgagggtgtcatcatgacatttttgatgctaggagctcgggaagaccacggcagggaagactttgggagccctcgccccgcttggcggtctgtcggtcccgattcacacagtgtccggcagcccaaggggagccagcagcaggtgggccataaaggcctgtcttgtttgtggccgattcaccctggtgaaatggtatttatgaacttgctacaggcggttgatgctttgctgggcacagtataaaatgcatgaagccagttcgtgcctcaccctctgggcgttcgcaagcgaaacgagagaccgggagactgagcaatcagcctgtgtgaacgctggctattaaatgtcacaataaatgttttctgttttttttcaaagcaacactgaggttgtggaagcagaacatttgaaatcagaatgaaattattacgatttagtgctcttttgaaaagttgcatcccaaagcagacggttgggatctggtgggccttgaaggacagggcaaacactgaggtgaacaacagcatggatcgttctggagtggagatttatggggctaaagttgctttatcctctactctatttttggtgaagttgaagtgtggcggttttgcaaaattagctttggggctgcacagaccaaccccaaatcccagcagtgctgacctgggccaaagacttcactttcacatgtctccactgtctcctccgtgaaaggggatagtaataggcctccttcatcaggttgccatggggatgtaatgtgtccatagagcccagcacctagaaacttgtctgacaggtgcagaatacttacgtcatagatgaggcaacatgaactcacttgaaatgacttgacctgtgcaccagagttgagacaccagcctgccattctttcagtcatttcccatcccagatagctatggaaatattcccaggtaatatattcttagtcacttaaaaaattaaggtataggctggacacagtggctcacacctgtaatcccagcactttgggaggccgaggtgggtggatcacttgaggtcaggagtttggtttgggtgttgaccagcctggccaacatggcgaaacctcgtctctactaaaaatacaaaaattagccgggtgtggtggcgggcacctgtactcccagctattcaggagactgaggcagaagaatcacgtgaacccggggggtggaagttgtagtgagccaagattgtgccactgcactccagcccaggcggaagagtgaaactcagtctcaaaaaaaaaggtacaatttacatacagtaaaatttattcttttttaatgtacagctctgccagttttgacaaaggcataatgcattcatcccacgggagggcccctgagccccctgtattcccctgcccgcttccccaccagccactgacatgctctccatttctgtagttttgccttttccagaatgttatgaaaattgagtcacatgggatgcagcctcttgcatatgtcttgttttatttatcactgtgtcgttcacgtgcatctgtgttctaggtaacagtggttggtgcttcttgttactgcgtcgagttccattgtatgaattcccctcttgaagggacatttgggttgtttctagtgtttggagattacaaataaagctgctagagacgtccacataagggttttgtaaccgtcataggtttcctgtcccatgtacgtgccaagtcaatgtgctgcgactctgggttgcagcagagaaagagttttaatcgtaggaccgccaaaacaggagaaggaggaaacctcatattgtctgctgcaggagtttggggctaggtattgttaaggttttcggagcaggcctaagtgggttgaagagcgtggggtgaagggacagggagatgaagaaactgcattgcattgctgattcctttcctctgtcgggggttttcaaaccagttggcagcagcagtttccctggaattcaggatctgagaaacaccttaagcaattcttaaacaaaagacttatgattctaatgtcagaaatcctatctgcaggaacgttggggatgcagatgaccagtatctagtgctgcgtgactttggattacgagtaagtgggctgaagtgcagcctgttccgtgcttaattatcactgtattgctgtccagagttcttgttaaccttatgaggatgccttcagtttttgtgaatgtaggttttcacttcatttgaggaggtggccaggagtacaatggctgggtgctacggattatgaatgtttacctatgagaaactgctgaactctcttctaaagttgctgaactatttttgcattcagactagcagtgttatacaaagagcatgttgtaggaattctgttttgttttcatgattcttatagatgttgcttgtatcttattgtcattttaatttgcatttccctgatgagtaatggtgctgagtgtcttttcaagtacttatttgccatccatctatcttctatggagaattgcctcttcatctcttttgcccattttgcagggaggggaagattgttttctcattattgagttttaagggttctttgtgtattctgtgtactaatctttagcagatatatgatctccagtcattttctccctgtgtagttcatcttctgttatctcagtagtacctttcaaagagcagaaattctttattttgatgaagtccaatttatcaattttttcttttacacattgtgctatttgtatcatatctaagaaatctttgcttagcccaaactcacacgtattttcttccaaaagttttacagtttttgaagttctacatttaagatcggtgatctatttaaagttgagttttgtacagtgtgagagaggagggcatgaagtttatttatttgctcatggtactgtgtacctttgttacaaatccatcaaccgtctgtatatgttcaggggaatacttttgaagtgagtttctgcctacttgcttttggagaacaattgtaaaaattgtttctgtaattgcgtagtattttccagtgttcaaagtgttaccctattcattttccaatttgattttgagctttattgcaattccttgaagtatctggcgtgaatgttattttccctcttacttaaagacacaggtagaaggtggcagagccagagtcagatcacttaaaatctggcaacttttcccaacagaagagagcaaagggactcagggtctgactttcccccgactgaatttaattctagcttagttcagtactagctttgtgaacagggacaaagtaattaatgtctccattgttggttttttcctccttcctactcagctaccttctaataggaggtgatatggtttggctgtgtccccacccaaatctcatcttgaattgtagctctgataatccccatgtgctgtgggaggggacctgtgggaggtaattgaatcatgagcagcaggtttttcctgtgccgttctcatgatggtgaataagcctcctgagatctgatggttttataaggcgcaattcccttgcacaaactttgttgcctgctgccatgtaagatgtgcttttgctcctccttcaccttccaccatgattatgaggccttcccagccatgtggaactgtgagcccattaaacctctttcctttataaattacccagtctcaggtatttcttcatagtaggatgaaaatggactaatacaggaggtctgtaagaattaaagatcaaatatacaagggtcctagcacagtgtgcagcatgacaggatctatcattaatatcattactctgttttttgagggtgtttgttttctagaagatacattactaaagaacaaaatgattcataattaaaatatatgcagatatacaggaaaacatttttggaatggaacaaagacagttgactttaatcattgaatgtagaagagttgaagtgaatttaatggaagaggattattctgagggggacaggtcttcattttgctttatcctcacagagctctgcaggggtaaaaggagaaaatcacatgcatgcttagcacacagtataggcacttaggccacaggtgataagtgttggcttctgttaataataattttattatgtgtcaggacaacctgtgagaagttagcattgtttgagcattctttgtaggttagagattcattttcttttttgagacaggatcttgctttgttgccggggctggattgccatgctgtgaacacggctcactgcaacctctacttcctgggctcaggtgattctcctgcctcagcctcctgaatagctgggactacaggtgcaagccaccaatgcctggctaattttttttgtatatttttgtaaaggtggaatttcgccatgttacccaggctggtctcgaactcctgagctgaagcgatctgcctgcctcagcctcccaaagtgctgggattacaggtgtgagccactgcgcctgatgacttttgttctttgctctattttcatcgtgttagccgtcagcccctcatctggaagtgatctttctcttctcagtatttctgcggttcttctcataaggattacaaattggtatgaacactccctaacctgcatgctgctcagccttcttgtttcttgatttgcagggggcagcactgaaatacttaccaacgatcgtcaacgatgtgaaattggtgtttgatcccaaagagctcaggtaagtatgcagcccaggcgaatgcttgtcacgtgccgtgtgtgacctccttctcagtgtgcttagtttatgggatgctcagggttctgcctcatgtctccatatgtcagtgccctggatcattctggaacatgtgttgctggtggtgtctgtgactctttgataatcatgacattatgtggaaaaggtatcaccagtcaactatgacaacattttttaagaagattgtttacagtctaattggtatataatgtccatttggcattttgcatactttgaggtttgaatttcagtatgtggttgttggttttgctcttgttttcagcacctaaaaatcctgacataggagctttaatattcctgcgccggcttctgcttctgtaatagaggcaactcctctttgggaggggccctgagcctcaagcagaagactcagaagttactaagaaaataatttttagaaaaccccacaaacaaactttgagaaagctggtcactgggctttcagaccaaggagtgagattggacaccaaatccttccttttctctccctaacttgccgcctctcagtggccaggtgtgctgtttgtttcctaatctgttggtatcactgcattctgaaagtgccattgtgagcaaatgggatacacagcctttttaatttattttttaagagataggggtctcactctgttgcccaggctgtagtgcagtggcgcgatcatagctcactgcagcttcaaactcctggcctcaagcacccctcccgcctctgccttcaaagcactggaattaccgacgtgcgccaccgctcccaccccagggatgcacagtcgtttaaaccccagacattcaatagcacagtcctcaactactttttgttttggttttgatttgacacaataaactacctgtgggtgaagacaccattttttaccggccaatgaagccctcctaaatattagtaaagggccatctgtccactgagcggtgaaacggaataaaaaatgattatccttcctgtactttatgtctaccataggtcactcgtgccctggaattgaagggcgaggggctctctgggaggcgctgtcccccacgaatcattgtgaatctgatgttccctaggatttagtgtcctgcagggaaacatttattttctgctcccagggcaccaacagtgctggtcataagcttagcaggtcctacatgagaaaaggagaaacacacaggctcacgggcggtgtctgcccacctggcgcgctgtagagtcctctccttggcacatgcttctccaagagcgggccccaaaatggcagctccggtagcccttgggaacttgttagagaaagccaaactttggcttcctccccagaccttctgaattagaaactgcacagtggggcctggtcatttgattttaacaacctccctccccgtgcaggtgcttccagggctctctcatattttagtagctcaggtcttgaaaaactgagaggaagcagagaaagctgcaactggtgtgggctgtggccatactctaggcctgtctcatggtgcacacagatcagctccgcacccgcggaggggtatcgtcgatactctcagtttgcgcttgagccgggcctgtcctcactgtacgcacaaattagcccctcaccgatggagggtatcattgacgctcacagtttgtggttgagccgtgtgcttggaggtcctaggaagacctgcttggccagggccgatgcaggctgctgctggcctctctcagatttgtgcatccctgtgttcctcctcaatgcctgttacactgatttttaaaaatgacattgaaaatcacatacatatttgtttctatttagaaaattggttcatgttttaataaacagaagagatgacagaagagggtaactcaaacttaagtccactacccaaaagaatcagaaagtgctggatcccttacacacatacgtacacacacacttaaaaaagtcaccattttttggttaggcatggtgactcacgcctgtaatcccagcactttgggaggccgagggggacagatcatgaggtcaggaattcgagaccaacctggccagcatggtgaaactccatctccactaaagatacaaaaaattagctgggcatgatggcgggtgcctgtaatcccagctactcaggaggctgaggcaggagaattgtttgaacccagaggcagaaattgcagtgagcctggatcgcggcattgtactccagcctgggtgacagggcaagactctgtctcaaaaataaaaaaaagaaaagtcaccattctttgtgatcagctcctgcacttaagacatcttcctctcccatgccacgagggcatcttctgcatcatcattgttagtaactttcatgccgatccatcccatgctggcctatctttaagcagcaacaatagacgcagcatctattatgtgctttcaccatgtaaaataggttttgcacaaagcacttgtattagtccattaatctttacaacaatggtatgacataggttctattgttagccgaattttatcctcaataacttgtccatgataattcagctggtaaatggcagtggttcaaggccaacccgggctttttgaatacaaagaacaggcctctagctactgtgctacctgatggctgttgagttgtattcaagtttttttaaaaaaaatatattataaaatgctaggataaaatttcctgtagcttaattgtagtttctgctcctattttatatcattaggataaaaagagaaatggcattacttggttttgcattttcttaaaggattttcagtagattttatctactcgtccccctccagaaggtaaaaccaacattctaccagtatacgttggtgtctgttttcccaaaatattgctggtactgggaattaccattttatagaaccttgccagtatgactggtgaaaccgtatctgcccattttaatttgtgtttatgtagttactaacaagagctcttctaaaatttcttcataggtctgttagccttttgtaaaagtgtatttttaaaaaattgctttattgtggtattatttacaaacgataaagtcacctattgtagacggttcaattcagtggtttttagtatatttacgaagatgtgcagtgatcaccagagtccaattttagaacatttttataaccccagcaagatcccagtgtccatttctggtcatttttccttcctagcccaggtaaccccgaatctcttttctctctctacacatttgtgttttctgggcattttacagagctggaatcatacaacgtgtggcctctgtactggcttcttctacttagcataaagttttcaaggtttctccatgttttagcatcagtgcctccttgtttttggaaatgaattgtgtggctatactgcattttgttcatccattcattaactgatggacttcgtgttttttttactttttcagtataatgaacaatgccacttggattcatggacaaattgttgtgtggatatatgttttcattttttctcggggaggtggtatatgcctggaagtggatggtgactatgtttgacattttgaggaaatgcctaactgttttccaaagtggctgtgctgtgttaccttcccaccagcttggtgtgactgttctcatttcattatatctttaccaacacttgttattgtctgtcttttggattataggcacgttagtgattgtgaagtgaaaacgaacactttcaaaacatcatttcttggaatgagttattgaccccatagtgcatgagaggctgtgttgaacatactggtgacattaatgaccatgtgatgacctatatctcagtattgtaacaacattggatccttttgctatgtgtctcaaaattatttcccttgtgtttttcctcacagcaaaatgtttactgaattcatcctcaatgttcccatgggcttgctgaccatccagaaactctactgcttgatcgaaatcgtccacagtgacctcttcacacagcatggtgagtggaaccccaagaattattcacttgtcctgttatttattttctgaagacattgaccctctgaattgcctcttcttgacaaaaggagtagaggctgcaaccaattaaaactgctgtattacaagacaggaagatttagcccttacaagagaagggtaattgacatgtaatgcaggtaatagatcattgagaaatgaaggcaaaagctcgtagtttgtaatttaggtatacaccaaagtcctagggtaatcagcatacattgtagcctttaagatatgtggttgtctgtcctggggaggcaatcacttcgctccattgtgatgattgcaaggaaaagaattcgagttttctttaaatctgaaagtaatggttttatcttattctgaactttgcattctttgacagcatttcttcaaatcctactcaaagtaataagaatttcaatgattcttcaactcatttatcctgcagaacactttatatttccctatgttatctccctgccctttttagtaatcattttttttctatttggacagattaaattaatattttacccttgtcaagcagttttattgaaagcttaaaacctctgcataattccacaaacttcctcatttattggaggcaaatgtgaagtctgttgagtgacattctgactgagaagcatggatttattcgattccatttgtgcctggacatttggctgctccattcattttctgttgtcctcattcttggtgttgttctcagttcccctgtgctttcacggatcccagacttgggatgtccctgttaagttacgggctgggtttggaacacactctgtgcttggcttggtcctttgtgccttctgggatgcgaattttaatcttctttcttggcttaaccttataaaatgcaccagagtgtacacgtgttgctaaggctaatattgaaagaaaatgttgacttcatttaggtgagagtgttcttctctagaaaaaaacacatcaaaccaagaagtgggtgactttctgcagcccctccatgtagacctctctctttagtcagaaaccacttcttactttcataaaagaaagtcagttctcaccatggtctgggactcaaagcacatgacgctccattgagctattattcctgactgtccatatttcagtttctcactggaaactgaattgcccactcaccaggtgttttccaagacttgggtactctagggggcttaaggaaaggctgatgatagaggtgatggccaggcaccctgcttcagggtttcctcctacagtgaataagctttgtaccacagcaagtaaaatcctccgaaaattttatatctgggtcttattaggtgggttactgatgctcctaaccattcaatgccaagacacacacagcgacatactgcatcaccagcactaccgtcatcagtatcttcatcaaattaacagctgtcaatgagtgtcaaccgtccatgaataacaattgttgtaaattgtcgatgaattgtgcttgatttttcttaagtgttgatttaacgaagatcttcttcaggatatatttacatatatttttaaatttctgttgcaaaactttgttctgtatgtcatttagtttctttgaataaggatgtaagccatgaaagattcaattagatttttttttttttttcgagacatagtcctgcgctgttgccgaggctggagtgcaatggcacaatctcagctccctgcaacctccgcctcccgggttcaaatgattctcctgcctcagcctcctgagtagctgggattataggcacccaccaccatgcctagctaatttctgtatttttagtagagatggggtttcaccatgttggtcaggctggtctcaaactaccgacctcaaatgatccacccgcctcggcctcccagagtgctgggattacaggcgtgagccaccgagcctgaccccagatattttttcctctattaaaacttgctcatttctttaggtcgtagaaagcttgaaggaaacttactgtttatattcgacgattttgttagcttaggtgtttgtaattgtgttctgtccctctttcctatgccccatttctgtttcattcttgttctctaagccttttatcttagacagcctgaagtcctgttttggaagtatgcaggatgtgaataactgcttagctttgtttaatatggaattaccaggtcatgtaatattttgaaataattaacctgctgtcatctttttaagtacggaattaggattttgatcttagtataagcaagttgtacccaatgtagtaaatgaggttgtatgaaatatatgaatcccaaattattgtgggctaaatgaaccaaaattagcccgaagcttcgtgtcttacaagcagccccagaattgccccatcagtagaagttgtctaagctgtaactggcagctcaaatgtacttctaaatgcttagtggttgcctagaagcatttcggaatgctttggccaacgtgaaaatggtcccatttactgtctttgagttttaagcgtttttcttaaaacaacctgtttttctcatctgcaagctctctgcttgttcaaagcagccaacagacatcttacctcctggtcaggagagatttatcaccagaaatcttccagttggtccattcttacaaaagatgtcattacttttgcaaaatattctgtgccacctttggtataacaatttaaagccaaactgttttctgatgagacatgttgaatctgattttcatgcttttttcctgtttcttgttaatttgtacaaatgtggttgtttttgtcctgtttcctgatcccagtggaatcagtcaaatgaactctctttgtgttcagatttctagaacttggtataactggatttagctgcatgtgccactgaatgcacttgcccttagtaaacatcctctggaggatgtgttcagaatgtgtcactgtatgtgtcctccaggctccttcgtgggggctccctgggtgaagtgagattcccaagtctttgcttctcagcttgtgtgttgccttactcactgaaagagacccactggttgctttgcactaaaacatttctttttatctccgcctgatataatgacaagtggatctgtttgcaagaggctggcagtgaattctgaaactggtgttgttcctctgcagaaaagcctttcgttgccaggtctgggtcccagtaggccaggccttacagtgccttggttgtttctggccttgttttccccatttctctctcttggagaacatggaaaccgtaggtgcatcctgagtttgttgggcttcataggaggcacgtctttgggcttgtcaaagcaagacaactctgtgtggtccagtccatgtgggactggcctgaatgaggacaccaggcctgcgtcactgcggccatttgctcacagagcattcagccttcctctgcccttctgttctatccaggccctcaaggattagatgatggccacccacactctgcaggatggacatgcttgactcagtcccccaatcccaatgctaatctctgctggaaacatccttacagacacactcagaaataatgttcagccagctctctgggcatccgtggtgcagtcatttggcatttaaaattaaccatcacagagtatttcttccaagaggcctgtgattgccctgcttaaaaagccccctacatgccacctcatggctcctcatggcacgccccccatgtggaatcattgtatttcttacttgcttatttgtaggccttccataggatgagaactttccaagctgggccttgttcatctagattttgctcttctgctggtacctagcgcatgcctggcttcagcatgcctgtaatggatatttattgaatgaatgaaatgcttatgggtattcctaaccaggaggcagtacagagaaagaagcaggaccagctacacacatgtgtagttgacttgattgaagggaggtaaaggtttggattcacatggggaaattggcaatctttccttgtcttagcattgaatgaattgatcataggggagaaaggagaggtcttagaggaggagtaacatcaggagcaaagggagagggagaagagtgagagacttgaggtgtgaagagtcttctctgagcagttttataaaatcaagatgctcttctatttgcatctgatctaatcattcctgttttctggaaataggaggggggtgcagttcagatctgtgcattcaagataccttttggctataccttttggctaaaactatggaaaatttcaaatatacaggagggcagagagaagagagtaatgcatgccagtgtactcatcactcagctccacaaattatcaactcatgatccttttttttctttcttttttttttttttttgagatggagtcttgctttgttgtcaggctggagtgcagtggcacgaacttggctcactgcaacctgtgcctcccgggttcaatcgattctcctgcctcagcctcctgagtagctggtactacaggcgcatgccactacactcagctaatttttgtattttcagtagagacgcggtttcaccgtgttggctgggatggtcttgatctcttgacctcgtgatccaccctcctcagcctcccatagtgctggggttacaggcatgagccaccacgcccggccagtccatcttttcttatctatatgcccgtcccccagatattttgaggcaaatctctgccatcacagcattccattttttgtcattttaaatgtatggtggtaatacagagggcaaacagtgttcctaagaagaggttgtgcagaggagctgatccccatgctgataaggcatccaccttggatgttcccacccctggccctttgctgaggtagagggcctgtgatgcattagcatactgtgtgtgagtcagtgaatgggcagtgtgtgtgagagtcaataggctgtgatggctttaagctttgtctcgccatgtgacttgactacttgaaagctggttgatagattacatgcttcaccaaaagatgactcttgcatataatctgtggtgtggagtgagcagattttcaaagcaagatagatacaaagagaaggaaaagtcaaagcttcatcatttgtgcatttgtagctttgtttccatgtgattatattgttgcccacatagctgacaaaagctgtgaaaattaaagcttaaatcttatagaaatgaaaagttttagtgtaattaaacactagaacactgacgtttaggatttaagctcacaaaattgtgtaacattaatgttatagaaattggaataaaatgaatcaagctgagctaacattgacttttaagttagtaaagagcattggctatacttgtaagaagcctttgagtggaggtgagagtcctcctggaacatgttctctcacccactggcccctttctgaatctgacagctttgggaagcttgtttcaatgaacactgggtcacttatttgctttgcaaggtataatttttccatattcccatttctatagtggccaaagcagtggacaggttttctttggagcttactgtgtacttatcattttgtcctcacttagtttgttttggatgggagtatgagactttgagagtaaattttagtggtaaggctacccctttttggtcttgcaaatagttggatactctagatagattgcttttctgtaagcctgctctgtgtagttttctgtttgtctgtttgttgtttttctggtggttggactctggcagtgagtaggaatgggaaagaggccattccctcataccctggctctcctggggctcctcccttcactatagcaaacaggctccttgtagacagtgttcatgagtcttttcaaacttcatttgctttcatttttgagcttcttgaaagtgtaagcctgttaagtttaaattattttccttattcttattttcaaggtgaatgattcttctagttatcaagcagagtaaaactctcctttttaatggtggaaacattagttacagcagccctttgaaatctgagggcaaaatcccagacacttactgggactagctattaggaaatattgaagtcagatttctacactattatcattgtgatttgatccatgatagaaatttatatctcaaaaattaccctattaataaacttattatgccttaaattatagaaaagttgcgtgtttaaaacaaacccataatataccttcttaatgttttgataaaagcatttttgattaaaaaaaccaaaataaaatctcttgagctttactattgtggaaaatagaaatatatcgaaagggatcttaaacctggagctactctgcagtagttttgttaacttgatagatgttgtgcagaaggaaaaattggggttggggtcaattttgccacattcacttaatgtaccactcatatagcattctgcagtactttaattagatagttgtgctgatgacttctgatgaacggtaccagctgtgaaccctgaagactgattcttttaaataatggtggaatgtaaacatcattttctcttctgtttctttcatgccttgagaaaactttttatctgtaatactgcacctttttcatccctcattctgtatatcattctctgtctttcattatatatgtttttgaaaagaccatttgttataacactgcaggattttagaaatgacttattgaatgtaggagggtgaactcaatttcaggtttttaattgtttctgtttcaattccatcataattcattgaatatcttccgtgtgctcaggaccattgattagcgagtttgcttcctttgagagtcttcagagtcatctacttaaaaatgtagaattggaaaagagtgattatctcaatgctcagataaggacaccagagttcagccagaagcctggcagggagctgtccaccgccgtggtgctgattgaggaggtggcttcttacaaatctatcagcccactcttttcttaaactgtttcacacccaccatatgagtaatgcattctgaaaactgaatttacttcaaatgccatatggagcaagacaaaatacaaataagtgaataaataaacatacaaataaattaaatgtataaagtatacagtgttgtgcttatatgttcatggagttttaatagtttttctcttctttctgtgtgggacctttatctgtgatcaaattggtggtgccaacagtttatggtatagttggtgtaaactttatcatcgtctgttgagttctgctgtcacttctgggtgggcttctgttcctgttgctggatgttgaatgcaagaagaacgatctgagaagagactgtgttggttgtgctgtatttagtcatgtgcacactgggcaccaggaaagcaagtccctgagtctctttagtacatgatttcttctagctcctggtagctgatttctgtaactgcatgatgtgttgtctacagtaactagcctgggacagtggaaagagccccaggtcagcatgcagtctcctaggttctgctttaggacctctgtcttttcttgggcataaactcctccctgggtgcacagtccttccgctaagatgaactgcaacacaatatagggttttgacatatgtattttattgtcagagcaaccaggaggggagtttgtgcaggaccacatgggccaagacctatgtttttttgctacctttattctcctggtttaaaaaatacccaccattccacagccctgtatattctctctcagttttctcatcctccatgtggtgagatcctgcctgcagactgacagccctgtaaattctttctgaacttaacacaagccacatccttgatgtacccccttccacctagaaaacagacttcctgcctgaccaattcttctcacacagtgttttctgcatttttcttgcatcttgccaattttttcatctactgataaatgggactcatttgcaatttttctccattggctcttctttaatttctttcctctgacaacttgttactaacagagtaatggaagtttaatccttagttttccagagtaaaagatacaaaatatctgctcccccactgccttcctttaaaggatggctcgcttttttacaaagccttgtgccgatgtccagaaaacatatatttgacaaacttctttttcctgttgttcaatagtccacgtgctactgtgccccctccttccaatttccaacacccttttacttgctctgtcaccttttcatttcaaattccatgatactgaatacctcaagagtgaagtgcagattaccgcatttctaacaatttcagccctctgcccagtggccctgttccagtcagaacacgtaaaaggtactgtcgggcagcttggaacagaaacactgtacaggccatttgtgtttactccattttacagactaggaaactaaggtgcagaaaggaaaagtgacctaccaagggtaacttgatgttgatttattctctggtactgctaactttcatgacttgttaggttagaatgattcttgaaaaatttgctttgcgtctgttatgtaaaaatgcctgaatcatacagatttacacacacgtgtacctgcatgggtcctttactctgggggctccagctgaggaatcaggctttttttttttttgagacggagtctcgctctgtcacccaggctggagtgcagtggcgcaatctcggcttactgcaagctccgtctcccaggttcacgccattcttctgcctcagcctcctgagtagctgggactacaggcgcctgccaccgtggccgactaattttgtttttgtatttttagtagagatggggtttcactgtgtcagccaggatggtctctatctcctgacctcatggtcctcctgactcagcctcccaagtgctgggattacaggcgtgagccaccgcgcccggccggaatagacatctaataattctgactccgatggtgcgtagaggtgcagtcctgaaggtcccttcactcagctcccagctcccacatctgtgaagtgtggggctaaggagatggctctgcgattccttccagtgtcggcaccgtcttctgtatttctgttgtttgaagacttgaatggagggaggaaagcacgtgaacatgttgaaacctgtgggtccaggattcttagatggttggaaaataagacaattgactatacaagatgaatagcaaacaccccccatgtatatgattcttactgtttaattcttaggaaaagtgttattctggatctcagttctatgtaacacagagttattaaatgcactttatggatcatttatttaatgtgaccaaactaaaaattaagaagtacattactctgttcataaaaatgaatgttttcaatggacaaattcattcttgtatttgcatcttgctttaatgtagagctgtaatggggttatggtcagatattctgcttgggcatttataagctgataatgcttattgaataccttttataaagattaatattttttactctgtcctcattaccagagcattaatcatcctggcttcggcccttgcagctgaggatgaacagatgttgaattattgctgtctgtaatcattgtggatcacactggggaagggccgtgaaagggtggctggtgtgatcttcacagctgatttgcatggagcctggctacctttatagctctgtgcatggcagaggaaaccaggatagctgtgccagctgattctagcttcctcgtaggtcaccgtagcctaagtcagcactgacaagcactggcggtcctggagtcacgtacgtgtgacagggtgtctgataagagagagctgtggccatgactctgcttacaataaatgccagttcataaaaatgagaagtcacatacaaggtctttaacatcggctttctagcattctctgagactgtgctgtccagcagaaatagaatgtgagccgtgtatgtaattaaaaatattctagttgccacattttaaaaaatgaggcaattgatgaaatgaattttagcaatgtattttgtctaaaacatcactgcaacgtgaattctctctaaatattactaatgatacatattttacattctttttatgatatgaagtctctgaagtccagtattttacacttacagcacatctctgtttggatgtgaaattttcaccagacacttgatctttattttcatcattgaatataatttacctttgaaaaatgagattcacataccccaattgttccaaacattggtttctaacaagtaaatcaagtagcactttttacatttgagtttatattaattacaattaaataacattaaaaattcctttcctccatggcactaattagatttcacatgctcagaggtttccatgttgggtatcacagctctgaggtattagttttcttttgtgtccttttagttgaacagctgactttgtataatactataccttctgttaaccaccatttgttgtaggctcatatttgctaaatacacacatcgtatcatttagttctcagtcaacctgggagacgaccaacagcatccccattttgcacattagaaaaattaagacctagagagtttaagtaactcttaaacgctctagatacaaagcaaagagccagcaggggggattgcattatttctttatacgtgtgggtaaactgattaaaaggctttccccaaatcccataaagtgacccaggttcctggacttctggtcaagtgtttgttccagagtattcaaaagatgatgtgtttttctttaaaatataagacccctcctccttttttttttttttctcctggtggattatttgttggcttcccaggccatctgttttggaactaatgggactatcagtgccaaacctgtagaaatgacattttgtccatgggaaaagtattcaggacatttaggtgtgttgtccataggaagataggagattcctcttccttggctgccagagacagctgttcatgctttaaaataggtcattgtagggtatatgtatatgtgtgtgtgtgtgtgtgtgtgtgtgtgtgtgtgtctatctgtccgtctgtctgtccatctgtctgtttttgtagtatacgttcctcagtgctcttgatttgctatcttaagacaaaattcaagagtcttactgttacttaaaacgtgtactcccaccacttcttgaaaaaacctatctgtagacagaaatatagagtaagagaagtcccttaaaaaatgaggttttaagaaatttatgtttttgcttttggggaaggcagctgagtggctactgtactggatagtgcagctgtaaggctttagttttctttgtatatttttagttgaaaaggctgactttgtatactgatatttgtattattgttattaacagctaccatttcttgagggttgagagtggcagacctgcttttaactgcagactttagtttgataccacatgtgcgtaattgcaagttaatccaagacacacacactcataccaccactatcatcaggccttggtttatgtgcttggatatgccatttaagaaaaataggaaggcttctgctcttatggagattgcatatcagcaaggaggaacagataattaaagcaatcagtatttcagtgttccgataacggggcattggaggccttcctgtacctgggtccagtgggggctgtgctgaggccagcagatcacaggtcaccagggaggtgcactccttggctttgctgccttcagcttcggtcctcccaccctctcctagtggctctggggaattgcctttctttgggggcctgggatgggttgctgtggaccaggtgacggacggtactgtaaggtgccatagcccgtgtgaccctctgcctggaggcatggttgaaatccctggcatgggcagactgacctttggcctttagggaaagagcctcgttgccagcctggtcctcctcagtgacctggttctgttttggggtcggggtggagtttcctgatgctgatggtgccgggggagacctctcactgaggcatgttggatggctttttacacagtccttcctcaagcagcatctcattttgtctcgacagttaaagtagacatcgccccacctccccacttgatcttgactggccatggatggctgggtcatgaaggctgaggtgcagttggattctggtctatcaggatggttataacaattttttttttttttttacatcttcttgggggcttagtgaatgaaatgtctgtattgggacaaaatgacagtgacatttctaaaagttttgttgtttctcatcaggagaggctggatagcaaacaggtgaaggtagcgcagtcctccaggtggggtggatggtgaacgttaccaccaggtaaccaaagatggttgatagcatcccccagccaaagatgaacagacagacacctctttcttctcaccagagtaattctaacaaatgagaccagcacactcaattagctctgagaatagcacagaccacaactgcctacccagcatgacagataaatggtgcggtgagggatgaatttaggccaggacatctgggtaccagagcctacagggccagctctgctgtttctgagcccagtgctatgttcctctgattttctggaatcacttatggacacaccctccttccagcctgtactggctggtccgttagaccttttccctctcttgggtccatcctaagcttgcttcagaagacggcttctaagcttatgtagtcatttttttccttagtcacattgtcaggggctgtcattacctgctcaggttttagtggttctaactgctgcctctgaggtttcttggaaattcagcttgttttccagaatggtggcagtgctagggatgaccaagtgacagggttgggccagggctctccccatgttgaggttggcacagtgtgtgatgtgtttccagccaaagggcaagaggactcatttgggagatattatggtgggcaccacgaggaagagtgctggcagggcggggctcagataagggtgtgctgaggaagcattccagccagctgggctagagcatttggagttaaaccctacgtcggatgctgtgttgtggttaaggtcagcagctcaagagtcactaaagttggatgtagtttgtaaacatcgaggttctataggaaaggcattgagatttgggggtatttgtggaaatagtgtgtcccatgtgttagcgtttccaggctggattcactcccatgaggtcattttcttgttcatttctcttagactggctttgttctcgggtggctctaacactagggcagtctcctacacgggcagcccatcttggcactgtgctctccctcactgacctcctgtgggattccagacaccacagccttcgaggctgacctggcctctttccagaagatgtgcagctcttagcacgtcatacatttcttctgcctaagtgttgactactggcattgtgaaattaacaggtacattcttattttcctttattaattggacaaaacttcttgtaaaaatggagttgctctcactcctttcttggcgaatcaacaaaaaatggaattggggaaggccttggccatgagccgcccacatgtgatccgctggagacaggggagtagaggggtttgtgtttcttctcagtctttgtttctctctgcctgctccccagtccttcattacagtgtagttcttgggaaagttctaagtgtgctctgtgtacttagaggaaccattccaatgttgcatgcttatagttttcttatataaaagaaacattaatgcaaaacatgttttaatgtatctttaatgttgtaagtcttaaaatataaaatcctgaaaaccggctaagtctgtttaaggttttagagcactgctgtctcctcttgtgctctgcgtttaaaggaaacaagaatggctgggctagtgtcaaaacacagaactggtgttgtaaatagatagtccatgctggagagtggatgatgctccagctaagctggatttcccaactggaagagacaattagggattgcatttcacctttcattgtatttgtatctgtttccctgttgctctgttattttctgaacatccttcctctgtgcttattgaaagaacaaatggaaacccaaacctgctttgcctctgatccttacaccatggcatcccttcattttatagccatgcgtcccagagtggggcctctgcacctgcttttcatttcctgttcctcctcagcccactccaggaagctgtcttgagaaggattctgtgtgccttaaattgccacattccaagattggcatcttctacctaggagaaggaaatcatactttggctcaccttggcatagatgagaaaagctgcaattcaaataatttgtgttgtaggaagtatttcttttaatgttgcaaattagtgaatttgtagttagagaaaattcattaaaaaacccgtgtgtggctaacatggtgaaaccccatgtctactaaaaataaaaaaaaaaaattagctgggcgtggtggcaggcacctgtagtcccagctactcaggaggctgaggcgggagaatggcgtgaacctgggaggcggagcttgcagtgagccgagatcacaccacggcactccagcctgggcgacagagcaagactccgtctcaaaaacaaaacaacaacaaaaaacaaaaaacccatgtgtgtttgtgtctgcatttatgtgcacacagtgggatataagtgtgtgtgtgtttatatatatcatgtatgcttgcaaattattatctgtttacctgggatacacacatagatgcatggaagtgtgtttgtatgtgaattatttacaataacagcagacacggtgttctcacagtcaagtaattgacccccctccagatgtcagttccacgtgttgcacaacgtgaatgcaaactgcttgaaagggcagacaagcttatagcaaacacgagttgcgtcttggtgggtttcacactgactggcaatgctgtgtcctgtgtagactgcagagagatcctgcttcccatgatgaccgatcagctcaagtaccatctggagagacaggaggacctggaggcctgctgtcagctgctcagccacatcctggaggtgctgtacaggaaggacgtggtgagtgttggctctgtgcgtgacgtcctgccatttgcctgaacctgccatttgccttgcagtacaactttattcagttaaaaatgaacggtcttgattttaaggtctagcctctctttttgtctcggtagagttgcacccttaaattatttttatttatgtatatatggtgattattacaacatttatccttttgcattgaaaattgttctttatttcctgtgtcttctcgacgaaatgtctctcaggacctaaattttcatccttaaggtcagacaaaaaggctttgatgcttaaagttggctaattatctgcattctttcttcttatttttattaaagtaatacatgcacaaagttaaaaataaataaataaataaagccaggcatgctgagggagtcgtaaggagaagagcagctcttttcctcccctcaggctctcttcccctaggtcagtgctttgcttttgtagctctaccctattcctttttttttttttcttttttcttttgagacagagtcttacactgtcgcccaggctagagtgcagtggcacaatctcagctcatggcaacctctgcctcccgggttcaagtgattctcctgcctcagcttcccaagtagctgggattataggtgcctgccaccatgcccagctaatttttttgtatttttagtacagacggggtttcactatgttggccaggctggtctcaaactcctgacttcgtgatccacttgccttggcctcccagtgagccactgcacctggcctaccctattccttttgcatttctaaattgtatgcttctttcagggacttttttaaaaatcagaagttggtgccagcccagcgaagtagctcacgcctgtaatcccagcggtttgggaagccaaggcaggaggatcgcttgagcccaggagtttaagaccagcctgggcaacatagtgagagcctgtctctagaaaatgaaagaaaaaataaaaagcaagtttgtgccagcacatatggaaaagtctgaccctgtgcctttcactcccaacataccattcctgttggagcacacacatgatgctattgatcttccaggtgtgcctggaaaggtgaaagcagggctttgtctgtccttgcccctagccctggacagagtggccaggatttctaagtagataaggcttgtccctggccgtttcctgcgtgaccttgaaaatccctcctagtcaccacgcccatatacctggccacccactcccctgtagccctggctcattctctcagagcctgattagtgatctggaagaaaaagatcggattaaatctgttcttggtgatgctggaaacctcacctcttacaggggcattgcctttggagaggtcttggaggccttcacccaaaggccagcctccagtggtcccacttcaggctcttccctgtttttattggagaaaagcttggggtaagagcttgtatggccaaagctcacagaggaggtggtgatgctgggaagggcctagagcatgtgtttaagcagattcatagttcacgaagaagaatcaacaatcgcatcccacactaataaaagagttaatttttactgaatgccacagcagtgtgaattttagatagtttgctaaatgctgtttaaacattctatcctgtgtgactgtttaagttatttgcatttgacgtgcagaaccatctaggactgttatctgcctgccttccatttacagatggccaaatatctttagaaaactaattggtgggctaatcagggatcataaacattatattgtttaaacagattttcttttatttttaaggtttgcttaaattaaattactatgattatatatgtaacaaattatcattaatggactataattaataaaatcccctgagtttttttgtgagagcttttgcctttgacaagggccatttttcatctcattaagggttataattgatttactctttacagggtaaatggattcaatgacaaccactggggcttgcatgttaatgtttctctggtgttggtgttcattggtgtgtccttccccaggggccaacccagaggcacgtccagattatcatggagaaacttctccggaccgtgaaccgaaccgtcatttccatgggacgggattctgaactcattgtaagtgcttggtgacatatgtttggatatttaactggggctgacagcatccttctccaactgctgtttgaacatagcttattatactgcaatgtagtgagcagttgagatacagcttggtatataaaatgtcctcattttccaaatgaatgtcaaagttgaagggtaagcaaaccaactttaaagatggaaacatttggctcttgttttctcattacttacttatagcaaaagacatgtattttctgctgagtcgtcattcttctggcagtttctccatagtgtttacacttaaggtgccattaataaaattttatgaaggaccctaaaaagtaattgagattcttcaccttagttattttattgtctactctaatgtattgtaggtgtttttcttaaacagtaattaggcaggagcctattcatttttttcaagaatattttactaatttagacagtccatcaagtttctgatcatggtgccttttcccagggttcactgctgtcctccgcacccccttaccttaagtctgtttccttcagcaaaaaatgcatgagtagatctcgtttaatttttttttttttgaggttcaaggggttataatttctttcctttttttttttttctttaatttctgggatacatgtgcagaacatacaggtttgttacgtaggtatgcgtgtgccatggtggtctgctgcacctatcaacccatcatctaggttttaagccctgcatgcattcggtatttgtcctaatgctctccctccatttgccccccactccccagcaggccccggtgtgtgtggttctcctccctgtgtgcatgtattttcattgttcacctcccacttatgagtgagaacatgtggtgtttggtgttctggtcctgtgttagtttgctgagaatgatggcttccagcttcatccatgtccctgcaaaggacatgaactcattcttttttatggctgcatactattccatggtgtataggtgccacattttctttattcagacacatgtacacgtatgtttattgcagcactgtttacaatagcaaagacttggaaccaacctgaatgcccatcaaagatagactggataatgtttaaaatatttagcacatgttatcatttaagtcatcttggtggatcctttccaaaaaatgacttgaaaggagaaaacgtccttttggagttttcccttgacatcagagaaggcaccctggtccttcctggtgcgtgaccgttgttcttgttgcatatctggggtgtgaacagggaggtgatgtgcgtcttcttggacagcatagtcagaacggagcactggggtcctttgcgtttttatgtctggtgtcaccacagaggactccgtgtcgtgtgcgtcacagacaggtcgcacagatggacaaatgctgccttagtgtgtttccatccagtgaaacagttcatgtcttagagcttcagcacatgtgaggttcagattttcctttttaaagtgtttaaacttaaagtttaaacttaaactcacattttcctttttaaagtgtttaaacttaaagtttaaacttaaacacttttaagtttggattacaacatgtatgaatcaggaaataaaatgtttccatgtaaattggctttatttacagtagacttttccattattacataaacgtaaatttgcctgccttttcttattctccatgataattattcatagtcttgaaacacatttggaacacattaatatggaatgggcactgagcccatggagaaggatttgcagtgactccacgagccacctgttgacccctgaggtctggcgttgacccctgatgtccagcgttgacccctgacgtctgacgttcctgtcttcttggagtcgtgccgcaggtgcactctgcacagtctcaggagtggaactggaaagggccttatgtagagcaaagagcatgtggcttgaacttgaaccaagtgtggttctgccaagaccctcttgggatgggcggacttagagaggctggggatgacatgatggcatgcaggggtggtggcagatgagggagagggtagaagtggaggcaggtggtctcatgagactgttttgtctctgtttaggggagcatggttctgcctgtgcttagggaaacatggttctgtctctggttagtgggtcttggtcctctctctccgattaggaggtcctgtctctggtcaggggggcacagtccagtctctggttagggggtgtggtcctgtctctagttggggcacaatcctgcctccagttagggtcttcttttttttttttttttcccctgagatagagtcttgctctgtcacccaggctggagtgcagtggtgcaatcttgactcactgcaacctctgtctcctgggttcaagtgattcttgtgcctcggactcccgagaagctgggattacaggtgcacatcaccacactcaagataatttttgtattttttagtaccgatggggtttcaccatgttggctaggctggtctcaaattcctgacctcaggtgatccatccgcttcggcctcccaaagtgctgggattacaggcatgagccaccatgcccagccttatttagggtctttatgctaggtgtgtgttcacttgacttgtagcccactggtcaacagttaaactggagggaagagggcacagaaaaagctcataaagtttggatgggaagctgggaatgtggagagattataagatgtgctcacagcttcatcaaagggtagaatagaccctgcagggaatgatatctcctctcagaccatgtggtccaggatgtctttgagaaatttctcctatctcaggcatgataataagtgtggtagtaataatggcacctcttcactgagcatgcatttacgtgctatgcactctataatgaacaggaagattctcatttaattctcacagtgccctgcagacagacaagaaacagttcaagatcccacagctagcatggcagcacttgtttccagcctggatttggttcccatgtatgctgtcagtcccttctataagacacaggcacacgatgctgatggccgtggtccacttcagaagtcatcgaaaggactgagctgctcctagatccctgtcctgcttagggagacagctgttcagggaaataagcacctttctattttctgtcatgtcgtatccatggtccaactctaggatctccttgctagaagggccagaccacaagctaggtgcccatttcctgaagggcttgggatgctccagcttggaagaacccctgtgttctaaggaaccctgaggagttcctccggaagaagccttgcatgttctaagaagggggtgtgacagcgaggacccatgcttggtcttatccagagccacattgatatcaagcatttggcataggggtctaagcactgtccgggaatggaagaggtagaacaaacttcccacctccagaaccatcctccacagccctgatcttcccaaacagaagcctcaaagtgggaagaggagagaggtcttaaacggactcctcccaattccaccatctctaagatctgtaaagaagtaaaaaaaatccttggagtttcttttataaaatgcagctgtcttgaaaggactctcaaaaaaattctgaataagctataatcatttaatgagtgatgacaacatcaagatgttttcaagaagggtgttcgccactgaaaattcgagttgtttagtgggaccttgtaatccccaaccagccacgagccccctctctggagtcaacagagcagtgtgagtgaaatgctaccctgtttaggatgcctgcccttgctcttccaatttgcatcaaatgtagatttgtgcattaactttttaaagtcgttgttgctctgtgaatttagattagaggaagatcaaggcaaaaagtatccctgacaaggtggacaaaaaccttaatcagtagaccttctagagtggaaaaagagtagaaaatagttcataggtctgttttgggtaggctgttccattccattatatcttagagatttcagcctttatgtgttactcatttttgctaaatatagtggaaattatgtaactatgaatcagcttaaaaattctaagtaatcactgaaaatgagtttttaaaaattaaagtgattaaaaagaactctgaaattaatatactttacttaatgatttattccatgatgttgtcaacaacagtactagaaatgtggcctctttccatcggaataaggtattaactgggaatgtgattatgccctgacagcttccccctattaatgtaaggaatagaaaactggggaacttcacacttaattagataaattgggatatgcaatataaggcttttctttatctgtgggattttacaaaaactcgactttgcagtcagttgtatattgtttgctttagttgattatatttgaaatgggtgattggaatgcgtctcgtgcctaggataataatgtgctatgatccgaagtattacatccttaagaaaaaaccaaaacaactctatttggcagttgcagaattgtagaccatgtgaatacctagcacatgcccagagacagaagcgttgcaataaccttgccacagaacaaaaaggtcattttatctttactctgatgtagtctgatgctgtagaagcatggagtgaaatacttatttttatattaagtcagacttcaggatttatttcagccttcctttttgagaagctttctaagccctcagcattaagcagcatttttcctcatcacacacggatctgagcaggtgaccgcggctgggataggtgctgttgtgttgtgtgcaggtgggctggccagccattgggtgtgtgtttttcctagagtaagaagcactccaggctgagatgagagctgttgaaatgagtaacatttccgtctcctgtgatacgcgctgctgttgcttctttcaaatgatcagatttacattcttttaatgggtcctttaaaaatgtaatcgagtgagaaggacttctaaagatttttctttggcctggatacacacgaggggattggaaattactaattcatgaaaatgaaaatgtgggcttcttttaaggaaaaattccctttgaacattgacagaagtgggcgtagggaaggggaagattttgcctggattctccacttaactcttgtcaccactggagcatcctgactccctagacacaagtgatggaagttattttgtttccactctaaacactgtctcagggggacattgatgggatggtggagggtgtgtttcattgtgacaacagcatctttggtggggaatttgctgttggtgaaaacccagtgctttctctgagcatgggtgattgataagggcctgacatgctccttcatttggaaaatggtattaatagaattggtttcccagtgaatagtgccttttacccaagactcataaccaaatattttcacaaagatgttatatccccatgcatgagcattcattttgagatgttcattataatagagtttaagtatgaatgtgttttaaaaatgattttaaaatcatctgcaaaaaaatgttgtgtttcaaatggacagtgtctgggttttgtatagtcatcataaaaatgtctataattgtactgtttgctaataaacctacctgctttcagaaaatcatcctaacgtgtgtgtgtgcaccaatggttttataagttcatttttctttggggcagctacagcaattttaggtttgttttcatattcctgtgaccctggtattttttcaaggttggttactagctatgggtttactgcagaagaagtaaaaaccacattgttgaatgggcacaatatgctctgcaatccttacatattcataccaaacagcaaagatatttgcaaaaccagactgccttaagttaatttttgcgcaacttaaaatgaccttgtcattgaccaaaatgtataggatccactgtagcatgatgactttatgccagttcatgaaatggatgttctttctgatctttgtaccacagagttgtttactttcagtaaataaagtggctgcacatgcagtgcctgcaaatatgctagtgatagagtttctgtaggtcaaagaagacgtgctggtgtgggaagcagctgctgtgatctttaggtgacactgctgcagccaaactgccctgattcataatgaaatcaactttcacttgctgataaaaatgctaaggaatgagtccaccagtgacaggttttctaaacaggccatggtgttactaacaccatgacatagaaaagttcatgcctctttcttgtttccttttcttgctgtcttctaggaaaggccagtatttgatggtctgtcttcacagttttaattaagagttgtgtatcttggttctgatatgcccatgtggtttccaaggaaaacagtgttgcaggccatcctccttgtgactgtttataggttggagttggtctgcctgaggctgggccatgactgtgacaccatttacacccagtagtccagccacatctcagatctctgtggctgtagataactaactgcctctcagggtacatgggaaatgctgccaactgcctaagttgtttccaaggtagcaaggttttcccatactttgagcccctccccatttatcttctgctggagggtcggagattgaaggagcagatgcaggactacaggacttctgcttcttggaagtgagttgcacacttgtagagtgactggtgggcacccttcattgtatctgggtgtctgtagaacaggacctttgaggcagcaccaatagttggctcagaaatgattatagaatgagacagaaccctccctctgtctgctctgggctgtgcattgggccttccttccctttctgcatgtgtcagaagaggaatccccttcttctccctgaagaacatgcgatggtagcaggagccttgagtgtcggtctgcagtgccctctcccttgcacatggactctgtggttgcagatactgggaaaaagcattgtggcctctcctctcctaggccgtccaggtgaggcaaacaccagcccacgtgtgcagatgggttagtattaggctagtgtcagcaggagaggtaggcgctcagcctatctcccactagggaggggaagaagaaaggaaggaggcggctgatcccttgaggctggggatgtgctcaatggaagatctagagagaagctacctcccctgggccatggaggcaagatttacatgccacagtgtactgtggcaacactcaatgtatttagccatttcttctgaggttaagaattaaacctcatatacctcctgctatgagcctgtgtgcatcctaaaatgccaccatgtgttccggtggtgaaactccatgccagggtgcataggtgggcaagcgtcagtcccttccctccccaagccaggccagctctggctggtgggtcaggcccaggccttacgatgctcttgtcttctgcagaccggatgaaatgcctatcggcccaaacattcttcctttattattattttcttagattacttttatgttccccaatttttgaggccatgaaataagtttaatagccacataaaacatctttgatttttttatttaaaaattaataaagaacttaacgacaagtataataatttaatctctatatgcaatgccatgtgtacatctacataagggaaccctgtgcgttttaccttgcttttgtatcagagtttttacttgaatctttccaagagaagaatcaccatctgttagtgacgtgttgcaattaaactatgaaatgattttgacaatagtttttctattttgaacacactttaatttttagggatgaattaatttatcttcagaagttcctttttgactctgaacatttcaattttatttttttttggtctagactggtgtgaaacagtgacattattttgtgtactaggatgtcctcttgtttagacagatttgtgttactaattagaaaactgctaatacccttatttcaatttactgagatagttgggattcttaaaacataaggagagagaacttgttggaaacatttttataactttagttaaaaacagtataaaaaacatgaaacccatttttaaatatttagtctacgtgaaacagttacacttccttcatgttacaggatcaacttcctcattgttcttgcaccaaaatatttctcagttccttttattgatattcagggattcgaacttcatatagtgtttccgcagaggatgtgtgtgtgcacatgtgtgttttaaattaaagcatacaactgcagtgttgtttggcccccgaagaatgtttacacgacatactcttcatttttttttcaaggcccgatctggttactgatcactaggtccttgtagaatcaaaacacttagaactaaaacagatttgctgttgagtcaggaggaaaatacatggcaagaagcagctccaatctgacaaaagcaggtgagatccttttaccaaggttagccactgtgtgtttggcatctagtcaatgaggtgtgcatgtcagcactccactagatgtgaaactgctggacagaaacttcaagactaggttttcctgtatgctcacaaactattcaaaatttaagttgtacaaaaaaaaaaaaaaaggcaaagtaagatccctacttcctattgtgaaaatcaaaaaattgatagacaaagtcattaatagactaggggatttgatttctataaaaagatacttgcaaaggtgcaaagaaatgagtgaaaaaataaaggaactaagatttacattgcaatgtgtaatcaagagagaactctaagtgttactgttgatttaaaaaatacctaaaaacatttgattcacagctttcccctaagtatgttgtttagtacaacttactaataggttaaatgtaggcgacattgtcccttggtagcagctaaactaaacgcactgtttctctttgagatggtcagggcttccaccattaatacaaagcataacgaattgtacataacgtctggctgcacttaccatggctaacagtgtctcggaggatcgatccacaaaaacactgtctgccatggcacagaatgcctgtgatttattggtgggtggattatccatcgtgtatctctatgtatgttctcagattcttgccagaatgtattatttggcctttgggtaccaaaagattaaaaatgagatctaagaaaacttagtgtccaatagctctgaccctgtctacttgcagtgattaaaggcatatcctgactttgggggactcctggctgctggccatttggaaaatgagcagtaaacatgtcgtaagtctggagatgaagaggatgctaaatttgaggtgtcgttgtgacactgagatgtggtcacttggcttagcgctatagcacatgaaggcaaatatacatatagtcacattttagagattattcatggtctccgaccacttgaaaaaattgtgctttctccggaatttgatgtgctgaaaattgcactcgccccctgcttatttgcaaaatgaaacataaaaatgaagtccttcgcaaacataaggcttgctttttcttctcattatttaaaaaaaaaatcaaggcttgaaaataattatgagttatagctgtgtacagggtgacagcctgccatctcgcaggttgataatgtattacttgcagatcgggggtgggggaaaatttttacttatcatctttgactacgtaagtttcatttcagattttacatcccacatcagtgaactgcaaagaacagctggcaaggagtgacacagaataccttgcttctgttaattatctattggtacaaaggcctttttggtacgcagggcgagaagtgggaggtgcctgaatgggcaccacagttccctcgatcctattcattttggaaaagtattgacttaaactccagtgggttctaaagacggcctcgagactccagacaccgtgagtgttaaaggaaccagagtttccatcttccgtgctttttagattcagttttggatttttgcttgggagttgaggagtaagtctcctgagagtaaggcgaaggtatgacctgagtttcctcaatagggtggagttttcttagaaccggctggagtttgtcttcttgctgcttaaaatccagctccacactagaaaagagagagagtgaagactttagcatttgatcttttccatatgaagatccctcttagtgtcagcaagatttgggcatgatcagtgtgtgtttgtaatgtaattttatggtttaataatagcaattcgatatactatgttttagctctgtgctcccgtgaaatagttcaaggaggctcacttcctttggaaaataacttacttgcttctgtaggtgaatctttaatattgtgttaatgtgcacagttggtgtatgtatttgtggaaatgaaaaatgtgaaatatgaataaccccattgtttgtccacagtctgttcacatgggcctcatggagtaaaacagaaaaccaaaagtatgagtgggcaggggtcaccttagtacatctataccaagtgcacgcaaggtccgttcctgtgcaatgtatcacaagatcagagaaatctatttctctgatctcccacctaaaacaattctggaaggaaatgaccttggctgacattctccttgtaaaagcttatctgtctgaaaatctgataagggccatagtgcccaacgctggggaaaatagtgtgttcatggagtcaacaccattgaatggtactctgccattactaaccacagtttctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaacaggtctgcttggcagctgggataggacccccggtccatgcatcgtttttctgtgatgatctctgcattgaggagttctgcttcccttcccactcaccctgtccctccttgggacctctgcgttctgggccaggccttgggaggattccgctctgtcctccttccatgtctggtctggatgccagactaaatgtcagtagatttcagtaaaggctcagcgttgatgataatgcatgagctcataacattttataaccagtggaaccgtaaaccatttataaacatgaaatcctattgatttagagaaccattaatcctagacaaattttgacattttggaaagacagaaacagccaagctatattatctggagttttaaaacaagttcaggacccatctaatgggccatttcatgttttaaatccactgttccatttttctcattgtcagtgactctaatattactcaaaaaattaaaaaaaaaaattgccagagaagtttatggctagtgacctcctgctcccaaaacaagttatccttttcccttttttcgaagagcctctttgagttatgctctaatttataggaagtagaataaaatctcatgaatttaagtcttgctaatccagactacgtgatgatggaggcatagtctcttctaaggacagttgtgaaaagtgcagtctaaggctgtgctgcattaatgaaatccgggcctcagttccgtgatgtggtgcactagaaggacatggggtttccaccctgcctcttccacctgatgctggtttgggagtcgggggctccttaaacttcaattctttcacttcaagggggagaaaatagttccttcccaggctgtcgtaattactgaattgtggtgacaatctctccccactgaaaaatgcccatgaacgagcctcctaaactgtaagatgcaatttaaatattattgtaccattattatctattgatcactaatcttataatggaaacaagagctaagtaataaagatatctattagggatctcttcaacttggacatttaacaaggaaaacaagagcctgtcaatcgagtctgtgaatatacggtatgttaggtatagaagcgtaattctaccaaggtgctttggtaatattgaaggtgtgttctccagatcgtaaccgtttcaacagccccagattggttttgggttattagaacagagagaaggcgctagcatctcctaggctaacagtacaatttcggctacctgtaattattgaattcccattaagcaactacactgggaatcctgttattaaccaatttatcacaccaaggaaccatgtaatcacagagtaatctaatctgagttcttgttaacaaaatgactcgactttatctgtcgagttgattcctgtttgcactccccattatgctgccctgggaatctgcaaccagaggcaggttccttggtagagggcacttatgagtctgtgagtgcccacttggaaacgcctgccagcaagttgaccctgaggtccgccccccagcccatctccccatctgtcacatgtgagttgcagtggatctgcgtgtgggatgacgcccgtgcaccagccaggcaacgtgtgcagaggtgtgaaggaataatgtgcattgttctggacactgcttcctgctcaaggacttttcttggggaagcacaccaagtctctcggttgagtttgacacaccaagtctctgggttgagtttgacacaccgagtctctgggttgagtttgacacaccgagtctctgggttgagtctgaagcagaaacctgactggaggaggcagcatcagaaggttaacggtctggccaactctggctgacatcgaacaaaggtccctttagtcttaatagctaaatggatcaaaaggcagcaacacctgctcttctggttagagtagtggacttggagaaaagctgccggtagatgttccagggcactgggactgccctgcacacagacctccctctgtatttgagacagcggcttgtccagatagtgcctgggggcctgcctggtggagggcccatggctcttgcttcagcttccccttcctgctgcccggcagacctgtggtgggagtgttggttgccctacctggggccacatctttgtccggtgctgccagcttcatgattatcactttctccccacctgaaacgcctttctgggctcatggcatggctggcattccttggcccactgtttctcaggtccacataacctccttgttgtctgaccaccttcccaaatgttgcccaatccatcctgtcttatttgtttttgcactaaccacagataattattcgttcccatattacttgccttcatcttcctaaatgcatcttctcgaatgcaggcaccataatcagagatgccatgcggtcatcctctttctgtttccagcaactatagcaggggctgggtcctagcagttgcctacgtaatattgctagaattaatgaatgagaacagagtcttaaaaggcaaattctggccaggcacggtggctcatgcctgtaatcctagcactttgggaggccgaggtgggcggatcacttgagatcaggagttcaagaccagtctggccaacatggtgaaaccccatctgtactaaaaatataaagtttagctgggtgtgatggtgcatgtctgtaatcccagctactcgggaggtggaggttgcagtgagttgagatcgtgccactgcactccaccctgggtgacagagtgagactttgtctttaaaacaaaaaaaaaaaaaaagcaaattctacctcacttttagtcccagttgccctggactgctttgttttggccaaaaattatgttgtgtcctcccctgtgtcctcccacaatgagaccccttccttgccacagacaaatagggctctgcctggaggcattgtcagaaccactccagatggagtctgtggcctggttctattctatcagaacttatcgaagatcctgaaacattttctgcaagacatactccaggatctttttggagcctggctcccatgccacggtcccctcctttccgtcttctaggattctacagtaagatcttggatagaatgggtggggccagcagggtctgcttgtgagtgaccggctaccacagtcgctgtgctaaggggagcgtgagagttactttgtccccttttcacttgcctgtggacagcaggtggaggtctagctggatgttttctgggtgatgtttgttctgagcaccatcacggtcccaggccaccagacgtgctgtgtgcacctgctttcccagggcggctccagtgcaggggctcattctacagccacacgggcacgtgggaagccggggctccaaaccttgttgtggtttctgaggactctggctgtggctttgcacagtccccttgcaacctcccaggcctcactctccagcagctcaggaggcaggaggctgcaggtggtgctgctgccctcctgctggagggatctggtgtttgtaaagcatgggcaggggagtgtccatgtcatgaggaattcttactcctggggaggagcagcagcctggaaaaagtcctgattcttgagattcaaagcatgagtctgaagcagctggagccaggccagccttacctgtgcggggtgttctgtcctataaacacctgagtcaaacacaggctgtagattttgctgggtgagaagggaagatccctggatggctggggatattgacaagacacgaattcctggggactgtagggatttacctttgtagccctctcgctgcctgcacctccattctccctccagataagggaaccatccacccaaacactctgtgccctggggctgtgtcgccctcgctgtgctcttggcaagtccctgtgatgcatgattaaagcaactgagagtagatttaatttcttggttggtctttcccttttcaaaatgaaagttttaagtgtggggactttcttacaacatgattattctgtacatttccaaagaaagaagaatctgccctacatctcaggctgctctccagcctgcacctaagctttattttcttcccagagactgtgctaggctttgtagtaacacttctccccgctgccgcatgtgattttgcagagcggcatccttcttgcttctccagcttattctctgtttgtctcatgctcctataaatactcaggccctgccacagtttctttagcaagctgtcactgaatcctcaagataatttaagaggaacacatttttaaagttgccttctgcagtcgtccatgtgtaacagttaagagttaaaagcaggacaatctggtgccccggagcttgctttctggaagggaagaaaaccctttgtctttggggtctctagcctcgacagggccatgtggctcggtggccagcaggtcagaggcctctgcctttaattctctttgaattagatctcagagtcttccccagtgctaaccgtggctctgtgctgactcaggctctaccactgtggataaatcacctcaccttggggacctgagcttgcttggctgtgaagtgatggctgagatgtgctcccacttctcacagcagtctcctggaacaaggcctgggcccaggagggcaggtgcaccaggatgtgggctggcttttattgtgtagctttgggtaggaccagccatgtccccaaagcgcaacaatttatgtcaactgacattggcgccaacttggccggttttatgtgagtgccatgggcaacaccagcattgtccagaggaaactaaaagttgggatccggatcccaggcctggctctcccccttgcatgggaggtgaattcaggcaagtcctttctgggccttggtttatggatgtgaccctggccacctctccaggcaatagaagaaccaggaccccaaatatttgttgttctcttctgaacacatctccgtgtgcatatctgaggggcactggaaatccagcatgtccagaaccagatctttcccccagcctgcatctctgtccttccagactcagcctgcagcccccattcatctccctggatgactgcagaccctggaatcaagctcaacttgctcctcctgcctcagcatccctgggtcgagtggatttaccctcagaacacccggtgtccttcctctccgcccaccttccactgctctagtccagaactccagcagtttcctccttggccattgaaacagcttagtctccctcactctctgtattctctccctctccagttaccagagtcaccttaggaaaactggcaaactccttctcaaatccctgcttatccttcaaaacctaggtcacacgtcactccttctttctgtggattttctagaataacaaagtccaccctcccccctgcctcatccacacacctctgggatgagttactgctctggcagcattgtctctaggtttccatgagagcctgtctcctgtgggatcgtagctgtcttcccccaggtctgtgaactcattgaaggatggaccatgtttaattcatcttttgtctgcagtgcatttagcacagtgctggctccgaacctgctctatttgtttgttgaattacaataaactgatgaactgaaccaaatcccctcacttctaatctcagcaaagtgctgccgccctattttctgttttcatttaaaatttatacatttgtataattctatttattctgtctatagaatttgttatatactatttctatattatatacctacattaaatatatatggatctcatcctaatagtttaaaatatcagtggtttgtagttaactagcttttcaacactttaaacatagaaatgattcaccgtgactttgtatccttcctttaccactattttacatggtaggtgcattaatcaatgtttatggtatcactgtagggcttcaaataccagaataaatggctaatccatgatagtaacactcaaactgtaagatctgtccccttttcctggtatactatgaacaagaaattatgattatagtttttttaaaaaagcattagccagatatcctagctgtatattttactatgaaggatccaaagttagagttagacgatgagctgagctttccaaatgcatcttggatgttttccgtgaccatactggagaacttgcttgactgaagctcatcctaggtgcccatcttacctgtggcactctctggagtgcacctgcggctctgggtcctgagcctcatctaggtgcctgggtctgagggcaggtcagatgcacaggggtcagagaacctggcatcccataaaatagtgccaccgaggagcagaggcagacccaagtcatttggattgcctctgcccatcgtaagttctccatgaggaaagacaccccatgactaacagcaccgccacatgtctatgaagcatatcttatgccatccccctaggaagccaggaagacgagtcatgataatcagaggagtcagtcctttctgagacgtagcctgcagaacactgctgttcctgacctcagtgaagaacagccagttttccaacttttgacagaaactgtgttataactgccttgaaaaggagatgacacagggctgttgtcctcctgttctaagctggttgctgtgagtccctcgtggccaacccaaccctgagtgggatcccatgacccagggccatcaccttgcctgcctgtctccttttgaagatgggagtgcgtctgtctagagacatgggtgacgtcccgggctcccagtgttggtgtgaaggctacaaagccaccctgcctccctgggccaccagcccggaaccctggtttctagatgtggtcaggagctcccactccatcctgatacccattgagagcatcatctccactaaatgtagcagtgatagttctcatcacacacggaaaccattagctgcttgtgtgtgtcatctggtgtcaccagtgaccggtctaaacgtcagcctgtgcattcctgcaggaggtcccttctcaaacaggttctttcaagacgcctatctgtgaggaagaacctgccctggggaccccgcaccctgaattccctagtcactctattccccatggaatttcatacgacccagccctagacatcgtggccaggactgcgtcccgtatttacccccagaaaaatctccatactcatctaaacatgaattatctttatcttcccatgaaactgacagcgtagtcccctcatgctgttttggacattggtaaatgcctccttaactttgaccttggggtataaccaaaggctgggactatcagtataattagcctttctctgctaataaattttaactaattgtttcacaaataatatgttgagatgggtaatcagttttagttacagttaatggctgtaacaagtttcctagcatctaaataagagaattaaggcattgctaaacattagtaaaaatgactaaacctaaatccgtacatattcgagggacataaataatatatttttggatttcaaatagaaaagaaaaaacttggattattagctttgggaattttcaagaagaatttagagatctgtcagaatcattcttttttcctgacttcattaaacaaaagtatttccttaccccagaataacattgtgtatgtaaggtgttatccagggattcctttctctcatcttcctaccctgtcactcaccataaatactaagaacagagcactaaacattaggcaaaaggcgaatttcccccacctcagttcatgctgctaaagaacttaatatgcacaagtggtggtcattgaagcagggctggaaagggcacttccatgaagagataatcgctgaatgacaaaggctgcagagactccactccaagtgggctccggacaggctggaattggcacggattctgcatacaaatgcaattaccactcttaacaataggtctccattagtcaggaggtgcccggttctgccggctgtcttgatcgtgcactatcctgaccagctttctttttgcaatacactcggaatcagtgaagtgccagtgtgcgtgattttatctagaactctttgcaccctctgttttgtggtcttattggtgttgtaatacattaccaagaatgatgtgagaaaatacaacccatcacttttgtgaattcttcattcagtctcataatgttagatattttcctcatctttcctgaaatcctccagtcatttggggaaggaacttgccttcttttggagcttcctacttgagaagccgtcaaggattgtggtggactgggatgttctccagcctgtctaagggggagtgttcacgggtcgcgaggtttcccatccatccttgggggtgccctggctgtttgtcctcctagttcctgccagttgttcctaacgccgtagcctggagggctctagagaggccatccaaatcctccctaacctggcctccctccacgattatcttgttttctttggagtctgctttgccaggtcgggcaccctggcttccttcacctcctcctcgcctgccttttacgtccttgcacctgtggctctcaccttccgtacagagggctctctctcgccagagctctgtccttaccctcatcccggggtcccagggtaaggggcatgcatggaggtgtcttcagcagcttcacactcctcccagtctcccagggcctggtgcagaacttgtccttaggaggtcccttgaaaaacacctgttcaattaataccctttaggaccccaaatggaaagggctaaggcatttttatcaaagtggttgtttaaaattccacctgtccttgtctgggcacggtggctcatgcctgtaatcctagcactttgggaagtcgaggcgggtggatcatgaggtcaggagtttgagaacagcctggccaatatggtgaaaccccatctctactaaaaatacaaaaattagccaggattggcggtgcgcgcacgtagtcccagctactcgggaggctgaggcagaagaattgcttcaacccaggaggaggagggtgcagtgagccgagattgcaccactgcactccagcctgggcaacagagtgagactctgtctcaaaaaaaaaaaaaaaaaaaaaaaaaaaattccacctgtccttgaccatcatggatcatatcaaacagtgaaagcatggagtacacagcaatgcgtttcacaagctccccctctctgatgtcagacaagtggtgtggagccttgtggcgttcccatccagtcaggttccaagcccactcattgatccactgcagaattattagtgtcacttgaggccactttgtgtggtggctgtgatgatccagaaatgaagcagacacagcgtgctccgggaggatgtggtcactcagggcttgcaactgatggtaggaattctaccacttgacgagaagattctaaattctgggagagatgctgtttaatgaatctgagtcagaattcctgttatgttttaaatcttgctttcatctccaaaagcccttggattgcagttggtccatgttattttcatgaaaatgtacacattagaattcaggccattttgtcgcagtactatgttacaaattaaccatttcagcgaaggagagaatggctggtttgccgatgatgtttcattgttcctttctgaaaccacatccgaacaaaagctgaatcatccgtggtgtgactcatcagattagtccgacaaaagaattaccaaaatagggctggagagaagaaatttcagctgcttatgagcaaagattatattagtaatttatccacaaaacattttctgaaataattacggcatattttgacaagaaatatggaagataagccagaaaagttttcctaaagaaaacggaaactggaatctcttttaatcttctttcatgctgagatggttttaattagagtagcacagtcggtctgcatcacaaccgaagggatgtctgtcatcttagaaaaagatgtagctgtgtcaaccatctcaaaatttgtcagaaagatcacgtttggtacttggggtttcagtggtctaggaggaagcccatcaatcctctgccgaagaagtgttactcagctctgagtcaatagatttgccaataagggagaggtgtttttcagctgaggaatgccttgtgactctccacacttttacccttctgtgcagtctcttgaaacccatagttacatcccttgcataattgtaaaaagcagctcctgggatttcagatctggaagggaccttgatgatcccttagtgcaaccccagaggacctggagactgaacagacaccccacccaagagagagggcagagaagctcagccctaaccttgcaggtacgcggcaggctctcacgggctgatgtttctcacctttcgcttgtcgtactggtggttttccccccgccttgaaattgcatcaagaccgtttgtccttttgatgcttttccctagtcctctatatttccatgacagaattatttttcacagagaaatatgtaccgcctcccatggcaaaggtacccatttattacaggcctgtggtgctaaagccccaggcagccgggtcttgaacacagtatccttttcatctccctgggccaggcattactggaaacacggtggatagctatgctgctcggagagggtaattgggtttcgagtgaaaagcggtgtttaaatgcaagacaggcagggtcaaattcatttccctccagggcttttggccttccagaaagcagggtatgacaaattacaatgtgtgaacactggcagctgtgatggccccacgtgttctcaagcctctgggacaaccacagtcatgtgacattttaagatttattttgaaattcctttaagctacccaatcccggggtgttccaggcatcccatggtgcatatggagaagtgggttgtaatggtggtgtagggactcacaggaaagttcctgaactcccggattcaggtccttgcaactaagagccaggctttgatctgacagcaaggactgtaacctgagctatactttcccctgctgctggaattgtgtttctacagattcatatgcaggaattcaaggaggacttggctgtaagtttgcatgggagaacaagacatggatgtagatttgtaaagcctttgaaatttggagacaccctctggctcacttggagtctatacttccgagatgctgtggccacccatgtacactgctactgagtcacctgaataggtgactcctcctgcccaaggaactcactgggttctgaacacttttctaccgaagaaacttctattcttaagcttctgacatttgggggtgactcacagaactgaccgcaagctgcgaggtcatccagctcaatccccattgctcaccctcccctttctctttgctcagtgggaccctgagggaagtgacctgtccctgtgtatcagcaactctcagccaccagggcagaatcacacagaccagtgcttggtagtcagataggattacataagccctcttagctgatgtgctagattaaccatatggccctgtcctttcacgacataagtggtgcacccatgatgctgggacccttaactaactggcttctctgtctttgtcctgtgactctctgtccttacttctcaaggttcatgcttaccaagaggatgctagatttgttcctggacctgtttatacaattagtactcactattgaaatgatgtgattattgaatgtcatgcaaaccactgaggcatgagaagatagtcattgctgtggattcagtgctttggaaagagtggggtaccacaaaatattcaatgaaaaaggtagagacaggtcaagtatggattcagaaggattctgatctcagattctgccacaggactttgctccactttaaagacaggaaaattggtgtggctcatggcagatcatttgaaactgtagtgggggtgccacattcaaagaaaacgtctgggcctcacctctaaaggctgccctaacttgaaatcattcaaatgggagatttcaattcatgcgattcaaattaaaataacatgtttaagttaggtacatgtcaattttttatgatttccccattgattgatttttcaattaatggaccagaagtgaactttcactccctttatcatctcttcctgcagacctcagaaaactcttatccaacataataaccaccttaagagtaatcgttaaactttaattatttccattataacatgatagggagtttaggaagcagcatttgatgagctatgttccacttggtagtcacagtgcagtctttatttgaatactagttcatttcttgagtttcacactagtttatttcattgacaggactcaatgaaataaagactttgggaggcagcaggagtccagccgaaatattactctgcagactgtcctgggaccaaaagccttccagtgtaacttctgtttgtagcagaagtttggctgttgtagggatgttttgtcattgtgaccactccaaagggagtgattttaaaaatcaggaaagaaagatctaaaactccactcttcctcaaacactacctcttctagaatgcctctcccatttataagggggtgacagtcgggtctgcaggctaccgagggccacatctctattcagtttctgaagatgccacccaaatcacccgtctgtaaaatcacatctgcagtaaaagttctcgatgagtagtcatgcattttccctgctcgtatgagataaccagagcgatcacagtgcctcgccctctacctagtgagtcttcctaagtcttggcaaattcctgtggtgcttggtcactcgcagttcttctagcaagtggaccagtggctgatgtattcggattcatgtagagtgatgtttgagccagttcaaaacagtgaccactcgagtaattcctgaaaggacagatttctgtccttcagagacttattcagtcacttttaatgtcactttttataggagtgaattctggatttagagctaagttcatttaaattatttcagttaggttaaacagtgttcacatatatatatattttttttcgatcacccacagaatattacgtaggtttaggctgaacagctcattctctgaacctaccctggatgtcttgactcactgttgcttggttgcgttaaagacggtatgagctttagcttccaaactaacagaagctgaactctgagtacgtgccaggtcatctacactctgcacttcctaacgtactgatgttcacggagggtcattttatgtcagtgttacagccctttgttgttgattcaaaattctcttttgcaagatgagtggagtgaaaagtttcccattaagcaaacttctctgatctgttgctatcattgagtttctaatttggaggaattgttgaagaaaagacctgcatggatgcctcattttaacctcctcattggcagttgccaagaacagtcagcagcttggcgtgccatgccaggctgctgcaggggcccctcctcccttcctgctgccaggaggccttaccagcttgtgtgtgcctcttacaacactctaaggtgggggtggtttcagtaaggtaggctttctcaacctcagcactattgacatttgggactggatagctcttggttgtgggggttgccctgtgcaggcagcataggatgtcagcagcattcctggcctctacctgctgcataaccggcagcagctcctcagttgtggcaactgaaaacgtctccttccagactttgcaaatggcccattggttcagaacctctgaggttaaggaatgtgctgatgtggccttcggtgcctatctctacctgtggtttcttctgcctcctcccagacaaggtctccaggtgacccagctttgcttttgcttttaaggaacctgggccctatctgggatgctctgtctggatcggaggcatggacggccaggtctaggctttcccttgggagagaaccctgatgggttgaagattgtgtagcctcaagcctctttgctctccccatgtctgtgttcttaatgcagaggacagtaactttgaataactttttagagggttttttggtttggtaattgttttttgataatttggtggatcactaaaattattctccagtctaaactttagaaaaagaacttactcataacatttctcaccgcttttatattttgtttgtgaaaaattacatttgcaaaaagaaaagaaaaaaggatagccatccttccgaaggttttgactacatcttaaaatcctaaattactgatgcaagccaaacacagcttcttcctgttgggagtttctgctgtattcttgttgatgtcagtcatataaacaaacttcaaattaaaaaccacaaggaacagctgtaggggctctggagcagggattctgcccggagacaggcaggcagcacaatcctcgagagttcccaggaaatgaaattccacatttggtgtgagcagcccaggtctttccatggtattcctagcacatacggtgtgctttcaagcctttgatctataccctctgaagggcctatgttttacagcctttccagaacacagagcccagggctcacacctatcgattccaagggagcaagccatcaaacttataccaattcttgaaaccactaagatacatttgcaagataaatgggttcaagctctcctacatcccacggttctatacttggggtggggtatttagaggtagcttagaattacagtcaagtaaggtccttcactttttgtctgatagaatcatcccagcatggccccagatcgttcttgcatttgtgggtaaacatcatttgtcactcataataagaaagtgggaagaggagaatgttaacatacctatagataatacatgcactgttcctgcatgtgtcacaattagctgtgtcttgccccgtccgatatgaaagcctacaagataagaacaggagagcattacaagcggtggctgggggtcactggctttatagagcagatgcctcaaatcagatgccttcccaatgccaagctcatcatggtcatggaaattgattaatgcatgcttcccagtttgctcctgtctctgctttcgttgtacaaaaccaatgcaacacctacagctaagatgatatttaaattaaatttagaagtgaacataagctcctggatgaagtaaataatatgatttcgttataagcacagggaatgtgggatgtttcaatgcagatttatggtgttttaaagaaactttgaggaaaaaccaaccacatacacatatgctgactccatggcttatgtttgctctaccccacctgtcctgctacaactgggactggcaaagtgcggcctgcaggccaaatcccgccggggcctggttttgtccagcaaactaagaatggattttacatttttaagcacttgaaaaaaaattgaaagcatataatatttgtgacacatggaaatgatccgaaattcaaatttcagtgtccatgaataaagtttttacttttgaaaataaaatggtgaaaatttttatgaaaatacctatttctagtatcctcaattttgcctcttggtctgcaaatccctgaacatttactctctggctctttagagaagaaaatgccaagccttatgttagaatgtcttactcccattgccataacttctgagttactttccctggctttattctctggtcagttctgtcagacccctgaggccgggcagattttggcctttgtaggggaggttgctaattctcccccctaattaaaaaattaataataatgaccttggggtctttctgtagtatattgttgaaggttgtataaacataaagggttgatgatgagaattttctggaccaggctggagttgccttggctgtttcttggtccagccacctaggaacagctggggagtgtttcatgccttcacagtttctcctattttatccagcctttcctctctgacatttttaacatgcagatgtgtattttctgggtattattttgtgtccaggcacagacatgataaccggaatgttaaatttgtggcaggagaaaagctcccatctgcattagcttataaacactctgggggcaaatttccacgtacagagctactcaccagagtaacagtgtgcacagaaggtcttctgtcaacattgctagtcagtactttttatcccctttgctgtgtaaacttctctgcatcatgggttttaaattgaaaataacttttgttttcctcattatattgtctgttacatcaacatttgacaaaaggattgtctgctacatgccgtgattgtctcagtgggcttgcaaaactcagacgtgacctcatggttatgtgcagtttgttgatcaagtgaccatattctgctccaaagtgttgccaggcactttctgtgattcatcatatttcagccagaattggaattacagtatggctgtctctatcgtctttccatcatcacctcccacatgaggtgcctttggaaccccacagcaggccattccgttctcccgttggctttgtcaggagagagggggatgaacagcctgtgccttatcccctccccttgttcctcaccagacacggtgattttgtagtccttacccctttcctcctcatggcaagccccaagaatgcattcctcctgcaccttcccacctggctccagatttgtccaccctatggcaaggctcttccacatgatgacatcacccttctcccttctctcttgccctatatagacttacagcctttctccatcagctaattctactggagctcggctctaagctcagtgctgaccaaggtcattttgcacagtgaagtcagtgccatccttgagctcaggtgctggcaatggcacggtccacgctgaatgtgttgttaaactgttggcttgggtggcagatgaggtactgctctactattgtgttgtgctagtgggtataagccagcagtcaggagaaagtacctagtacttgtctatatgtgctagtcatatccaaattttaggttcttacagtgggcgaaaccagggatatttacagttttctgaaggcactctttttgtgctcataggaaagtgtgaattctaagcttatagaaccttcctgccctaaacctcaggggaaatgtctatcaagcctcatcaacatcaacactccttccttgcccagtgtccaagtttcccagtgcctcacttgcattagagccctgagccttctaattatgctagccccacttacagaggagcatacagtcacacttcaggtccaggatctcattattcttaggccccaggcttctgatgctccctgtcaccttgcttgtatgctggggctggtgttctgcaccacatgtaattggcagcttgggataggcaatgaacctgacaatgagaggacaaaggcttcaggcacctgaaatgtacaagaggaatcttccaggaccttggagtacttcagtaagaaattgcttttctgaatcttttcttctcttttctttacttttcttttctctttttcttcttcttcttcttcttcttcttttttttttttttttttttttgagaccgagtttcgctcttgttgcccaggctggagtgcaatgggcacaatctgggctcaccacaacctccgcctcctgggttcaagcgattctcctgcctcagcctaccgagtagctgggattacaggcatacgccaccactcccggctaattttgtatttttagtagagacggggtttctctatgttggtcaggctggtcttgaactcccaacctcaagtgatcttcccgcctcggcctcccaaagtgttgggattacaggcgtgtgccaccatgcctggcccgagatattgctcttctaaagcccttcctgaaaagactttactgcagtcactttgtagaaagcacatattcctccattacggtcagtaagcaaatagttattaagtacatactaagtgtgaaacatttttctggctctacaggagacatttgcgaataagatggagtccttgtcctcacaaagctcacagtggcgtgggagtggcagaagggcaacataaatgcataaatgagcgaacggttaatttttgatactgctgagtgttaaggaagtgttgtgaagcagtattttggtctagaatgaactctaaggaggtgacatttttagtgagacctggatggtaatgaaaaagcagtcagtcatctgttgacccagggttggatgttgcaaacacaaagaccgtcacgtgttaacatcctgcagtgggaatgatgttcctctgtttgcaagtcagaaaaaaaggccagtgctgctggaatagatgcagcaggtgagagtggggagagatgaggacatgtgtataaaatgagaggccctttgggcattattttaaattgaatgggaagccactatagtttttcttataggtggttgaatgacatggaaacacttcttgacttttactctcaatcctctccttctataacatcattttcactcaattttctttctcttgcttcttttatttacaacccagcccaattcaccaattcctgagaaatggtttggctgacgtttgttggtaagaaccaaaggagtcattgtgttttctttggagacatatctgtggtcattctttttttagctagttgaaaacagtgggtggtctgtcagtttctaaatatatgtatgtttctcccatgtgtgagaattatttttaggacttcattaccatgaaggtgaggttttgtttaagttttgtttgggatctttcttttgtttaaaggaatcagttgtttggagtccatgaatgtcagcaggagattaatttgtgaataaaatttaaagtgttgaccttgtcatgtggttaattcacaggcagctgccagcagctggtgtcaatcagggtatgcctgctaaaattttattaagcacgagagtgttctcaatagagggcttaaaactatgtaatccattgtgcttactgctttcataatccatctaattgtccttgaagcttccaagctgtagggtttggcttcactgataattttatggtcacattaataattgggctgcagcatctgaatatgttctccaaatagagatgaaacagataagttatttctacaggacagggaacacagagtgctgttatggaatttccctattttttccttctcaacttggaaacacatcagaaaacagtactttgaatgattctctatattgccattgccataaggaagaacaacctaaaaactttaaactgctagagcagattcttctccagtgacagtagggctggagatcttttgtagattagaagtttagagaggagaaagcttaggttattgatgtaaaacctgcagtggaagaacatttggatcacaaattataaattttctgtcttgcagattaattgctacctttgtaaagcactcttcccttttgctttgaggagcctgtattatatatacataggcttgtaactccatgcgtgatacaatacctggtaccttctgggcgttcagttaatgttgatgtagccaagtcatagagtccatatttgtattttcataagtccagaataacacacttacctatttaaagaattccaactgagtgtggacaaaaaccctgacaggtataaattgtgaaaagttctagtcttcatttttctccccatatgaactcctttgggtgctaatgataagcatgttcattgtaaatatggattttgtggcattcactatgtatcgtcccatggcagttagttgtaagtattctcttaacaatgcatatagcttggaaaacatcgcattcagcaccagggacagtgttaaaagtccaaggagctctctttttttggtgcttttgttttctgttctgttgaccctctagcctcccatccttctagaactgggttttatcccagggaccaatttggggaccctggacctctccttgcttgatgccttttgaacactccttggtcaaggtaggcttgcctgttagaggagcctggacatgaactgttaatagggaagctataagaacatagactctgcgacagtgcatgaaagagaaggtgatgctctgttagaaacagaagggatctggacaagccaattctacaaggtggtttttgtggagtccagtttttgagtcatttacatttctgttttgtagtgaaccacctttcttcacaggactttgctctactttaaagaaaggaaaataaacttggcttacagaacacagcgtggagctctagtcagggctacctctctgtaatggcctggacctctcaggtttagctcagcatgcagttccccagtttctctagctaccttatacctttataataatcggctctaattcttcagttgttactatcagcaattcctgaatgtataaataaatatatatacttgtatacttacaagtatataacatacctgaatttttttgtgtgtaaatacacacacatacatacctttgtaaatttattttcaaaagtagtgacaattcggggcatgcaggtcttcagttaatcctttttggaccaatagcaaaagagggaatatatgcacctttgtatatttattttaaaaactggtgacaatttggggtatacgtgttttcagttattccttttacggaccgttggcaaaagagggcatcacgggtagacatttgaaaagaaacaaagaagggcaggcccatggcagagctggtgctgcagtttttgtgacaccactgcaggaatgataaaggaggagggtggctgccggcctcagcctgagagccgcaccatggccacgtcctgggtggcagggactccgaggagcagggcacgggagggctggacggcatctgctctttcatgctgacaccacagggagatctaagtcagcagggccctgggtgttaggaagggtgttgagaaatgtcagagaaagatcactgcaagctttcttcccggccacatatccaagctctgcttagtgtctccgagaccttgaagatggggcctgagaggcaggactaacaactctgaggcaatcataacaaaacatgaattgtttggttaaaaggtcaggaaagaaaaaaaaaaaaaagtctctcactgtgctgtcattagaagcaaagaccgagaaagtgacaagcatctcctagaggaatggttagcaagtggaaactaattttacagtacctaatagtaattacagtactagtattgggttattggattgatgtaaatgtgctgtttttactgccatagtctcacaacactgtttccttcataagatcttaaattctcaatggaaagttctcttctcacattcctgggtgactggatggggcatttgtgtgtgcctggtctggttgcagagttcagcagcatgctgtgggcccctccctggaagatgtgttcagtactcagtgcaggggagggcaagtgacccagttgttgatttgctgctcttttaaatgccttgttaattttcagccagttcagagcttctagcatgtcagggagcagcacgttggatagtgctgaaatcaaagcatgaccttctaagtgtggtcttcaaaatgttcattacatagggtatggcaattgtcacactgaatcaattcagaggctgtatcctaggtttacctgtatggaccttagctagagatggtggttgttgcagatataaaaaaggcatggtctctgctctcaaagaaaatgtttttgccgttaatttattctcttaagtttgatctctcttgttctttcagttttcttactggatgcaacaaccgtttttttcttctgcattcttacccaggtttgtgcactagctgtctcttctcgataactaagccatcatttatgtcagcatcttgaagggctttttcacttaatagtctcaaagtgacattaattagaggcataaaatgataccaccactattgctgggagaaattaagtttcaaaaagtagtaaaggcactgttttcagtgattccctcctatgtttgagagccactctgagcagtagatttggcttgtttctgaatctaaggtctcaccaggagtttgccagattatgccccggacatgtacttattttagatgtcagctgtttacagctaaagtggatttagacttcaccatatactcatggaaacgcaagtacattgtcttagcatttgagctgttaaatgctagaatttgagggaacagccaatttatggttgctaaaagaatatgaagttgattttcataaccaactcccaggatcaccccttcattagtcaaaggcggtactggcttttggtgatggtttgtctgttccctttttcccagtagctgataggacccatctgtcagccagcatccaacttgctgaagtgaggctgagcagttatgagatccttgctggccttggatctccaagtagacaaagtaagttgttagtggtaaaaactgaagttgcaatttgaagagcacaaattgtgaccctccatactggcaaggctgtttggagtactgcctctgttctcccctgcttttgggatgtcgaacaggggtgagtgttgacacctctccagctgcccggctgccaccttttgagagttctgctggagcagctgttctttacggatcctttggctggctctcccccactctcctcgcctctgctccatttcctctgccagaacacctgtcttgccatgttgtcatggcaggctaatctttctttgttcgccagtcacagaggagatggcaagaaagatctgtgggtacatggaatgatgaatgaaggaacaaatgaaaaaatataattgagaaggtgtctttgtctcagatctatgggggttggattgacccctgttccagagaaacttagcagctttttcctgacagttaagtaaaactctggaaaactgtctcccatgttttctgctcaggacgttgatgatgggacaggcagtgtctgtggtagagttactttaatataaccaccactcatgggtttcgagaacgttaatgcgatttgatattgtctgattggtttctcttttctccagctctttcgcctgcagatatatgtcaggtggtaaagctgatcccattagctctcagtattctccatttgtctagaatgtctttctggggaagggcaaatacttctttttcagacacccgtgtaatctccctgaatatgaacatgcattttctatagtgtttcttgtatacagttgtgtcccaattgattagtttaagggagatctatttttgtcatcccatgtgagaacttggaagtaatatatctctaagaacatgatagttagatctgatagcattctaatgctgaatctccatatagattaaaggattttgagggctaccctggcaacctcaacacaaattacttagcaatgatgtttggagcacagctaattcagaagttgagttgggtctgtcttcatcccatttctctttaccttactttttttccatggtagggcaaagttctcagaatcacacacatcccattcccctaaagccaggaatcgagatttaaaccctggaaggatcacctgtacatgtaaactccatgtggtctcatttaacatgtcaggataattttcaacaagcctagttatttctacttagtgttctaatcatagactttaatggactttgctacaaaggagccgacataacgagccggcctccccaggcctgccagtcccagttcatctggggcttgctgtgtgtcagcactgtgcatggcctgtgctggggaacagttgcttggaagaataaaacacaggtctcgcccccagacacttaaaatccagaagacctttgtttccaaaatgaaggaattcttgatgggttaaggaagcagagtcacagaaccctgaacagtagcactccttccatgggactgttctaacccgcatgcaaacctgcatccttggtccgggcccggcttctctcttccctccggggcagcacagcacatcctcagtgcagcactcccagcaccttgtttgtggctctcttgcagaccatgccactgtggaatctgatgatcagatgcactttctctgtcctatgggactgggcattttgctggctgggaacatgtctttgttcctcttcacaatcctagctgatagcttggtgacttctgcagatcggggcttgaggtgcatcagcaatgcctggtcctttcatgcccagtgaaagtcagtttccttcccacctctccctccctccctgcttgagacttctccgccacatttatcgccatggagtataccgggagctgtagctatttcgctttccctgtctccctccacgagaaggtcaacacaatgtgggcagaggtttttgtctgttcccgggcgggcaaactttcagtgcccacctcagggccagaagtagagtagatgactgagaaatatcttttgaataatgcttgagtgaatgaatgaatgagtgaatgaatgaggagtctgtgtgagtgcccttttgggtgaactgataacatgcccttttgcttctgaaagggaaaataggactctcacaattttgtgatgcgtctgtctaaatagtattcatattagcccattttaaatttcctcaaacaagtagaaaaaagatcagtcgtcttctgcttccgacacccagttttgaaaataaatagcttagtcttgcacctaaaccaggcccacttccgtgtctggataaagccttcctttttttttttttttttttgccctgaagcaatcctggtggacgtgttccaggaagaaacacccttaatgaactcagtggctttctttcgatggtgtggacaaattaacttttattggcctcgcagctccccagatgtggtgacactataattctggggaggctctggctgttagggaagttttaatgcttgttttcattatcaagaattaaagggtaacaatgctggtggatcgtggcaaagcatcacagttagcagggagattccaacctgggtggcgtcccaggggacgcaggggtcagccgggctccctctcctctctttctcccttggccctttgtcttccctgtcatttgcctcctttttttttttttttttttttttttttttttttttttttttgagacagagtcctgctctgtcacccaggctggagtgcagaggtgcgatctgggctcactgcaaactccacctcccaggttcaagtgattctcctccctcagcctcttgagcagctgagattacaggtgcccgccaccacaccccactaatttttgtatttttgtagacacgggatttcaccatgttggccaggctggtctcaaactcctgacctcaggtgatccacccgcctcggcctcccagagtgttgggattacaggcgtgagccactgctcccggccctgcctccttgtttttgttgctcctctctgtagccctgtcccagcaacttgtatgcttcctttttcacagagccatcatgcatgatgaagaaaatggaatgcatcagtattttatagacattattattgtcagaaatacatgcagatttggacagggacaaatacagagatgaacactattattaaggcaggactttttattttttagctttagtgccttttaatcatattttcataatataaaatcataacataaatatcaggaaagctagtaattattattttgtgtgtggactgcctggctatattataaacagggcaaagcttacattttccttccttcattcatgcagtcagggaaatactaagttgcaaaatgatgacaatgatacaaacaagtcatttggcccagaaggcaccaggagcagctattaataaggaaaacaactttttccagctgaggccgagttgattaacttattttcctggaggagagataaagcttaagctataatttattgaaaattaatgaaaatgaattttggtggcactggctatcaaactagaatgaaaataagaatgtgagtatactgtattaaaccaaattttccttcaggactcccatatttcttcagctcttgtactgtcacagaggttcgaatttgaaagcattaatgttgtcattttttgccagtggttctgatggtaaatatccacagagtcttttatctttaatttcttttgatgtgtgtttttagatcaagcttagttagcaatttttaatgagaacttatacatcttggagctttagtgctttgtttcaaaagcctgaccttgcatttgctttttaaacaaatgtctcagagctcttgttgccaaagactaaaatcttgaaattttggtgtgatcatttataaatttcttgatgtccagttatgagactttgctagggggataacctagtgctgtaaccaatgacatactgatagaaaaaactttactgcctttttggttgaaggatgctcgttgttagatcattttttcccccaggatctcaattttcatgaatgttctttccagcctatctttaaggtttatttttatattgcattgcaaacaatgcagtatcaaatgtttgttgttcacatggatgtggacatcaatatgaggaaggaagagccagacaggcatgtgacggtcctctgaaggaccactgatattacaaatggcctgtgaactgggttcccaggcaggttcctcaaggagagacgttgcatcctggcacccagatccctggacttaaagatcaatggccttgatttgtctgaaattacttcacagagaggattcctgttaatgattacagatccttcccaatacactttatttatgggaccctctcaatgaggggatctctgctgtctctagcaccggaaagatgctttctccagaagatgaattggcatgaaccctaccaggcctgggagggtaggagcttctgtagccttttcaagtaaaagggaaaatccagacttgcattagcaaaaaaattaaaaaatttaaaaaatgcctgcattttcttatttatttatttattttctgagacggagtctcgctctgtagcgtaggctggagtgcaggggcacaatctcggctcactgcaagctctgcctcccgggctcactccattctcctgcctcagccccccaagtagctgggactacaggtgcctgccactacgcccagctaattttttttatttttagtagagacagggtttcaccgtgttaggcaggatggtctcgatctcctgacctcgtgatccacccacctcggcctcccaaagtgctgggattacaggcgtgagccaccgcgcccggcccaaaaaaatgcctgcattttcattagttcatgttggttccccattttcaggggagagagaagatgagtgggccggtctgacagcccagatgtgaattctggcattaacatgtcttaccagctttttgaccttggagaaggtactgagcatatccaagctctagcttcctcatggagggcattcccaccttggattgttactctaaagattaaagaagataataccaaatggctggcacattgtaggtgcccaaaataggtgacctctgtaggtcatctgtatggggattctcatttcactagaacgctccctcagctccagtgggaaatagagctcaaaccatttttgcatagcttagcaggaattgcatggagtttttaaaattatttgaaaattagaacttgcatttcattttttttttaaatccaaattctgggacacaaatccataaattccataaatgttcatgccatgccttgaattgctcattttatctgcaaatgggctgtctggattgcctagtggctcggtggtgaggcttttattcacctaccaacttaaaaggctgaggaggtatttgaaatctattttggcattctgcacaggaagattatttaaattacattttcatgtatgtgtgatacctacatgaagcccaaagcaagaatttgaaatgtgttttatattctttcaaatatattttgctttatttttcatattagagatggaaagccttattattttttaagaacttaaaagtagtgtttacaaagttatataaatataagctataaaaaaggcttgctgtgaccctgtgaattaaatgaagaaaatgatagaaagaatatgaaatgtgcttcccatttcaaaatttcaaagaaatgataacttatatttggggtttcgaacttgaatattctattgcaaataaataaaagccattagtttcaacagaaaaagaaaagaaaatggcttccctgaaaacaattcaaaggattgcaaccttgcaggacagagaccaactctagcatttgtagtactgggagagataaggaattgatgaagtgtcaagaggaaaaagaaaacagaacagtgggatcattgcacacttttattgatggagatctgcagcgaggttcccccccgccccgaaacttttatgagtattataaggcagtggctgaaattgtgatgttctcagacatctctatagaatatgttcttggagcagaaaggagcctctagggcctctcctctcatttggaccatgttcctttcatatcaaaaaatgtagctcagaggctaggccagggtgaactaaaacaaaatccaggtctcctgacgctacatcagctcccctgcccgtgacaccaaatgaactggtcctgtccttttctctggaaaccaccaagacaaagcttcatgtctccatttagtgatcctcaccaccaccccccatccccaaaatacaccaccctgtaaaataaagcaagaaaatctcttccctgtgttcaagctcctcccctggcttcacctccctgaatcttagcacttggagggttgcttcccagtagcaaagtaacctcaaaggtagtaacttactgagtgcaaacatagcctgaggactgagaccctctttgtccataattcatttcatctccaagagaagcccaagaggcaggtattctcagctgtttgttacagagaaaagctgaggtccagaggggttaataagcctgtgcacgcaggtcaggagagggaaggtcagcatctcaggacctgcagagtggagagcctggtcaccccaccctatccctctcctgaatctcactctggaaaaatggaagaaccaagtgcatgggaggctgacctcagccagctggctggaatgatttaaaatgttttgggttatgataaatgtggagagagacatcgaaactgatttatcaagaatattagaaaatgaagtgctgacatttccatgccattcaaatagggagtgctaaggcacaggagagcatttggcagcaacaacctttttgcttctgatctcagctcagcgctgctttctctctgctgctcacaatgccctgcttttctgtgatgcatctggccagagccagggaacacggcactcagtattccagagaagagccacaagatcattttcaggactgcagaggctgttgagagactgtctaatgtcacccacctcctctcctcaaaattgggccattctcagctaaccaggtggaagactttgatctctattaagtgggtaggttttggcaagaacaacctaatcatcctgctagagagtgcatagccaaattgggatgggatcacctcactgtgcccagctttccccttggctcttggaggggtgagcctgggaagccaggaaatcagactctaagcccacaccttcgtgattcctcagcgtttatgcacagctgctgcagcggtgcacaattttccatgtgggttctttctgctctgtaacttaaatagtccccttatgcttcctctgtaattgtgatgcagtatttattctgtttgggcattggtaattagagcaaattcagagatttcttatcccctgacaggtctctctgattctgagtgatttgtcaatatgaggacataagatacagcaagtatatcatttctacccatctagcatcaatattctaggttaacgcaagtcacatcacgcaaacatgttctgtgatggctttttatttctgctgctgggagaatgagacctttttcatgtttccaagagatgctgtcatatacattatacatacatattaggtatatgtgtgtcatacacacacagagttccaaagcaggaccccaggttgtatgggctgatgaacaattaagcgtatatttgaacagcctgaatgccgatgaactgtgaacccctcaaaggctgggcccgaattcctttgactctcacatcccctcattgcctggcacagtgtccatcacttcagtgatgtttggcagaaaccttctaaatgtgtgaatgaatgataggccggtgtgcttggcagtcacacaccttggactgcctgcacccatattctggcctgaacatttttagctgtatgaatatggtcactgtatttacaaaccatatatcaggagtccataacctatggcttgtggcccaaatctggctaccacctgtttttgtaaataaagttttattggaacacaagtatgcccattcatacagattctctgtgggtgctttcaggatacaatggcagagttgaatcattgtgacaaagactggctgtcaatatgtatttactatttggccctttgcagaaaagtttgctgacctctgccatgtaggagctgaccctgagcccctgcagtaaacacagatgtccatgagactaagtccttacctcttaagtatgtgtatgtgcacatgaccttccattacttgttggctattcattgtttttggtaaagttgagcaaaccttggtacaggataccacacttcgtctgtattaactcgttccatccctcagctctttcttcctctctcccttgtcttgaacaccaccgtaagcggcaccctcacagagcccctgaactcagggggttcctttagcttctttttttaccactgtgtgcccgagacttgggagagctggcctcacaccaccaagaaaccaccctttctcaatgaggatgaacagaacccctgctgacagggaactgcccccatgatggggtggcagggatgatgggaggtgataaatgactgggtttgccacccttcctgcaaggtactagactctttgggttggtgtgttacttaggattttctgtttttaatcatactcttgcctttgctctgaattagtaaagtcacaaagccccgaagcctcagggtcttatcactacctgctggtcatgtttaagggcctggggtcctcttgctctctccccctaccccaagcctgcaggtaacacccagcaaatgctgagggaggcctggcccatagaagaatctgcttcactctgggcagtgacagattctgatcatgtgcttgatatcctcaagtaaagcttctcacgatcatttctggtcttctccaaatagcagagtatcattaggctgtcaccagccaatggacacttcaagagactaaatgtttggcgtaggaaatctaagaggcaaagagcgctgtcggggttgccacactgtagttgctggtgagtttacccaatgagccaccaagacctacaccccattggtctgaggatctcctgcccaggaatcccatagctgctacagtgaattagcactgttctaataattgattgggttttttaaatccactgtcccatttgccttgttcttagccttcaatgactcccattagtgacttatttaggtagcctgtgtgaccctgaacttccccagaagacacaagcataatactaagagctctgaaataagcaggataattcttggcattcatgcaagcccgcactgcataaagcagagtgattttagtgaattgccccagtgttttacaagggactaaaaggcgtgattttgcatactttttgcacatctaacctacttgcagaattcatcccactgaaatgctcgtaacaggatatgtcctttattcagcgccaactgtgtgctggttataagtgggagctttgtagatactgtatttcagtgtctaccacccctagttgatttcagacaaaattgaagctcacagaggttaacctgtctcagccataaacattctctgccgaagccatttggaaatctacataagcaaatgaaaataatgaaggagagtctcttacgaaaaataatttggaagctactgagagcggttgtagccagtgacacagaaattcctgcacaggttaagaactacagggaagcacttgcctgacaaactcaatagtgaaaagaagtcctattaaagagattttacaataaacatgttctaagaaacatacattgcccagggccatcagcgggattcaaagaatactggcttcccaaggagcaggcccatgacccctttgggccaggtcagaccttaagtatagtgtggaaatgtgggggcaagatttgtcacttgcattcaaactcatgggctccgaggtgcctgccctcactaggactcttctgaatgcagatgaaattctgttggaagcccctgtatgctttattggggtggcaagtggggagaggaactgactttccccagcttcaagagtgttctccagctcctgatttgtaggctttagaatattttccaagaaaagttccattgattttatttttatttttttgagatggagtctcgctctgttgcccaggctggagtgcagtggtgtgatcttggcccactgcaacctccacctcccgggttcaagcaattctcctgcctcagcctctggaggagctaggattacaggtgcccgccaccacgcccgactaatgtttgtattttttagtagagacgggatttcaccatgttggccagactggtctcaaactcctgacctcaagtgatccactcgccttggcctcccaaagtgctgggattacaggcatgatccaccgtgcccggcctccactgatattttaacttggtcatttgagttcattgtcgtatcatataataactatgtatcagtgtacacagagtgcattttcctgttttctttttttgtttgtttgtttttttaaaccatgagatgcaactaaaataccagcttcccagttcagatctggtacataaagtaagccctgtgaatccctcgttctaaagtcctagaacttgcccttcaagggattggttgggtgctgagtggagcagagtgttacatttttaggatttcatgagattgaaattggccacggtagcagtatttacaccatggaaatcagcagatgctacttcccttccctccagagcctgttgttccagatgtcccagcccagtgctggctgccactgctcacagctgtcactcctgggactctgtgctgtacccagggtctgggaagggatggagaatgagcttgcatcttatctgcctgtctctgaggctgcagtcctctcctatgttctgacatggagaagacgggtgggaaatttgaatttcagccaaattaatgaccctggggcattgagcaagagggggccccataaggtggccttgaattttggagcccataaggtggcacttgattctttgctatctgagtccagagggctctgagagagaggaagtgaatgttcccaggaacacaacagagacctgcctttctaccttccaccgtgagcttgtgctggcagcaactgaactaggattgattttaaagtaaaaccatcctttgtcttgatttaaggtgcccaagtcctcagatgcttaagaaccaggcactgtgccatgttctgggataccggagtgaatgacatttcgtgatgatggaaatgttccgtagctgcactgtcttatgtatgtggctatcgagcatttgaaatgtgactgctgtgactgtgaagtttcaattgtcattgagtttgaatttcaatagccacgtgcagctagtggccactgtattggatagagcagctccagagtttcagggacagtcttgtgtggcagcctgtgtgccgggcatataggggatgcattcatcacattggacgcccacaagaccactaagtcctccccagacccctgctccagcattgctggccagcaagatcaacactcatgccactagtggacatctacccattcagacacacctgccactaggctgaacacattagaaggtcaccccatgtcattccatcccctgtctgcaggacagacagtgatctcaacttacaggtgaagaaagaaggcacagagacatacagcccttgcccaagccctcagtgccagattcctacccagacatatcttagtaaactgagaaccacactgctagatggatggcatctcagagaaccctgaggatcttatttaaagcaatcttccatacttgttctaagaggagtgtaagaaggcgctcccatatatcgtacggttttcctttcttgtgttcgtgggtgttcagccctctcaggttcttctttgggcacacactcctgtgagtatgcacattagtgtacatatttcattttacaccatttggtgaactttatttcaccaaagatgttggcatctttctcttttgctgtctggtttaattcactaccaactatatcaacatcagtgactgggtcaatgtttgaccttttaatttttttgcaggaatgtggactactgatcagtaaatcactggtctcccccaccccacgcctgatgagtgttgcttttggatctgtactgatggaaatgggatgaaaatggagatgtaaacccaagactgaacaaggccttttggaaatgttatatggtgttagattacctatgaatctactgttaagatttttgtacatttggctggcagttctttttgcttaagagcatcaagctgtagacaggcctcctgcaccaagctggagcagccagagcccagggcaggacctgccccagcctctccactgctggagctgggcctttcacctcagcctccaccttaaggcaggaggtgtttcctccccattctttgcagtcagcaaactgtctaactcagccacagcaatcctcttaaggaaactttgtgcccaggtggttttctgtcctggaaatacattacttggcttatttcaggctggcttctagcttgctaaacccagggctcagggctcgcagagtgaagggtgcacatcacatgaggcaacagggcgctgcctccgatgttacctccagtacacaggctagcaggaacacagacactttcaaggggcaatgggcaagagaggtctcggcaatccaggcgaagtccgataacccccagacccagagtagaacaggctgctttgtatcagctgagcacatgccggcctgtaggaggcttccgcactggggagctcaagaactaaaaccccacctttaggtcatttgtttttaaagatgctgctgcacagtttaaacttcaaaacatgaagtgcaagatggtcttatcaacgcaataaagtactggccgtgaagttagtatcattctttctgcagccccactggacacatagggcagcccgtggggaagggcatctgtctcctaatcatatacagtcaggactggtctcacaatgcccattgcttctttgggttccaggtacagaatggaaaacacactgtctatgatgtaaagccttgtacagtcctgaataccaatattatttcaattatttattataagcaagtcagcatttacttttccaaatgtcacatgaaatttcctttctcttcctaatacgattcctaagaggcctgtggcctcttctcttcctgattctcttcttatttagaatagatattttggactggcatatgttgttatacattatcaatatcataaacctttagccctagcagaataaaaggaaaggtctatcaattcattctaagcataggtatggtttgaattcaaggccagaaagatgaacattaaccagaaagcgtatcgtgcaggatgcagtgacgtctagtatcataaaataatctgcgaccccttggagctcgccacgcccttagactatgacctgtttacggaaatgctggctttagtctcattacagacttgggtttggggctacagatggactctgtggtgatcagcctgcatagcttcctaagacatgggtgaacatacatacccttcccgatgggcctctcctttttccaactcctgaatgacccccaagagcactttgatggtttcttggcttgaactgatcaagttctccatcatctgaagttgtgctttgaggtcgaccacttccgtatgaggcacgattcgttggcattcttcacctgcagcaaccgctgtgggactaggctggttccccagccccggcggggtgtgagtctgcgacggctgctcactacattcgggggacaggcactgcatcgggggtgagcaggccagggcagtttccgagggcgcctggagcccgttgagatgtgtggctctcctccgctcgtcatctgccgggcagagtgaccactggctggcggctgcagagtctgacaaaccaggctcgggggccctggcactgagggcaggtgcgtaaacggtggcaacctccgttttaaacaccctcctgagggcaggtggagcgggctcctcggagtttggcctcccccggtcctgcttggccctcccgagcagctggtaatcgggctcttcggatggaggccgagtggagttttggagcgcagcttctccatagctgagcggctccgggcttttacagggctctgtgcagttgacccccaaaggctggtccactgtgttcatgtgttggttggaatggaaaaccaaggctgtggtcttgtgcacccgccccgcgccacatggccgggcctcctccatgggtccagcctcgttcttctctttcgcatctgttagaaacccattgttttggcttttaaagggatctgcagctgggaggcttttgaggttcccctttttgcggtccagagggaacgtctggtaacacttcttaaggtcgggcgaggtctgcacgcctgtgctcttggtgacgttggggatggacctgcgtgcgggcactgtcatgtatttgcggtaggctgctctgcaggacacgggcttggcctcccgcttctcccccagctggcccgaggacagctgtgtgtccctctgctcattctgtgcctcgcagatatccttaaaccgcacctgcagggctttgttccgttttttaatctgccggttggggtccagggcgtatttcatctccagggccaggcaggcggcgggttccacttcactctccgatgttgtgagtatgcatttgccggtgtccttactgaccatggttcctgcattcagaaacagcaacagaggtgtcagtgggacagaaatacacattcgagcaccggccgcacaaacttttagccaccacgacgactgcctgtttcctaattatatttaagcaggtgaggtcggcctttatgttaaggaaaatcacacgggctgagagtcgctggcagcacagcttgaaatgcttctcagatattaaagcctgcttgcttttccaggtgggatacactcgctttccttttgacagtaatgcatgtttccccattagacaaacctgttttactacattcatcaagaaacccaatgatgctgcctcttctgctttgcaaattatcttttcacacgcgtgactccccttcttaggcagatggtttaccaagtgctacttatttggtttgcgttttgactattttttgaggatgacgtcattaatctattgctggaatctgggagagctgctgttttaaagacttactggagctgccacgtctcgagcagataaatgtggagagccctccgaggaggaacggaaagaaatctatttgcgtgagccgttatggattccgggggagagttggccgtgctcctggatgggaaccgtgaaggagaagtcgtcgaggggtggtcgcttctcatgggttaacatcagctctaaaaggaacgtgggtttccctgcatctacaaaggccatgtttgcaactccttttattccatggagagtggtactggaaaataattcttaaaaaaaaaaataaaagaaattactcattctagaatcaagttttgtgttgtgatcacaacctccgaaaatgaaaacaatggtggtggtttcagtacttaaattctgaaagcaaataaaactatgaggctttatgttaatcatgcaaattcatcctgggctgaattattaaatgcagctaaaaagatgcaggtggccaatgactcctctcggggaataccagtggggtaaaatgccttcactttattaggcggattcacagctgtttattgcacatggaagaacttatttgatggctgcgcttaaagcaagaaaatagagttaagtgtgttgtttgtgagtgaggcttcgccttttccccccttgtgtttgagaagaaaacagtcaaacggaaggcactgagggtgtacggggcccgagtggctggagctgagtgcccagagaggcaaggtcatggacatgggcccgtgagagctgcacagaaacagacttcgtccacattgcccccagcccagctgccgaccttgtgccctgtcctgggggtgtctgaaaaaccagcccagagacctgtggcagcactcattggaaaatgccacaagaactatgacatgcgcagcatggccactgcttctggagtgaggtggttcgagtgccagatgctctgctcgttcacatacagaatgccttgcttacaaatgttcctgaaggtcaaggctacacttcccatttcaaggaggatactagggttcagagatgttgcgtcatttttcggtgtcacacaggaaataagcagcgcaggcaggagcaggaccctactttagtggaccgctgaatccatgctgttctcatagacccagctgtccaacagacagaggcatgacccctccccacatccttagcccttactgagttagcatgacaggccgaggtgcacggtggttccataagggggaagaagagacaacttcacagccaccatctaaaagtaagtgacatgactagccctctattaaaatgacctctatgtctcaggccagcctggtcttgtcaccttgctggcctccactgctgttcactggatgaaagagtgaaggaatcaaattcttcatacattatgctatgaacaactaacaggtaatcatgtgtaagaacaacaaaaaacaatctctgcagcatttgatttaggtgggaccagagtttctaaatcctggcactactggtatttcaggatggatcatttgctgttggaggggctttgctgtgcggtgcagggtggtcagcagtccctggcttctccccactgaagaagtagcaccgctccctcccagtgtgacaactagaaatgtctccagccattaccagatgagcctgggagcagagtcttgcctggcagagaaccactgcattagcccttgcacctctggatgcctcgggctcttgttcgattatcctatagtgtgtcctgaaaggtgaggcttgcgtagacagcaaaggaagtccttggtgctttactaggtgctgggggtatttggagattgctgcaatttgaaacttgaaaaactgggcagttttagagaggagagaaaaggcaagaaacagactggagatgcaccaatatcttggccccgtttgggatggctagatgataggtggaaggagggacaaggcgtgcctgctcaggagaaagcatcgatggcttttagagattcttatcccagcaggttaaacagatgcacacaagacagcttggtgtgggggacagtatgggtagcagtgggggtggaataagaaaattaaatcttaaccttcactctgatctcctattcattctttaactgcctttgttgtccaggtatgtcagaatgtattgtgccatcattctgcagaagaccttcatactagggaaaatttgaaagagagagcatttttacaaaaagcaatttactagtaatttatcagccttttccctgctacttctgaaaaatgtgtgtctgaataagtttgtcctgccatgctattcatcatcaccatttgctagggactgcactgaaataattttcttacatcagttggctggggtaagaaatattctaggtcttggacgcaaccatcaaactaatacaacaaatcagaagaattaattgctggtggccaaataataataaaaaattctaagctcttctctgttttatagagggttgctggtacataaaaatcatttcgttgttagtaaaaaaatgatggtaatacttaggatttttaatcactttagtttgttattgctgacttaaaaaacagtaatagtaattgagttcttattctctgatagggaaaacaccaaggaatttttgtggctggtttattttggcttcaaatgaggttatgagttctttctgacggctggatgacattttctaaagctttaaaattgaatttctggacattaagaattactaaggtggacacatcttttcggggtgttcatttgctctttattgggggtggagggtaaggcttacagtgattaccattaagaaaatgattttgttatgaaaggaaatggggcattctacagaggactttccctaagacaagtggaaccttctcccacactatttcattcatcattccttcatgcatttattcagcaagtgaatgtacatacgttacagtgtagcattaacattcagtaagcatgcagttaagtgctcctatgtgctaatcaaatgtcaccattcccctatgcatagcagttgtgttttctagatttgatcctcatcatatccttacaaggcagccactattgataccctcatactgcagattgagaaaccgaggcacacgattttgggattttttgcaacttgctcagagtgaggaggctagtgggccacacccattgaaacagctgaatccgtttgaatcacatgccctaacccactacccctgctcaaggaactctgtaacttgaagtgatccatgataaacttgaaaacatcaaacaactgaaactcatctgagcaatgcccttgtcttgttcccacagtgtatctgggtgctggttaggcaaggacatccaggtagttccggtaacacagtgggtgttggagcactgagtgaatgttgccttgaattctggactgagcatgaagctgcaataggattcttcatgatggcttgccttggctgggtcaccctagagaaccatggactctggtttggggagctgatctcttggctctaaagcagcaggagttcataaagtttatttttcgtaagaaaattgtgttttagaattcattggactgtgctgtcttgaggtgaaaatggctagtcatggttgtgcctgtttggctcgagagagctagatgtcgaggagctgtttggaatataaatgtcttaattaccctcaaattaaatttcataatcaaagtgagctgtaaatacataaaccctgcatttttagattagtgacggagaaccatctctgcatgctgctttaaattaatggctgatatgaaaatgtgcattccaacttaaataagtgaaaaatggaagcaacttaatggctaacaataggtaaacagttaagtaaattatggtttacattcactctgggcggccattaaaaggataattatagagattatttagtatcatagaaaaacacgaaataatgttaagtgaaacaaagcagtctacaaattatactggaaaaaaatgaacaaaaacggtcatcgttgtggtattaagatagcacattcggagagatttatttttccttctgttttccaatttggggagaatggagggaggtacagcgtcgttctggttttgccaatgaaaataacacaaggtaaaatctaatccacacctgaagcaggcctctggaaggcataaccactagtatcagaataagaaaaacccagaaatgatgagatggggctataagtagtttgtcaaaggtcatcttttattgttttgagggagccctgataaagaatgaaaatgaatttcaagtgtgtatatgtatgtatatatgcataggtatatacgtgcctgcgtatgtatttggctatgtatagttaaatgtttagcagaagatatgtcaatatttgagcaaacgtactgtaaggaaggaagttagcatctgttttaattagaaataaaacagactcaatagtctgaaggcaattttgtggggttccattagctgccaagagaaactctccattggattctgtccattcttaaaatgtccgtgctgatttgcaggtttgcagtttgaccctgtgatgggatttgtgggggaagatgcaggcagctgccagtctgaccgagacacctcccagggcccagcagtctccgcatatagtaagatagctaggcaagcagtcagaggagtgccacaagggattgtatgaaattatgggttttcctagtggctttctcactgttcagacaccttggagtcaaagatgctggtggggattcaagatgaactgggtcagcattttcttccatatgccaagggggtgcctgaacatgaggctactcagaatgggagaatggtgaaaatgaacatcccattcttcaccaccggcttccaccggaaggggaggtaaaatagaacctcactcactaaatgaagtcactcacattgtgaaatagttaacttagagacctgtttcataggtgccaattgagtcttcagaactggaagtcctcttttccttggggcaaagccagctgccatagatggtggactgtgtcttagattcattatccggtttaattttctttatatagtgaaatgttattttttccctacatttgttgttttcagcagaggtcactgatgaggaccaaaaaggggtgactggatgaattcagacacccttgtgtgactgagcaatgcgtgaggaactgttttcttgcagaactatggctccttggaggaaacacggagatggcacgccccgttccctcgatgtgtagaatattgcagtgaaacctctgtcattaagaactgatgaccacctagtccaaagcagggaaaaggggcactcacagaggttaaatgtaggcatcgaggcagaagaaaacctatcttaggttcagcccccactcatgcatatctgcggttttagaaaacactcttaacgaacaaaaaaacctatggtcagttgctttagccacataatgtaaaccacaaaggctcacactggcctacttcggggagtgagaacaaaggagggcaagcatgcatgcttggggcttggtgcttggtgctcatgttttaaaagaaccagggaatggccctcttaaatggtccagacttttaatttatgtttcactacccagttctttgattttcagcttatgttgatgttaacctttgctcatcctgctacattcatagagatgaattaccaaaattttatgatgttggtgaaaatcaactggaaaatatgcctccttgaaatgagacattatgtcaatgtaaaaaaagttttatttgcagcagttagctatgccagctaataatggccaaaaggagttcagtacagttggttccaacaactcaccaaaatcacctgtgagattggtaaaaggaactaatttccctgcctccctgtttcccatcatcatgacagtgacagagtgtgagacaggagggctgtgctttgaacacagctcatgagtacctttagttacgatagcaggtgtcccactgaccctggaggcttcctggtgatgaagcaacaatcagctggtagtttggggcccatcagaggcgggagttggcaggacacagaagaggtggtctcccttttttagacttagtgggaatctcactcacatgaaaacacaaagatacatactagaatgtacttggggagtgctttgccttcctgattatgctgaatctttttttttttttttttttttttaactaaacagcatgttttgactcatgatttatctgaaactaaaactaggacattgattttttcccccctaaaaatgacttatatcaaaggagtctgttttccctgacacttcccagtcttatttgaggataccctattggaacaatcagggcaggatatctgcttggaggtaatggtcactacaatggaagtcatttagagttgaagatgcagtctgtctttctggcaaggccatgggaatgcccatcaactcgaccatcagaatggatccctcttgtattttcatcgtagtatgaaaatgccacaatgtttctttggtttggccaaatcctaaactttgcatggtcttcggttcactgcagaggtagctgtgccaggaagaaaaggagacttgagcatttcttgtaatgagcttctattcctaagctgatagccaaatgtagagaaaataacctgcacttggggtccatgtacacaatcctaaccgaagtctgcagaaagagttagtgcttgtaatcttctcggccctcatacagtttgcagttcatggcctagtctgaaaagactgtcttggtttgaatgagctattcattgcaagtgtgcacagagcgaaattttagcattcataacacaaaatgtcatttttgttggggggctggtgaagagaaaataaacaaaaggtctatatattgtatacttgaaactgtatattttattccttaaaaatctacctcttatcaatcctggtgttactctgccaggttagttggttgtttaatttttcccttgaccagcagctgttgtgaacctctgtcttctctgtgcatgataataagtagctactttttaaaaacatgaaaccatatccttccctcacaaagtttcatctaatgtcttcgaaggtttatctctttgtgcatgaaaaacttggcagtgtctctggtaatctggaggaggaggactcagtggtctttcttgggaagcagtctgacatgatgtaatgcctgagacccaagggtggcctggactcaacccagcaacacagctactgtgcttaccccagctgagcttggagcaaaagacaccccatgttaaaggcaggactggacttggtttgcattggggtcacgagacccatctccaacttagtagattctgtcagtatttttatgctgaaggcttccaacaagtgctgccaacggcttgctcaattcattccccccccagtctaatcccccaaatcagtcgtcaccatgccctattcgtttttgtttttccttcctgttgcttctcctactgatttcttccctttagttccacactgttcccaccctgatcttggccttcataactctcctgccctcagctctccattcccccatgccccacccccgtcccccatcctgcaggtcctgctagtcttggcttcaagtgcacacgtcgcttctctgtgcatatacctggatacatcccagttggtagcacttccaaagagtctcttattataagatcatctatactttttcctacctgctcatctttctagatttctcttggctactcagaaatgctccatctgctgacttccattaagccatttcctgcactgtctcctgaacacaccatggtcagtctctactttgtgtcttcacttccactggttcattttccaggaccgcgccctggtcctccttcctcatggatagtctgtgtttggtggtctagatctagtcttatcttctatgccttctccagtccttacctgtcaccttcatttactcactgaacagtgcatgcctggggtgacctaggcaccatactggatgctgggcacacaggaaaaaacaaggcatactctttggcagtgtctagtccagcaggagagagacacgttgatgcctgacaccagtccactgtgcacaagaccatgtaagaggagggaagtactgagagtgctccctggggagtcagggtaggctctacctgggagatgtgcaagagcaggcctgaaggatgctcactttgctttgctttgtgtcggttttctctccttaacacaaatataagtgttctgtggagtaggtccctctaagtcttcctcctatgctcagtcatccttctttacttactggtttaagaatcttaacactggccaggcacggtggctcatgcctgtaatcccagcactttgggaggctgaggtgggtggatcacaaggtcaggagatcaagaccatcctggccaacatggtgaatcccgtctctactaaaaatacaaaaattagctgggcgtggtgatgcgtgcctgtaatcccagctacttgggaggctgaggcaggagaatcgcttgaaccagggagtgggaggttgcagtgagccgagattgcaccactgcactccagcaagagaatcttaacactatacatcacagtatccttagagctgggaccttagctgagatacagcaagaagacttaggatgagtgtacaatattaatggcttccaaggagtctttttacattatctggatcctcacattaggtagaacctggctgtataatgaaacatgagtaggaattagagaagtggaaaggagaagggatagttttgttcgttgaggtaaaaccatatccagagatctttatcttctgaactttggcatgactaccttgagtggttgttgtacaaatgtttccggtgctgatgggagagaaggagatggcacacacactcacaaaaatgagtagatggcacagaaatggtacaggttctatatttaaccatgcagtatattggggccccatactgttgtagaaaatgtgacttgctaggaattatcagaaggtttgttcttatattactcaactttcttcttgggtactcccaagatatggtagtggcaaaataaattgagtttaattaaaaaatctcaatagcttggaataacaacgttttagagcatggcacctttcctaaactcagttgtctaatctgctctagaggatgaatcactggctttcagagggaaaaaaacaatagagggtctggggcatacccagggttctagtgacttccaagggtgtattagtccattctcacactgctatgaagaaatgcctgagactgggttatttataaaggacaggtgtttaacggactctccgttctgcattgctggggaggcctcaagaaacttaaaatcatggcagaaggcaaaggagaagcaggcaccttcttcacaaggctgcaggactgaatgagcgcaagcaggggaaatgccagacactagacatggtggtgcgtgcctgtaatcccagctacttgggaggctctccttaacacatccgatagacaaccatcagatctcctgcgatttcactcacaatcatgataacagcatgggagaaaccgcccccccgcccccccccatccagttacctccacccagttccacccttgacacatggggattatggagattacaattggaggtgagatttgggtggggacagagagccaaaccgtatcagaggggcataaacatatgaatgaaatagctttcattttcctgttctttagactgagaacaatgaatataaaattatactaaataaggaagcgcagtacttaggaatctcatgccacactgctgttgtccattgagatgaacgtggagaggaaggagaagggcaatggggatgtataaagagagagaggttgttaggggaacggtgagtcgagagaaatgcacagacaaacagacacatgcacacacagatacaggaggggaaggggatgtgtgctggaacataagtccaggtcagctgtgggacatctgtgggctgttccttgaatcaggcacatagagttttgatagccttcagccatgactcccagcgttttggttgctcttaaagggccagttgcagcaaccccatctcctgtccagaagggaacgtgacaattcaccccggggcaaaacaagagcccaggctcgggcaggcacccaaagcaggacatcatacagtttcctgttctatgaagcacccaacacataacacattaagtgttaaactcaatgaagagtcccattttcagcaaatattcctgcgtttgcctctatctttttatctctccagcacctccttggaacagatgccctgctactttacaaggcttgtggaaaagagaaagagaacagtagcaaaagcctgtgtagttcatgaatagaagttagcatcgtagtgagtaagcagtactgatgatctgtgaaatgattctctgtggacttgagcatgctaaaaagatcttgaaaaaggaaaacataaatctttccaaaacctcacatgacccctgtatgctttcgccttcttgaagctttggaggagagcataggtgtggatgaaatggagtcttttaaaagttgttttggtttttgtttttgtgtgtgggtttttaaagagagcatatcctgccacgtagaagaaaatccagggggtggctgtcctcctacaggaaggaggtaaacaagcatttttccttaagggctctattccctcagcctcgctccctcgaaggccacacttggaggccaggaagttaatccattaaaaaacaaggagaagaaagagagaaagaaagaaagaaagagagaaagaaagaaaagagagagaaaagcaagcaagcaagcaagcaaaagcaaaagcatattggtctctaccccagtccaggtaaatcagaacttctggaggatggagactgggttccactgtttgttttaaatacctaatataattttaataatgcacatacgataaagaaccactggccttcttcctttatctttttcaccctttgttgtcttctatttcctgctgtatctccaaagcttagagaagtttgtggcatacaaaaagtacccagaaatattgactgaacgaagggcttaatgaatgagtgaatgtcacgggggagcagggaggttgagccccttccatttttttctagaatgaacctggacatcagccaggtgttgggatgatcaccagcagatcccacacaggcccacagagtgtctgtgccctggcctggctgggctgtgctgtgcacaaacagatggggtggattcatgttccacagaggagagagctagtggccagttattgtcatggatgaaaatccaggtctttcacaacatccattaattatgggatggcaaattccaagtaaattgtcactgagcagacccatagtaggaatagggcatattcacacttttttttatgtatatatatttctggttggagacgcaaaacatttagaattctgttcccttctagaaattccatggcttggggcagctcttttcaaccatggatctggggtttgagaccagtcattcgtacattgacagtctttgcacagtgaataactctggaatttctgcattagagagggggtgctcaaggtcttcccatgctaccatggtttgctaacgtggttaatttctggccgtagtccttacgaactggggctttgagaccacctgcttggatttgagttctggcccttcccctccacttaatagcccagaactctgggcaagtgatctaacctgggagagcaaagatcagaaaaggtaacacttgtgtataacactcagcacaagctaggtaccgttctgtgctttgtgtatgtctgaacctttcattctccaaacaccctctgaaggagaaattactatttgtaataaagatggggaaacagaggcacaggtagtggagtcacatgccaaaggtcacacagatactggcagagccaggagggcaaaggaggacagcctggcctggagcctgttaccgcaccaccacgctgcactccactgtgagctgggtcagggctcaggtggtcggctcctaggaagcgctcagtacacagccctggtgatgaagtggatgtacacaaagacagcacaccttgggatgtgttgtgcatgtggatgacactggatgcaggacctacgagacacaagcttgagaatcaccaccagaaggttccaaccttgagtggctgattaaaaactgtacggttgtcttagacttatactttaaagctgcatttgctagtggtcactctcactgactcttcagatacagttagaactgatgcttccatgtggaattattttaaataattactaggagtgagttggggtccagtctctgccactcactcagtagttgacctgcccagtgcagtgtggggccaaccctgccagtgagcctgggcactctgtctgaggctccagtgtccagccacctgctaacttctgtcattcagcctcaccctgggtgtttttgccacatggacaaatgtgatagacacaataaataaagtagatatatattcagaataaatattatatagcaagactaaaatataaatagcaagtgcaaaacaaattaaatgaggatatgaatgacttcagtgaagccactgagctaacaactacctttaaaactaaaacagtaagtaattgagaaatgcagttatcattgggcaagaagtcaaatgaaaaatacggtttgaaagtgaacagcatattttcagcattcctttaagttcacacagtacgtttgcacatggcacattatctaagctatgggagtctcaagtgcacggttaagtggacactgtgcagtgtgatttacgcaaggaaaaaaagacaaaaataatctttatgcagcgctgtcattgatttttaaaatgataaattggtgggtctggcacagagatcaatggagttgaagtcacgacgtcaaattgagatgtgaggttaaggctgagagacagacatctccttctctcatgctggcccgatgaactctccagtttttttggtgagctctggtgaaaactctttttaacccagaatgtcagcatttgggttataagaacattaatttatctgactgcagtgagatacattttctcaattctccttatttgcttcttttaccctaatactaggtcaccaaattcaaagacattctttctctaaaaactcaacttctacccaactgaattttcaccaaaggaatcgctgaggttgagtttggtggtaaagaacccaaccctttggtgcttttttcttttctaaacactgcatggccagacgtcagtactgttcagccctggaagccgtcttcctctttactgccttctcacggtgtttcctttaattcctgctacacaaaaagttacaagtggaaatggaagaaaacaattctttcccaatcaggattccctgagttggtagcaaaatcactggctaggtttgtgttagtagcctcattaaatatttattaagcacctgttatagatagtactatgcttagtcatttaaggatttgcgctgtgaatcgcttcatccaatttcctcctatttcaaagtatttcttgtggacattctaggaggtaagagataatgaaaaacttattttttaaataatatttccagttgaaaattcacactcaaatatttaatagaaatcctatcttcccccccccgttcctgctggctcccagatttctgttgccattaaaatcccccaccgccttgctggccttgggtagcatctttaatcccttctttctatcttgccacattacaaagacttgtctgccagaaggttttactcatagctgccccctaacttacttcccagtgctactgagactggcacattctcatctgtgacaccttctcaactggtctccaactcctctcctctggtttgcctctagttataccgccttaatcttctgagaatatatgttcttgtttcaaacatcaacagaggaccctcttgccctgctggttcctcctcaaactgactccagactatgcctccactctctgattccagcacctcaacctttgctgaatgtcacttctcactcttcccatacaagtctgtagccctgagcaccctaccacttggcttaagctccaggactaatgtctgctgggctcaggagtgcaatctcaagcatcacccacgaagtgagccggggcatcactctctgcctgtaatctcctatcctgattctacctgggagtctttaggctcctgccacttccttgccacctcctcccctcctcctggacttgagcttcttggagtcctctcacttggtcttgtaacaccttacacattgccttggccactgctgcaacagctcagtacatatccacaaatcagaagtcctctctgaacaaagccatctgcgtatccatctaccttccctatgcttgccccatttaaaaatcccaggttttatatctttgctgcattttttaaggatgctaaaatcacttactacaaaaataagcagatttcactgtacaaaatgcaggtagtaagaggtatctaaaatgtaaccactaagtacacatagaaaagatttttaaaaacatgaagaaggaccattgacaaatacaagatccttcctagagaagaacaagggtgggggatctcacatcaccagtggaatgacctagaaacacaaagactgctcaatttcattaaggttggcagtgaataggatatagccccatgctgcttcctcaactgaacagctgtaaaaaggccctcacgccatcagcctgtgctttttcctctttctctctgggatgtgcctgtccatggaacccctgctttgggatatagctgtgatcatctctgctgagatggagtgagagcaacttttatttgcaaggctgcctgtagtattttcagcattccgtagcctccttcccatgtctctcatatgttgtagtttactgcatttcatttcatggccaaagctagattattaagggctgaactggaattttccatattaagtagaatataaacttcaacaagcattttgatatggtggggttttcttttgtttctttaccattctattggatagaatagtataattcatatgaatgtatgctgtgcagagatgtaagactctcttcttttctttttttgctcaaacttcctaacagcaggatagtgtggtaaagagaacatgtctatggatgtgcaatactttgaataaacagttcagtgctctataaaataaatattcacaaataatgactttggggagagttatttccaaatccctttgaaatatgttgttagccaaaaggtttatagagtaatttagaatcataattcctgcttgtccctaatatctgctgttctacattcaagttaattttctctcagtcccaattagagctgggaatacatactcagcagaaagagacacatttgtcaggttagaatgttttgtttttattcaggtagtgatttgtcatctgataacatctttatacacctcaaagtccctcaacccattcattatggtttgaataatgtctaaagcacgtacgactcaaatgcacactgaatatcctgtgacttacagtagaggggtctctgaaaggacttgaatttggagccaggaaatgtctctgaagttatggtttttctcaatgtgagaggtaagatccttggttgcctggagataccttagttagtgccttcaggatctgaaacagacacattatcacacatggtccaaaggttcaaacctatcctttcatggcttagtgcttaacacaagacattgtccaaacaacttgtttacagcaatcctgtcagggtccctatagtttggttcctgcaagtctgtattctgtccttaatgtataagaacaatgtacattttaaataaactgattaaaagtcatgaagtttcactacatatatatcataggttagctccagtattggaataaagacttctctcaatgtttgtatgagaatttcatggtaatgaaagtgtcgtcatgtagtatcaatcatattaaattttgctttaaaatattgaagtcaccccataatgttatgaaatattaaaatcaaatatgtgagacaaaaaaggatctgcttcataaatcatgccagctaatttctggttggggaatgtaggtctccaaccagtggaatcatggtggggaggggttgtggtgcttcacatttatgaaagactgttgaaaatgacgatgacactggttttatctggggagtttttatgacctcacactcccagaatgacggtggtttgcctcaagtatgtagaatttgcctgccttcccaactgagcttcttggatgctatggatgcgttgaacagcatccttcacaagcgttaaaatccgtggtgaacctgtcactgccctcctacgtaaatatctgaccacagagctgctgctttgggaggtagctgtgatcatttctgtatcatgagtctctgagaagcataagtcacctgcttctcatattccagagttcagtagttgtctctaaatgagatagccatggctgggcgcaaacaagagaatacaaatgtctacgtgaacgggtctgtcctgccactccactgcgatccgttgttatttctgagaatcattttgatttttggactgcttatttcagtgtgtaggagtcttccttgtagatgaatgcctttcacgtacaagtctttctcttatttattgacttatttaaaaatttttccctacagagggagaaacaaaacacaaaaattccctttcctgccacaggggaaaacaactgtggcaaaacagagaagcccccgaagtaaacagagtaatagagtacccagcctcccatagagcttgcagaaatctcattgtgcagacatggagcttcccagcttttgccttgttagcctatttcttaaccagtaattctgtttcttaataggataaagggcctgacttacatgaaagctcaaagtcttaatcacaatgataaaatacaaagtcgtggcaactgtaataagtttaaagacatatgtagcttttcaaggacatcttgtctttaaggaaaagtctttcatttagctaaagaaattaaactgaattgtttagtcttttaaacaaaatgatgaatttagtgaagaaaacaaaactctccatggctaatgtaatttatgcaaaatcatgcaattagtgatagctgtgctagactttttcttttccttaaccaaatgcgcctctaataaaaccatcgtgaggagcagtgccatctaatgtaagtagtaaacatggatagtaaatgattaatatctggtgaggcatgcagatggcaggacttccattttttctttgagctccttgtgcatgtttgctaatcattcttgcaaaaaaattgcaaagataaatatgaactttcaaaagtaacattcaacaggatatgaatgtaagaaatagtacagtgtgggggaatagtaaaaaccagcactttccgcctctgcatagtgaaatgacggtaacttgctgtagcgtaagcttaataagggttatatcattttcatgtatgtactactctgggaatggcccgggtcttgtgagtggtattttttcatcaagtacccagccagcgcagtcaccctgacagtccccccactgagataaggcatggaaaggtaaccctctagcaagtcctcgttgaggggggagcgttcaagtgcacagacgtctaccctgtgctatcctgagctgtagtcttctgaaatgatcgtttcgcttcccagccaaggcagggctcccccaaagttcattcccactcttgcagtttcacctcgggatgcttccgcagaatttcagcgcctaagcagacaaggtcaaagtaaaccgcttcgctgcttctggcgcaggggcccagagcgcgtgcagctccccagcacagaccaacagcaggagaggggtccgggcgggagccctgggctgtagataagcaaaacgcacccattttctctcctatttactccagaggcacctctcctcccccactcctggcatctctttatcactggctccctctccctgtggcatatttttgggtagtagaatgctgaggtcacagggagcggctctttatccaagcagtggggacatcagcctggagccctgagcatgaaccagcaagatgcagactctcgctcttgactttgggctccaggagctgccccgaccccgggctgcccgcgggctccctcctccctcctgccctcgcccgccagctcgcagtctcttaggtctgcagcgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcagcctggggcggcacggagcactccggacagggcatccgcggccagactcgccgggctcacgcggaggaagcctcggctccggggacttggcccgctgcgcgcctgctgcccgccccctccaccgctgccggcccggccctgctggcccggccggcccccgcgccgcagctcgcgtcgctcgcgtccctccggccccgcttagcgacgcgcgcggggaggcagcggctgggccagctccggggacgcccgcgcgctcgcttgctcgcgacgcggcggagccagccacagccacccggcttcgcgctcctccgatgtcctcatttactgcaattgtcttcggcgagatctcagagccagggccaggaggcgggggcggggcagaggagggagcaggagggaagtcctttccgctgctccaggtcccagctactccgcggagccgggcggccagaggcgagggcgccccaagccgcgcgcctgccgcctgtgcgcccggctggcaccgaggcgggcggagccccgggccccgcggggcggaggtggggcggcggcggcgcggagccgggccgggccgggccgcgtgcgtggggtggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtctgctgtgccagccagcctggcccggcggggctttgggaagccaggcttgaaggtgcgtgtcttgtaggtgcctggccgctcacctgcggatgctgccttgtagaagcaggagttcggggatcctttcagtgctggctccaacctggtgtcagcctctctacatggggacaggaggtcctatgagtggcctgaggactgaagtgggagggcctgcctggtaatgttgcatgctgacatttagggacactccagagcaggcgccactgccactcctagccaggaaccctaccccccctccagagcacacaccacccgtcagcagaagccacagggcgcagaggctgagttcctttgtggcagagtagaattctcttgggagaggaaaagacctaggatgcacacggagctatccccgcccttaatttcccacccaccaaagagtattgggtgttttgagctcagagcagcagacccaggggcccctctgatgcctgtcaggccctggggtctgggccagggactaagcagccagccgagtgcagggctcctggccccctggatttgctcctagaatgtaatgtaaaatgtaagtagccacatttattagtctgtttctcaggaaaggtcagagaagtagtggaccccagggaagggacaggcttcggagaggaaattgggaggacaaatggaaagtcccttcacccacccacctctccagacacatcagtgggcagtgagacctctttgcctatacatccctgagtctctgcacctagcaccagctctgtgcctgtgaccaagccatagctccatccttgttcgctgagctgaactgagcctatcactgccttatagagtgtctgttttttataaatgactttatacgaaataccttctttgtatgtggatgctttgggcagtgtgtccagacatttcagaagaaaaaaaaatctaaaatgtcatctatttccctctttaccccgcagcatcctttggtatacaattttgccagccttggggatccagatatgcccaggacgggagtcctgagcctgtggatccaaactctgcccacctcactcttcttgttgttcttcttaactcagatcccccaagctgattttccagcttaccagggaggctgttgggagctggctggaaagagatgcttaattttgtgtgagcagtatggaaactgcagtcccctcttctgcctggaaggggcctgggaagggaatgtataggagttggggacgtttaaaaccagataggagaagttgccactctccagcatgttcccttggggatgtgctgttgcagctgtgggctccagtaattttcccagtggtctggggagcttctgtaaatcttactttattggcaatccataaaattgaaatctgccttccgtcttttaaagtgactgtaaataaagctgccaggaaacttgggcattgggctggtagtatcagaaggctgaagttttccgggaccaagagtgaaaacaggtcaacataaatgcatgcccagcaaggcagtgctcagccacaggtggcactgtgaactggcaagaaaacagctccaaggacagtgctatctgagattcgcatgatgtataactccaggaagaaaatggaaagccgtaattggcaggttagaaaatccacttacatgaagaggagagtataacggaattctgtagcatcatcaggactgcttagagttgttcaattgtgtagtagacttacagttgttttgctaagtctattaaaatcattggcatcgcttcttttttttttttttttgaagtaggaaaccatttacatattgtagtgcttaagtgcatgtcttcagcatcacaaatcaaaatattggtgaaaacttgcctcaccttacctttggctctggagagatattccacatgggtgaggtgtgtgtcatcatgctccaggctttaaagcaagcatcatgctgggggctggctggagagaagggagtttcagccatcttcctgcccacagatccctcttgcatttttttttaatagatgggatgtaggcatatttttagggtctagaatgagtcaatatgctcggcttcctcaggaaaaaaaaaaagtgaaacttgatagattcattttaggaatcaattggtattggctttttatattttgcttaagatttttgttgaaaaagatagacttgcaaaggagaaaatagctacttttcaagtgggatttcctaaaagcagaggaataaaaataagggaaagttcaagacggctaactaagcaaaatatccacgtctctcttcttttgccttcttcttggaattgtgcaggggttgtacagagaattgctggaattccacccctatggtatagtgagtttgaggtctcaatttccacattaaaaagtcaagaatatacaagtcaaacatgttcaagaatgttcataacaggtttatctatatctgttccaaacgggaaataatccaaataccagtcaacagtagataaagatttcttggttcttcgtatagtggaatactagacagcaacccaaaagcactaactgctgatgcatgctttggcatggagggcttctacaaaggtgcagaacaaaggaagccagacgcccagtgtttatgacatgattccctttagatgaagtccaagaatgcgacaaagttatcaatggtggaaaatatcagaatggggattacctttgaggcatactcgttgcccgggaccacagcaacttcactggtgctggatcattctgtctcttgcactagttgcttatgcagttttccacctatatagaaattcatggagatgcttcctgtctcagtgtgacctcatttgtctgagcatcatcactgtgtcattgcaatgtccacatgcatgctccccaataacccttacccctcagtgaaccagtgtatctgtcagtgtgattaacctgtatcctctccagtgtgcaaggcaggagaagagaaaagtgtctccaaactagcaactgcagaagaggagccttccagtttagctacacagcagaacttccttctttaggagactgccgatgaaacgcctgccctcccaactgtccgatgtcgctgtgacagagctcgctatggacgtgaatttttctttcccatgtctttgttacacaaaagcggtcccgatccagatcccaagagagggttcccggatctcacacaagaaagaacacagggcgagtccactgtgcaaagtgaaaacaagtttattaagagaataaagtagtgaaagaacagctactccatagacagagtgggacattcccaaaagtaagaggaggaatgcgtccagcctaggtacaatactcatatatatggggagctctgctctgctacgagggtttgtgataaaggattaaatttcttaattattatattttgcaagaatcgatattatctgttttcgtttttgtttttgtttttgttttggagacagagtttcgttttgttgcccaggctagagtggcgtgatgtcagtttactgcaacctccatctcccatgttcaagcaattctcgtgcctcagcctcctgagtaacctgtaaccacgcctggctgattttttgtattttagtagaaatgaggtttcaccatgttgcccaggctggtctccaactcctcagctcaggcaatccacccatctcagcctcccaaagtgctaagattacaggcgtgagccactgcgcccgatattattatctttaaagtaaaattaggaacgcctttgttctcaggatgtctggatattaggacactcccaagtctgggtctgtttagtaaacatcaccagtgtgttcccttaaccttaaacatctagaggtgaggaatgcctaactttctaagaatgcagcccagtaagtctcagcctcatttctctagtcctcactcaaaatggagtcgctgtggttcggatgcctctgacatctgcatattccaaagagactcatagatgagcccaacctaagtctgtgatgggcaggttacacccgtcagttcagaagctgtggtagcagatcagccagtgctcaacgcctacgagggaaaagtaactcatatcgccttcgacctgtagggtcgagatcattcccttggggacactttagccttgtctttcaagaacaagacagacacaatcctcaaggtgccccagtggggcctccttttctgccgagaagccctgcaggaaggctttctgcatcattccccttgtcatattctgctcgagccttcactctcctctttctgggcttatttctggtttaagactctcgctttgtgtaaagccccttgcccgtggctcttgcacggtcctggcagccgagccgtgtttccttctggtgggaaccagagctgtttctgaggtgctggtccatgttccagggccatgccactcctctggctttcttttcctttcatggtaagaaactagagatggtttattggcctgaaatacaaatttgttttggaaaacctgagcatcgtgaggactcgttgagatccctggctttctatgatgcatcattgtgaatctgatttatccacagaaatggaaggttttccttttgaaagagagggaagtagctctaggtttttgtttttttctaatgctccctgcaactgaggcagtgatgtatgggaataaggaagagcaggcgtgcactctggctctcccctctcccctcacaatccctcattttcagggctctgagcaaaccccaaggctttcccctcccaactgcagcctctcctttcttttaggcggactcctggggaatgaaacagaaaccctttattttgttgacctttatttggtcagtcttgggtgctggtttctatagggtttcttactatcccattctcgtcactggggagccaacctcttcagcacaggtagatggctcaatgggcttgtcttaatccttgctggtaaggccaccagtctcattgagcctgctgaagccaccttctcataaagtggctgacatgcccacagagagtgacacttctgatcagaactagggcaggaaggagccaggcacggtggcttatgcctgtaatccgagcattttgggaggccaaggcgggcagattgcttgagctcaggagttcgagaccagcctggccactatggtgaaagcttgtctctactaaaaataggaaaattagccaggcatagtggctcatgactgtaatcccagctagtcggtaagctgaggcagtagaatcacttgaacctgggaggtgaaggttgcagtgagccaagatcgcgccatggcattccagcctgggtgacagagcgagactctgtctccaaaaaaaaaaaaagaactaggacaggaaggggtaagaatggatttcacacttgagtttccacccaccagcgctgtgtgctggtgctggagctactggctgcccttcccaggccttctgccccggtgcacaggaggcttttctttagggagctgctgcagggaggcctgcagtcttctcccagctggggggtgtaggaacttccttgtttgccctccatccccaccttaggttccacaggcatggaagagggatggggtaaaggggaaggcaaggaacatggaagcctccttgttgtacttttttccttccccaagccctgactgaatatgagacttcgatgagaatgatgctccgcttcggttgtgcgcctccagggtggcaggtactcggtccattgtggattatatactttggttcttaccagataactgggcactcaatactgttaaactgtctccacagatgtggatcagagaacgtaaatgatctctccaaggtcacacagctaggaaggggtggagcctggattcaaatccagttctgtctgatgcaaccagaggacagattctgaccaaaaatgccaactgctcatgccaggctctcaggaagctgatgctgcgtccaggctggctggagagtagctttgaccagcattcttttgtcgtcattagccgtccctcattatctcactgtattagttacactttgaaataaaaacaggcactgaaacagcaatatactcaaatcattttgcatttcgatagcactctaagcttccccaatataatttcagtgatattctcacgttttcttcgttgaataacagctattaaaatgattcatcacaatatacgtatcccatctataccacaagaggccacttcacacccttctggtgccatgtataatggcatcgtattaccatggccttttgattatcttgaacacctctttggtgctgtcatttgctgagattcagtcatagtggacaggatatgtgtttttattttttttaaagatgactaacacactgtgcatataattctaattacctacccttgacattttatgcgcttagtgcaataaattattttgctagtttggtctaagaattgacgacctgactttagatgtatttatttcgcagcgtggctcatgggtgatgtgataacaagctatgaaacattggaaagcaagcattttattctttaacaccaagttccaaatgggaaaagtacagaattaaaaataaaaaaatctctagttatgtttgatgacctctgagttcctggaactgtcagttccatgttttccgtaaacgtttttttttttttcatattattgagtctttggagaattaaacagtcttcgctttaattgcactgcacggtagggctgcggatctccccgtgtccaattcacctaatttgtgttttggcacattctgcagctgtgccatactctaaatgtgtgtgcacccctcacttcggggttctcatatattagtccactaactaaagttaaagtaaaaaatcaaaaacttattttaagacatttcttacacaattttgattttttttttttttgagattcaaagaaaggcagggaatttggcttgtaaatgttgcttaatgtttttttctctttttagaaactccagtgtccatagtttaaagtgaatatggctagaatgttgtacaaacgctcctggcttcatccacatccctgtatctcggcagtcacagctccctggcaccttctcccccttgcctggacggaggcttctgagtgatctcctaggccttcctagattgagaggggaaagggaagatcttaagattccagaatattcatttcatttaagcgagggaggcaaatcctacagagctttttcccatttgtgttcatttattggctgtttccgtggattcgagaaagaaacttgaaaatctgttttgttttgtttggtttggttttgagatggagtctcactctgtcacccaggctggagtgcagtgatgtgatgttggctcactgcaacctctgcctgccaggttcaagcaattctcctgcctcagcctcctgagtagctgggattacaggcatgcaccaccacacccagctaatctttgtatttttagtggacttagggtttcaccatgttggccaggctggtctcgaactcctgacctcaagcaatccacctgcctcagtctcccaaagtgctgggatcactggcgtgagccaccgtgcctgaccgtttttttaaaaaaaaatagagatgggcgtttggaaactgagtcactcaaaaggtgaagtagctttgtcccacagatctgttactcagtacaaagttgaaaggaaacctaaattcattttatttgtgtttccagtgtgcatcccagacatttgtttcagaatttgttaaacattgaagaagatcacctagggttgagtaggtaagaagtaaatgtggctttgagaggccgtgatagccgataccctcaatggctgctcttggcctgttggacaagccatccttgcacatgacttgctatcctatgacccgcctccagatcagtcaccctccccatttgactgtgggtggcctggctctgtttgatgaccatgagcaataaagttaccctttcattaccatgccttgggctatctgagctggatgcccctaagttctaatagaaaataacatttattgatggttttttttttcttctctgaacccaaatatgacaatgaggaaatttattttaaaggtactgattttttccttccccacagagtaaatattgtcacatggaactgctgatgatacttctgagtcccttaaaataagacttgtgattcattcacaccatgaaaatggtagagaaccaacatcttcaccttcagattcatacgttattggctctttcctttttggtccgtgggtgttaatgaacattttcactctggagctttctctgcttccgactccagcgtggatgaaggagtgcagcttctggcctgcctggttcatcctctgggtctctcagccctgggatttccacgttccatctctgttgtggtgggcgagttgcatgatgcattcgatttgatattttacagaacctctactgagaaaatagggtaagcagattaaagctgaactcagacacgtgtttggcaaccacccactcttgatggcgtaagtggatggaggcaggtggccacagcaaacaccatgtggctttacgaagaaatgttcctcttccatacgttaggcctgtgtaaagttccttgttggacttttgcttcttcgatgacaatacatattttgttagtatttaaaggacatttttaaacattgctgaagtgcaatcagcttaaattgcgattcatatgacaagtgttgaaacagggtgatgtttgccatgaaatttaaataagctccgttaaagcagaaatgtctatataccatgtaagacacaatggtctcccatagccttcccctgttctttacttcttgacaagcatgaatagtctctctgtttgaatacagagtagagtcagttattttaaaagagttatcatctatgggtataatgcactttaagcaaactctttacatgcaagtatgacttatcaacaagtaaaccttaccaaataaatgctcattttgattaaggctaccttcagataaccactgtttatcatgcacttagagggattcagttttccaaaataatttaaaaggtgactttttagaacatcatctattacattgtcatctaccatatattcttcttctcttttttttttttttttttttttttttgtgacagagtctcactctgttgcccaggctatagtgcagtggtgcaagctcagctcactgcaacctccacctcccaaactcaagcaattctggtgcctcagcctcccgagtagctggaattacaggcacccgccaccatgcccagctaatttttgtatttttagtagagacagggttttgccatgttggccaggctggtctcaaactcgtgacctcaagtgatctgcccaccttggcctcccaaagtgctgggattaaaggcgtgagccaccgcgcccggcctactgtatattcttatatatacatgtgtataagaatatgcatttacttaatacgctatcaatgtacagaattgtttgttgtggatttctgcacatgttccttgggtaagagagtcttgatgtgatttgcgctgtgagagcagaacttaggtgctctatgttctccaaagtccccctccacctcctggatggcatttattcagtagaatccgagctcaataaataaagaacctcgtgtacttcccaaagagccagacactgtgttagctgctttatacatacatctcttaattttcattttttgacaacattatgaactatgaaatattgataggacatgaaaaatcaagagctggtcttacggaatagtgcaggattccttccctgctccatttttcaaagctttgctccattggaacttaacaatgtgctgtctttcagtacgtctgaaggtctttttcaatttaaatcagtttattcctgtttttaccatatccagctccctgctactcctaatataaacagacttagtggcctattaagtattttacttctaatgcttttgagttttttcttggcagtggaggtgtaatctctcccaaaacctgcctgcacttcacagagaataggaccgcaattgccagaagaaactgaacctttgtgggggaaaaagaaaaatacagccttccctcattctccagtcttaattgagctaactcaatttatgccaaccagttcttgctggtcatagttctagagctttatgagaattaaatcctgatctcaccttaatcctcctaaaatctccgtgaaactgggcactgttatcagcaccattgtgaaatgaggcagcaagtacagggcggtccctaaatgtgactaagtcaggaatcttatgtagaaagcttacaaggaagttggggggtgattaggaattgtctccagaaataccagataaacagttcaaattttagtgaagcaaaagataggcatattttggccttgtttaacttgtacctgaatgtaccaataacacttttggaagacttggacgtactcttcctcttttcccaggaaaatgggagagtattcattcctgtacatattgagaacatggacaattctcacattttaggattgtcttaataggcaactgactttattatctacgtgttgattgaaagaatagctcatagcaggtgttaaaagtttttcctaaagagctacattataaatattttggactttgaaggccataacatcgtaacatttcaaaggtcatgaaaacccagctctgctggtgaagcagggaagcagctgtagagaatatgtagacaaatgggcaactactgagttccaacaaaactttatttacaaaaccaggaggtgggccagatttggtccacaggctatagttttatgacccctggcttatagcataagttgttggacagaattttgataccatatgtagacccaaattttaagaatgaattgatgcgtttgattgatcacaggagaattcagtgtttttcccctttgcttcttacatacgctagattgtaggctcacccggcctcctctgcgatttgggcagaattagagcagtatatcctatcaagaattacttctggcaggggatatggtgaaggggccattcatctgttagtatttgagtaagaaacagttccatacaaacaattgggaatagtaatgtctttgtcattgtgaaacggaagaattttgctgtcttagttatgggaatgctccagttatgggaactaaagtgcagtaattgctttaaatggacggtcatatatgtttggctccttagtccaataattttattcaccacgttcccctgagagaagacttgacaagacaatcctggacagtcagcattggattttcatctccagctgattgatttagtatttcatgcaacccaatggagtatctttgctgtagggttttaatactggagctattatgatgactgatgtaatttagtttcctgtattgatggtttccaaacaattgagatgaatagttaagtttctataattgttctctgtaaccatatgaaaaatgattatatattagcttaacatgagttttttcactaaaataaaaatcaataatcagttggttatccttttgaatattatatttaatgcctcagatttgaatattatcaggaagccaagatttcaagaccccgtttcatttttttaaaaacatgacaaaatgtgacatagtgaacattgagatcactgagcttcattgtggattagcaccccactttcaaatttgtcaacacgatatcatctgttagatgatatctaacgttgagatgttctctaagataataacgttgagatattctctaaagacctaggataaagttctaatttaatttcctattgcagtatttttgtgttgcctgtcattaagactgtggagcttccttattaattaaatttagttcactgtgtatattgctaccacttaccaagtggtcgttaatacagcctctcttaggtgatggctttttgtttacctagcgatgaaaagcttaacctacactgcatttttttcatgtgtgtttaaccgaaggaaacatctttgaatttatcttctcactgcataactggaaacactgaaatttatttgatgatccagaatcagttccttggtttttaactttatttccatccacaacaagtggcagctttgagaaggtttcatgttctttacactgagattccagtggatgagtctgaatgtttaactcccagaagttaggagaagattgagcttgcttttggagtttaagaatgaaaatgcaagtgcatgtgcctattttagggcctaagttggattttcataaaataaagcaaaatctgaggtcaccctgtgtgggaaaacctcatccgagactggagattgaaaataggagcaagggccagaagtagccgcctggagagcagagctaaggactgggtggtgcctgtgtgtcctttgggcacctggtgactttcaggacatcatagacgcaagggtgagggcccatctcatccttactgtcagaggcaacagtacagccctggggtgtatttcacattataccactagagctgggtgcttaaagggcatcatcaaatccatttttctttccttgagtggaggtgcctttcatttgtaaatgatggatttgaaaaatggacaagtagtgaaaatgcaggaaaatgattcacatcagtaggtgctccagcagatgtggagtaaaaatcaacatgtcccacaaatgggcaattaaaggttacacatagaatttatggaaagaactttggagtgtcccagggattgcaaaggtggttataaatgcatgtgctcacctcttcctgttagcacacacacctaaatacgcagaatctctcagcagagacattccgttgagagcctacttaataaacctcattttaattttattcaccttagtaaggctgcaggagttggtaagtcccgtggacttggagacttaggttaaggaattccaaacttgactgctaggctgctggtacaaatcatctttctctctttctagtcacctggatacattatgatgcgatgccagacttccccaaaaccccaatcaagaaataagaaaagatttttctccatttcctggttccctcacagtgagaatgagattttttatgaagtcttacatttggtggttattggcccattacctatggaaaccactgtaaagacctcacagtgctgccatcagcatgcgctctggacttcggcggtgccacataaggtggccccagtgctcatcccaggaagaatggcccctgcttgtctcggcaaatgactcccacggaagctgtggagagccacgaaggtggcaggcggcattagaggggctgtaaagggaccgatgcctgagaatttcttctgcaggatgtagaaccgtgtgcatttggatgataatgcagtcagaggagggcttcctgtgattacggtggaataactctcaggctgagcccgggaaaccaggaaatgcacgtctaccaggagccgaagcagaggggtttctttttccctcttgctctgtctcgttgaaccttggttcttctatctgtccctgagtcctgcctctgagccactgcctgttccctgggtggctccagccatggactgcatgggtgccaggcacatagctggtgactctgcccctctggtgagtgcagcatggcctctgctctctccccctgcctctttttgttttccttttctgagggttcctcagcctcatgaagtttaaagcctaatgcagatcctctccctccgctgcattgttctaggtgtcactgaatttctccaaagagaaaaataaaaactcagaatattcttgtgactgatttctgaatgtgacacgtggcgtaatgacttaaacgtattacagccagcagctcttggtataggacccatgatattttattatattttgtttagcattttgttgtactttattattttattgtctttgttttatttagaacactttatatccacccttttcacagagttttaaatgtacgttacggtactgttaactctgggtacgatgttgtgcagcagatgtctagaacttactcatcttgtggaagtgaaactgtacaattgtgtctgtgatccttcttaaagccttagctgggctgctgagtcctgcactctaactgcaggaagggcagctaaggaaagccaagtgcaacttgccagacagatgggattttcatgtctcatctatcaggcaagacattgtctcagtgtactcagcagactcctagactcgggttctgggctgatgctgtcagacatcataaaaggagagacactcctctcagccatgctcctaatacccctgataagcatgctcctaattcatctactgcccttagcaaagctgccgtttgtgtctccgatttggtgtctttatagacatcgccatcccctgttagtgaatttggggtcttgagacgtcatctgatgaggacctgctgtttcacagaggaaatataactgtctgtgtgctttttattattgtcatgtttgctgctgacatttcacagctttcatttattgaattttgaagacattgattttttcttcatagcagaaattatggatcagataattggccaaataagaaaaattcagacagcattgtttttctaaacatactgaaaataacgcatgtacctggtgaaaagtgaagacgtcatgacagagggtccagccctgctgtccaggccacccccaggatgggagccctgaatcctcatgggatgtgcgctgagatacaaggaggtccctgcacacacctgcctttccccgctgctggactcttgcaaatcatttcctgtgagtgtcagccagcccactgcatgttccgaaagctctgcagagtgcgccaatattccagagtttcaaagtagtgccctttgaaaagatttaaacctgcaaataaaattaaatttgcatttgagaatacaatgtgttttccttcttgaaggacttgatgctttggtgaataagcatatattacaaaattattcaatcacccatcacaagtgggtgtgtcattccagctctgtgcatcctttcaatgactccgaggatgatatcctcacggaagcagagttatttaaccccagttcactgatttctcagagttgtttacaaggcggctttccgtgatgtgtctgcttgggtaaggcattaaattatttcaagaatcattttggtctttgctctcaagtaaaagtggttttagaaggaaacttctacctggccatcgtgtgacaacactggctgcatatcaagaaaagtgagactttattttttgcacatgattttatactcatgtatgcttgaaggaatatgcaagcgtcgtgagatctaatccatacagaagttgagaatgtgtttccattagaaggtaaagagcctctagtattcaaagcctttgattcagcgggcaggtgcgaacggtggaggactgtgcttctcgcttgcagacacctcgaattatttttctttagctccctctgtgctttcagggagcctgcgtgagttaagcctctccttgtagtgatttcccgatgcccagcaaggccgaagctctcatttcctttaggagtgttgttttttttttctcaatgaaggatgaattttctaaatccataattacacctgaccatgatggcagcttctctgttaagggcttggaaagtaccttgttaattacttgacttattttgtcaacattttttcatgttctccccaccccttgccaaaaaaaaaaaaaaaaggatggagaatctcatttttgcttcagcgtctcttctgtgatgatttcttgcttttcaattcacgtttggaaaaatgttttcatttaaacaacctccctatttaaaaaatttaacagtaatacctgctttttgtaatgagtgaagataatacaataaggatgtatgaagtcaaagctaattaatcattcttctcccccatcccctttctatccatcccctttagattactcagtaatgtcgacagcttgctgtatgtctttagacaccttacttcttgtttgtgtgtacccatgaaagcttttatatgcatagatatttcttttacatgtatttcaaaaagctcagaatattgttgggaagggaagagagagaaaaatgttttctttgatttttaagacagtacttggaagttaagtgtgggcatcagtgtaagtaagaagtaggatgctagagacagaaagaacaagatgggtagtttttctttttattcaaagcaatcagtgatatgttctaatgctttggaaaggttctatgcctagaatgttcccaagaaaggtctgatttattcttcataaagtacttttgtgtacttctgagctagggtggaatttacatggtttggaatcatttttgggggtgtttttcaaaatgtttgattggaatagtgataagttctctttaaagagattgatcacgtgagattgggtaacaccaagatgaacagaatgaaaaatgtttccctatagcagtgctttcagaaacgtgaatacattaatgtacaccaagcatttgtagaagagggattagggctcagcattacagtgttttcctaactttccttactcacaggctccttatttatttattttttgttaggctgccgtggccagcgttccaggaaacacactttgggaaatgacgctcctttggctgtgtagcgcacaaggggctgtgagcttcccctgtagacgtttctgccttattccagctgatcagtaatattcatcagcatcatttcattcttttttttaagacggagtcttgctctgtcgcccaggctggagtgcagtggcgccatctcagctcactgcaagctccgcctctggggttcacgccattctcctgcctcagcctctcaagtagctgggactacaggcacccgccaccatgcctggctaatttttttgtattttttttctttagcagagacaaggtttcactatgttagccaggatggtctcaatcacctgaccttgtgatccactcgcctcggcgtcccaaagtgctggggttacaggtgtgagccactgcacccgatctttttttcacttttaaatcaaaacagatcattcatacaagagaagaaatacatatgtagagatgacaaatcattcagtgggcctctctgtaatgcttcccgctccagtccctgagtagctccccccgcccagctgtgcacgtcttcttctttgtgatgtggtctctacacagatttgggattcattttccctcgcttctctttttagttttaccacatattaatgtatccttaaacaatatgttcttaagccttgcttccttttgccgtttatagaagcagagtcaaacaatatatatttttccatgacatgcttttagctttcagcactgtggttttgcagtctctccaggttgatgggtgcagctgtggtccattcgttttcttagctgaataatactcctgttgtaggaatagatggcagcaagcgtaacccctcttcatggatgggtacctgggtgatgccagtgtttgctattaggacagcgtgttagatcctgcatttagcgatctccaggcacacctgcgggagagcgcctccaggaaacacaccccggggtaggattgccaggccaacaggtccttaaggcagatgattaccttagggaaacagaggcccccagtgtttcttaggcttcagaagtgtggtctacacagcaatagtaatatgaagactcagctaccgtgattccttctcagccactcctcctcttgtcctaacccagaatcatatttatgatattgtcattttaaacatatgcgtgtagtttctatgtgatggaatatggtagtgagaatctaagtatccagcctggtcacccgctcctttccgcctcacgtgcaggatggttgccctcatttaatcatcgtgtacagtctccctcgggcaccctgagccctgcatctgtttcacccagggcctccctttggttctcgttttgttctttgcctcttccaggactcctgcctcccttcctgcctcgctatcagccttctttagaatacatccccagccacgttccacacccaatggacagcttgtgtaatcatgttctcccacatccctaggagtcctgggatccatgagtggctgtttgtaaatctcaggaagctttccctgtcttcctgccctgccctgtcttccttcccctggtccactggcctcgggtttcctgcagcatccatggagcactagggaagacccagccacgcagctccatgtgatccctctgtggtccgcctggtgctactactgaaaggagggtctctgttacttggcgccaagcatggcaggtccagttcccacggatagccggggcatctaaccaagataatttagagcagaagctgtagctacattctgtacctgtttatcttgagttcctgctagcaggtaccaataatgatggattgtgaacaaacagctctgccttgtttttttagaccctgaaatagacaggttggctttgataatgctttttgactgatgggcactttttgtaactaaatcccattcaaaggcttaaaatatgccgcccaaggttgatttcaagatatattaaattgacctaaagaaaaataagtaggaaaaaaagtcctacctacatatgggatgatgtatggacattttcaaaatagtcacaacccaactttaccatagcaaaaacaagcaaacaacaccccccctcaccccccagaaaacaacaaaagcaaaaacatcaaaataatccctgcagtgaaacaagatttcccctttattactaagtaccttcagccaaaaggaactgcaccacttcatttaaatgtggttctgaatattcgtttgtgtttgcattgctggattatctaactgctgctttccatctgaaacgtaagccttcagagatgttgctccccagtaaactatcttagctttgccaggaccgggccttcactgagtgtaatagaatccctgatccccaggaggtagggaaggggctgacaatgacatgcatgaatgagaatgttttctagagaggatgtagtctgccacgtcctggagctgctttagggagagcaaaaacctgtttgtatctttcattatatatgcttttaagtacccaagttaggaagtagctatctgtgagcttttctaccagtcttcatgccaaagtgataatttagtaaaaaaaaaaaaaaagaaaaagaacaaacaagccctcgaaaccaacctgaaagcgcaggatacagatacttatgggcagagagagactattgcctgtctttggaagcattgccagctattgctgggaagaccactcctgcttagaggggtggaattctttctgagctagcttgtcctggaagtctccgccccaagagtgttcttgatgcgtgtgccttacagccattgggctgggcatcctcacctttccattggctggaaaatgaagaggataaaccccactctcatatgtaggcaaaaggttccttttgataaagtcgtgatttctccatctcaataataatagtaatgcacccatcccaaccgccccagagctttgctgttcaggaaacataggcatatctcaaagtaccctttaccttaattttcagaatcagtgccttgtctcatgacttttcaaggttggtgaagttctgaagtacttaaaaaaaattgctgatttaataaacttgctagttgaataaaagagtcagaccaagtagaaagtcgttttaccacagatgtgactttttctttttgtggtgagtacatgtcgtgggcagtgcatggggcctgtcacaactggcatcatttccatttggttgaaatccgagcctctgcatcctgccttgagatcagggcagagcccttgctttttagtttcatggaggctacattataacagagaggaagagagggagagggaaggaaaggaggagaaagaaagagaaaagaagggaaggggcacaggcaggaaaagaataggaacattccaaagccatgtctcaggacattagagctagaaccagtgtctgtgctaatgggactcttgcaaacaccctcttatttcactttacctggggttagtttttggtttcctgctttaacagatgaaaacaggttttttaattggattctgcacattacccctgtgaaactgcagaacataagcggtttaagtagtttcacactgggctttatttcattagtgatatgctgtatggattgtaattctcataaactgataatatgctgatttactggaaaccaaattgacaagaagcctatcatgtgtattggcagtctgttcagcttgctggacttggccaggagaccttgagctcctaagattttttcatccttctcttaaaaaatagcaaaaacatatctttattttcagttattaaattttgagttcacttaacagtttcttatctgtttgcagaaccacatggaagtaatgataaagtcttgtttcagatatataaggccaacatactaaaaatctgagcatactcaaatatgcttctgcatcttgaagaataaggttgtctatatgctagtaacatttatctgaaaaacatgccacatagaaatacctttatggggacttggccataaattctttgccaaagccaatgtcaagaagggtattaactaggttttcttctaggattttaatagtttgaggtgttaacatttaaatctttaatccaactcaagttaatttttttcatatcacggaagttaaagggccagttttatttttatgcatatgttaagccagttatcccagaaccatttattgaaaaggagtcctttccccattgcttttttcttttttttttctcagccttgttgaggatcagatggttgtaggagtgcagctttatttctgagttttccattctattctgctgttctaaatatctgataaaataaaagttgaaatttttaaaaaagtatctttatgaaatctaaaaattgtggaaagtaattaatctcattaatctaagagaatccttgttaatgtatttgaatacagatatttatagaaatacaactataatttgacctaatatgcagtagtatacatgagacttaacaattgaaattgttgttttatctaaacagaatctgctcatttcctttttacaccagcaatggtagagccagagaactttggttcacaatggaatcatcaagtcataaaacttttgaacttcaagggatttttccatttttttttggttggaggtggtgatagggaaatcttcttcaatgacaataagttaatgacttgcattacttcttggccaaagttaagactagaacagaagttttccgactcccagtctgttcagtattttccccatcatacctgtgattatcaaccttttctcactctgccaaccaaaaatgttcccttggaatgacttctgactgtttgtgctgaaatgaagcagtggtttttcaaagctcacacatgaccgtatggactctgcacagttggtgccatattaaaatacaatgtctcttacctttttttccctccactttctgttgttatttcccaatcaaagtaaaaccagtattaaggtctgtcttagttcactttgtgatgttataacaaaattacctgagactggtcatttataaagaacaaaaatttgtttctcgtggttctggtggctgggaagtccaaaatcaaggcaccagcaagtttggtcgtctggtgaggtctgctctctacttccaagatggcgccttgttgcttcatcctctggaggggagaaagctgtgtcccctcctggtgggatggaaagggaagccaacctagggctaagtgaaacctcttttttaagggccttaatcccacctcttaaaggatgcacttcttaatactatcacactggcactggcaattttggagggggcacattcaaactgtagcaaggactaacttctagcatattgtttatttaattccccaaattaagtagtggggactgcagattagttctgaagttttcctttcaggagaaagtagaataaatgggtaaagaagaaaccataaattcatcttgggtggaagtgcagtttctgaatatattctacacatcccaacaattgtgaatgtgctttgccatcttatcaaagcagtattatattatagaaggaaaggctttggttgagcatatggctatttctgagttacttagctttatattaactttctcatcaccagttggcctacttgcttaggccaattagtccttggccattttgtctatgtgggcatgctaggtcatgtcagggctgattttttcttctcaaaaatttttaattgtggtaaaatatatatcacatagaatttatcacctttgccattttaagtgtacagttcaatattgtgaagaacattcacatttgtgcatgactaaattccagaactctttttatgttataagactaaaactctctacccattaaataacaacaccccatttctccctcctctcagcacctgtagaaccaccattctacttcctgtctctatgagtttggttactctaggttattgggccaattttgacagcctttcttgaggtggaatcctcttcccaacatacttatttccattgccaaccatgaccctgcccatggagctctatcctacactctatcccatccccgtcttcagcccatcctgtttggtgacacccaccatggccccagcccacatcttcagcaggtgcagaatgtctcttagtgttgacttacaccctggcagtcctgtgcaccattcacaggatagtcttacttacagattgagaatctacagttttgagatcattatctttacatttctgtatcctccatccttcacagagtcttcagcacagagcatgagttcaaaatcaatgctgggagcattaggagaaaattacagagaaaaaaatgttcaaagatttcatgtagttaaacattcattccttccacttttgcatcctagattgacccctcttgtgtcttcctagataaatgggaagttgtctgtctcagttgatgtgatatttaaatataccagagtttggagtttgcagagaaagagtgtggagaagctaagtagggaaacttgatgagtccctagactgaggatacaggagaatgaagaggaggcaggagtggggaggaaggaacagagaaccaggaggcccagggacgtgtgtgttgcagcagctttgagtgtgaatgggcaagaatgaactgcacgtggggctgccacatttaacaaataaaaatataagatatgcagtcaaattttaatttcaggtaaaaaaaaacttaagtctatccatgcaatatttaggatatacttacactagaaaaaatgttgcttatctgaaattccaattttactgagtgtcctggattttgtcttgcaaccctagctgtaaagggaagaaggagctttgtagggtagagccaagcattggacaaaggcatggatggaggagcgatcggtgtccccagtccagttcagtaatatggagggcggagggtggagattacaagaattacaagcaaagatgggggccgtagaattccatcttctacctttaaagaatttgcccttttttttttccctttaattgatttttccctctgtttttaagttgttctcttttgaatactctgcttatagatttatttcctaaacaagtgctgttaaatggcctccacttcacaggctccatggaggagcagagctctcctctctctatgccgatgctttcagcatcctcagaatagcagctggaaggcagtaggttttatggggataactgtgcactcaccagtttagatgtgtggttgctaagagtcacggtatttgtttgcaaacctgttggtaccattggtccatgtttagctttgtttaatatacataaacaaaaaagtgtaactggaagctatggtattttatttttcaattagctatggaaagtacaagaaaatcaagttgctaagcaatttctgttgaattggatgtgggtggaaccattatcaaaggttggaagaaatcgtaaaaatggaggagcattttatattcacgttgtttttcctatgtcttcaagttctttaaaggaactgaaactggaaattgcagaaaatgcattatgggtgtgatttatgaggtaaagaagagtacacagtgcatggtgtgttgttatggcaaccctaggaaactaacatcaagatcttaactcaagatattgatcctcatgtatgttaacgtgagagacatgtgtgtcttgtgtggagggcctctccaggtgagagggtggctgtgctttcactcatggtcagctccagtctgctcagggagctctgggcatccatgtgcccatgtgtcatccttgtgacatcccttcagtgtcagctacttttatcctttgatcaattgctccagggctcataatacatgatgtaattggttggaaacgtggatgtccaaaaagtgcatcaacgctcaaggtcatgtgtcctttgttttgaggtgtcactctgggcagagctgtccggtgcaactcaggggaagtggtgtcctggtgagaaccaagtcagaatgtggcttgaaatgagctcttgtatgaagctggcaaattatggcttatctttcctttagtaggttttcttcatttatttccttaatttaatggaatgccttagtgctatttcaattaaaaaatattgatggtaaatgtttgggaggacattctgcatcctttgatgctcaagattttctgttctccaaagcagtagagacattagcctcactcaaaggagagtaaaattatgttcaatgtgtaaacttgcttgctgcgtaacaaagtaatattatggcagggtgtttgacagagactctttagcttaatgaaattctatcagggagatgcagttttaatagcgtcgttcattgctttttgtccctgtagtctttaaaggctcacatgtggggaggacagtggctgcatctgagctgccagcagcagtgcaggagttcagatgtgaaatttcactcatgccagcatttccagcatttatttttaatcaggatctgcgcttaccgatggcctgttaaaaaggaattgtgtaattagcctactaaatcaccttttcttcctcagtctcttcacatctctgaaaaacagcccccatatcactgtggcttactctctctctctcaatatgttgtaggaactacagaagtttcagcatacccacaaatactgggttgaatacctcttttcaaacattagtttttgaaattgtagtcaggtttttaaaaaacggttgaatcagagtatatcaaattgtcatgttaacgtggtaacatcataaacaagtttccttgggagataaattttgtggtttctgtacatagagaccacctttctttttggtcgacatttcattcctcctgtgtttttgttttgtgttgtgttgtgttgtgttgtgttgtgttgtgttgtgttgtgttgtggagacaggatcttgctctgccacccaggctggagtgcagtggtatgatcgtggctcactgcggccttgacctcctaggctaaagtgattctctcactttagcctcccaagtagctgggactacaagcacttgccactacgcctggctaatttttttctttcttaaaaattttttgtggagattaggtctcactgtgttgcccagactggtctcaaacacctgggctcaagcgctccttctgccttagcttccccaaattctgagattataggtgtgagccgctgtgccgagccagtttctcctaggttttaaaagattgactttatagtttggatctgcaaataagttttaaaaaattgtagaacctgttcccatgtatccttcattcagtctctgccctcattattgacattttgtgttaccatgtcacagtggtcacaactaataaatcaatactgaaaatctctttgaatttataacaatgtctgattatttagttttactaatctcaaaatttggaacaacataaatcagcaactttcaaggtttttttctgaaagaaagtagcttagaaatgtatacaaaagcaaatcaactcaaagtgtgtgtttatcatttagaaaggtaaaaatctatttttcctatcaaaattatctcttaatgctttttaatttattttcttgagtttagtaattctatcttgctaatgtaccttcaatttctacttacttagtagaatgttaatattacagatcgagcatccctaattggaaaattcgaaatcggaaatgctccaaaaccccaaaatttttgtgtgctaacatgatgctcaaaggaaatgcttattggagcattttggatttcagatgagagatattgaaccggtaagtataatgcaaatattccaaactctgaaataatctgcaatctgaaacatttcttgtcccaagcattttgaataagggatactccacttttattcttattcaccaagaaaccaccagagaagacatcaagcatcaagtgaaagctacagatgagcactttacttttttgggagtgctgtttgttcgtataaagaagtgaggctttttaagaagtggcctttttaggccttagcacctttttaagctgatcactgtctccttgtctatagaggggacccaggaaatcttaggtgacagtgaggctcagggtggagcttggttacttgtctcagcatcaagggacaggatcaggggaaaggatgctgagctgtgcttgtgggtgagaaatgagttaattaagccctttctgccatgataactctggtgtttgttttctgctatttaggctatcaaagttagttagtgactcacagcaaaaagaagatactgatattttcttgggttttgtttataatcatgttttgagcttatatagacatgctctttcttaaaattcatttatttgcttttcatccatggaaaaccagttttttttcaatgagttataaagtatttaataagaagagattctgatttaattatatccagagatggctttggatcatgttatttaagatggagaatgactatttagaaatattaatgtttggccgggtgcagtggcacacacctgtaatcctagtactttgggaggctgaggcaggcaggtcacttgaggtcaggagttcaagaccagcttggccaaacatgttgaaaccctgtctctaataaaaatacaaaaaatagccaggcatggtggtacacacctgtaatcccagctacttgggaggctgagggaggaaaatcacttgaacctgggaggaggttgcagtgagccaagatcatgccactgtactccagcctaggtgacaaaacaagactctgcttcagaaaaaaaaaaaaaaattggtgtggtagtgcatgcctgtagtcccagctgcttgggagcctgaggtaggaggatcacttgaacccagtaggttaaggccgtggtgagctctgatcacacccctatactttagcctgggagagacagcaagaccctgtctcaaaaaaaagaaaagaaaagaaatattaatgttcatatgtatctatatattatctatatctgtatatttttatattataatttaaattatttcagtagaaatttgaagtaggaattttagggagaggaaaaaaggagtgcatgcattaaacattcctttagggtcaagacgatggagccattgagtacattttaatgaatgtgaatgttatctgggctgctagaaaagaatgaaaaagccatacttaattgtttaaggaaaccatagaagaatctactgttgggtaagttgctacccaaatatacatacattctttttcaaaatatatcctgaagttcatattttccaccattaaatctattctcttcctgccaggaaacctgaactagagaggtttggaggtcttatgttgttacgtgccaaaaatatagaaagtaatttatgagaaggacaagaattgtgatacattactaaggcgcatgtaattttctaagtactaaactgacaggtgttttatatatatatttatgttttattggtaaagacagaaaacaaatacatcttagtcaaacagtgttccccgacttaccccatcaatgccaagggcacaggagggggtctgcagtaacttcctgaagcaaagcacggaggagagcaggtaacccatgacatgacctggcttgcgagccttgatgttttctgtgggtttcattctttcctttgagatcccaggcaaatgacacaacataggttgtaatggaacccctccttttccttgtttagactcttgaacatctcatattgctcctgactgccagcaaccaaatgaagggcttcattagttatagctaattaactacacaccagactgaaggatttctagccaaggagtttggggttgctttggaataatagcgagaagctagtcttttgagttttaactgttggatccctagcttagaaagttaccagtaccctttttaattttttactctgtaatgggcaggaatagaaattatgtacaacagtggaaaagtagaagaccatatcaaacctgatgtacccataagaagtagttggacgggcatggtggctcacgcctgtaaccccttcactttgggaggccgaggcaggtgaatcacgagatcaggagttggagaccagcctgactaacatggtgaaaacctgtctctactaaaaatacaaaaagttagcagggcatggtggcgggtgcctgtaatcccagctacttgggaggctgaggcaggagaatcgattgaacttgggaggcagaggttgcagtcagccaagatcatgccactgcactccagccggggcgatagtgcgagagactctgtctcaaaaaaaaaaaaaaaaaagatgtagttaatagcatatgcttctccttaagtgatcacccaagttgttggagtttcctaatcatcagtttttttctctgtcattttgagcttcctggaataggactgaatttgcaagttgaatgattatgcataaggctcaagaaaaacttgaaggcagataaaattgatttatactccttagctctaccctaccctatctacaggtatttcttggcggtcagtgaaggatcaaacaagaacagggttgggtaatgctgtcagcaggcccactacatcccatgccaggcgctcatggcgtcctgtctctgctcctgcctcactttccacctctctgcccagcccccataaatagtatgtgggaagctgggcacagtggctcacacctgtcatctcagcactttgggagccgaggtggatggatcgcttgaggtcaggagttcgagaccagcctggccaaaatggtgaaaccccatctctactaaaaaatacaacaattagctgggcatggtggtgcgtgcctgtaatcccaagtactcaggaggctgaggcaggagaattgcttgaacccaggaggcagaggctgcagtgagccaagatcgtgctactgcattccagcctcggtgacaggggaagactgggtctcagaatgaaaacaaacaaacaaacaaacaaaaaaaagagtgggtggggctcctgatgccttcgccattgtgattacacaatacttctacctggactgcctttctcccgctcccatccccaccttcacctgggaggcatgctattgcgttccccacagcacccaagtcaccccgtcatggctctgtcatgctgcatacaccactgctcctttaaagggtcatttctcactagacacaggggcagagaccatgttgcgtattttcttccatgccccaagccccagcaccggacttggcctatagcaagtgacaatgcttgtttttattaacgaatgagtacacgatcccaggaatctcgttgaagtccagttctccacgtggccacccttgactcccacagctgacctgggattgacaccgtggccagccctgttcctcacctgatgcctgcctgtagtcttcggccttgctgctccagaacttttcatcgtggcccctttagggccatggcagcacaaatacacttagtaggtgaggccatgaggacacctaccaccattaaggatgcctgtggggagtagggagatggaggataggctggtaagaccctgccagtgcgggcctgcctcagtgccttggaacgaggtattcccagtgcctctgagctgcatcccagtgtgtcctgagcacccatctggcctggcaagaagcaggcacgaaaggcatatgggccgtagcctctagcctcctgccacctgcattccaagccacgttccagtagcactttaactgaaacatctagctacacaagatgggctgagcactctacacagatgctggtccatgcagaaacaaccctaccccttctgcacctgaaagggttccctctgattagaaaaggtttgcttcaagttcggttataaaggaaggcttgtgcatagttagtggggaagccacagggatgtgcaacttttccctacagccctgaggttccaggcactaagaacttggcacgtctttccatgctggctgaaatcaaaatgaaaccttctttgacttttgccccttctgctggggcattgacattggggtttgacactggctcagacagtcaaatctggaagccaaaccttagaagccaaatcttagggtggcattaggactaagctgagaataaattctcagtgatcccattcatctgcctcccagtgtactaaagtaggactttgaaccttccagaaacctgatatgttggcaatttctcaagctttgactctttcttccccattgcctctaaaccctagcttgaattttactggctgccttataattgctatttgttaaaaatcaaaacgattttccatcctggtaaaatggtaaaaatatcagtagtttgcagacagtaaatatctgtctttaatacttcaaaaacaagccatatttgcctcctgcctgttttccttatgagggaattatgctgtggggtggtagagtgagaagggttaaatcactggggacccaccttccctcgttcctcatggaatttagatgaatgtgctcttgctaaattctccagaacgtgtatgtgcgtcacccccacgctgcccggcccggaggtggctggaagtctcactttgtttttcatctgctgggtggtgaccagcagagagcactgagcggactgttctttccaatgctataaaaagcctgtttgcaaaatgaggatttctgcttccaggggctgaattccacgtctgcattatgcttgctgggtgggtaccaggcacagtctgtggcttggtcgtagcctttgccatgtcttttgatgatgtgacatgcctgagacacatggtggagctctgcaggtggtgagcagccacgaggctgtgcttgcatgctggagcagaaccttgttactgctgattgaatagtctcgcagaccccttttctgtcaaacgcaaagccatgtgtttttgttccatgtggaaaatcacacacattctctagcatattacattgtcattatgtcaacatttttaaattttattgtttaaattgacgaataaaaattatatatatttatgatgtacgacatgatgttttgatgtatgcttacattgtggaacagctaaattgagctaactaacatgcattctctcacatacttatttttcacgtgtggtgagaacacttaaaaactaccgtctttggccgggtgcagtggctcacacctgtaatcccagcactctgggaggcttaggcgggtggatcacctgaggtcaggagttcgtgagcagcctggccaacatggtgaaaccctgtctttactaaaaaatacaaaaaattagccgggcgtggtggtgcgcacctgtaatcccaggctgaggcaggagaatcgcttgaacccaccaggcagaggttgcagtgagccgagatcgcatcactgcactccagcctgggtgacagagcaagactccatctcaaaacaaaacaaaaccaaccaaccaaacaaacctcacaaaactactgtctgcagttttcaagtgtgcagtatattgctattaactgaagtcaccgtgatgtagacttcttgaacttattctgcctgtctaaatgaaattttgttttctttgaccatcgtctccccggtccccccgctctccagtccttggtaaccacaattctactttctgcttctatgagttcgacttgtagagtccacttagaagtgagatcatgctgtgtttgtctttctgtgccttacttatttcccttaaaataatgccctccaggtccatctatgttgttccaaatgatggtatttccaccttttttaaggctgaacagtactccactgtgtttttagatcacattttccgtatccatccattgatgcacgcttaggctgtttccctattttgactattgtgaataacgctacagtgtacatgggagtgcaaatatgtcttcaacatattgatttcatttcctttgggtatattctcagaagtgggattgcagcatcatttgatgattttagttttaatttttcgaggaccctccattgtgctttccgtaatggctgtttacaaatttacactcccatccacagcacacaggggctcccgtttctccacatcctaacacttgttcttattccttttgttgatagtagccattctaacaggtgtaaggtgataatttattctggttttgatttgcatttccctgattattagtgatgttgagcattttttcatacatatgttggccactttttattttgaaaaatatctatccagtgatcaccttagccacacatgtactaaatatgtctgtccatttcctttgcccctttttaaaacaggtcatttattttcttgctattaagttatctgagttttttatatatttgagatattaatcccctttcagatatatgaattgcaaatattttctcccattttgtagggagtctcttcactctggtgattgttccttttactgtacaagagctttctagtttgatttaacatcatttgtctatttttagccttattttttattgtgctttttaaggttatatccaaaaactcattgctcagaccaatttcaagaggttttttttctttatgttttcttctagcagttttacagtttcaggccttaggtttttaatacattttgagttaattattgtatatggtatgagatgaggttataatttcattcttttacatgtggagatccagttcttccagcatcattattgaagattatcctttcctcattgtgtgtttttggcatctttgttgaaaatcaattgactgtaagtgtgtggatttatttccaggctctctatcctgtttcattggtcgatgagtctgtttttatggccagcactatattgttttgattactatagctttatattagatcttaaaaaatctggtagtctgatgcctccatctttgttatttttgcccaagattgctttagctattctgggttttttgttttttttgttttttgtttttttgtttttttgtttgtttttggtggttccaaacccatcttagaattgttcttttaattttagtgaaaaatgtcattggaattttgaataggacttgcgttggatctgtagataactttgggtaatatggatattatagcaatgttaattcttctaatccatgaacataaggtatcttccatttatttttatcatcttcagtttcatcaatgttttatagttttcagtgtacagatctctctctttcttggtttaattattcctaagtcttttattttttgaagcatattttatcacacgtttgattacttttattaatgcaactttcattaaacaaccagaaatttttgttttaagactcatctggtaattcttttctatcagagcagggttaaagtttgctttgaaaatgatcacatggagatcaaactctctttagcgaatgggtagactgaatccaaggctttttttttttttaacatttaaatgccctctccacaagccccaccacaaagttattttgaaaatacgaattcagtactattcgatacaagaaaatgttggtgtagtcagtgtcttacaatgtatattttaagtgtattgtaaaaaagaatattcagtgcatgaatttctttttcttattcttttttttttattttgaggtgaggtctctctctgttgcccaggttggagtgcagtggcacaatcatggatcactgcagcctccacttcctaggctcaagcaattcttcttcctcagcctccccagcagctgggacttcaggcacacaccaccatgcctggctaaacacatttctttggaagagtgccatttagctagaggcttggggatctttaaaaatactagaaatgacatctataactttgtcagaagcacattcactcattaattgatagaatcattgtccccttatttagactcaaggcttttgttggaataaatgttttcccttccttcttgtttgtgttaggctttcttcttttctttgccttttaatgttctttcaaacaaatagaagactgagtgcattcgctcagacatcttcatttgttcaaataaactccattttttcagacagacttgaacaaatggagagacagttcgtgtgtcacctaggtaaaggctgtctgctaggggtccttcaacaagcaaaaccaaggtccctgcacacatggagttcatattctagtgaggagagacataaacaatttatgcaatttgtgtcaacctgattggtgcatggagaaggcagaaaaggagggaaggaagtgagccaggtggtcagctggcagagaagcgttccgtagagggtacaggtagagtacaatcctgaagggtgcagaccttttagttctgcatcttggtggtcatatgtattggaagagcttgagaaaaatgaaaataccatttagcttaagaagttgtgagttatctgcaagtcaactcatttcaggagtggaagaatccccggaatgatttcctaatatcaaaatgtatgcaggtttctcttttgaatgtcttgtatatttagagagggtgctgtacaaagtctcttgttttccatacagcaaattccaggatcccttgctggatactgtggctggagcaatgtgagcaacagaggcagagtccgggaggtgatgtggggctggggcactcatcatggccttataggtctgcgccttggtccacattcgtactgcagttattgtttttatttgtgataatgattttatactaaataatggtgatattcctaccatatttaccacgtagtagtgtctgaggtttctgattctttcgaacaaatgcctcctgttgaccctgtttccatttaaccaatcaacctagatttctgctttttgccccttcatgacaccaacacagtgggttgaaattcaaaacaagtggacttcatttcatgatctcatgtgcttcttatttaaacaggaaataggagcattgcatttgacaacttttaactgtgtagccagataattagcttgtgaaaaacatactcagttttacaaacaagttgtgattctggaaagtaaaattagtcattatagtactactttgcggatttacctcccactgcatgctgttaagatctcatctaagcaagattaataaaaaataaaaaatcttgactaaacatctgttgcaaagtgactttcaatttggctcttcaccatgtgactagtgattagagtttttggtttaggttaaggggatttgatttgatttggcatggtccctttttaattttatgtatgaggcaaataactgaaatgtccctgattgtcataagtgaaaaaatatcattaaaatatttgaattttgttcaaggagattaatctctataaaccaatgttttgtattccctaattagaattatggtagtcaccagtatgatcaatgctaagtgtttatttggtaattaggaagtgcaagctctaaattttgataagattgatgaaatggcctcttctcatattttcattatgtccgtataaacataacttagaagttggaaatatgaattttgtctacataacagtggacatgctacaacaaacaaatatatagctacaaacaaagctatatatttacattgatatccccttgattatttttctcaatgagcagacattcaagagatttttttcccccacaaaatgtgatgtgaaacatctacaatgtatacttgccaagtgcataactattaacttactccaggtaccagatggtcttattaagatactaattaatgtcaactctgacaagtgaagctaatgtttaaattcagctgccagtaagttctctgtcagagcactcccaatagaatgtgagttatatgcgggcttctagaacaatgtccaaaacacagtgtgccttcgcaaaggtttcagcgaacggataaatactgtggctacattccctttctaggaaataagaattataaaaaatgttgatcttctaagtttaattttattatagtttgaccttacatataagttgtgttttgaaggtaccattcttcccttcttagtaaaaatgtaacagcatccatacgatgtgatttcggctgctccattttattgttgatctacttgttcttcaataatagaactcttgttttataataatttccataccatgtttgttaaccaataatatccataaccataacttgaggcactttgttatagctgatcctgaggttaggaatacttccttgacatgatacatacagtatattaaaccaacattcaaaataatagttaaaaattagacactaaaagcgtgcccattaaaatcacttaagaaaacaggcgcttgctgtcattattataatttgacattaccgtgatagtgcggcctgaggagtaagtctagaagcagaattaagacctacagtgattagaaaagacaacacaaaaatattgacagatgttggtttgatgtatttagaaaccctctccaaagtgggggaaaaatagtttggaagtaataggagaattctgtaggttcaattgcaaaatgtacacatcaaattcaatagtttaccctaatatacaaataaaaatacacaaaatgttcaaagggttatttaaaaaagcactccctccaaaagacacaaaaataaaaggagctgttaaagatccgtatgatgaaaaccacaaaacattcctgaaatggcataaaaatagacttgaacaaatggagagacagtttgcatgtctaagtgggaaggctgatattgtaagcctcttcaattaatttaaaaattcaatggaattccaatttgaatcccaataggaccttgtttcagactcaataatgtgtttctaaagtacatgcaaaagaataaattggcaggaatactcaagaaaaatgtgaaaaacaagggtaatgtgaagtaggccttgcaatactgaatagcaaaaccatttgaaagctacaataaagtattaattaaattgaaagtactctgtttctatataagtgtaagagcaagaaggaatcctttcaaatacaacattaattacatatggcttataggacatggtgattttcagattttcttctttattttaaaatatataaaatatatactttatattttatacatataaagtatatggattttatacataaaaagtaaataatatatgtacattttatacatatataataaatacatataagtatatatactgtataaagcatatatacttatacataaatctatataaagtatactttatatactttgtatgtatagaatactttatatatgtatactttaaacattatatactttgtatactttataaagtataaaatacgtatattttatacattataaatgatatactttatattttatatagtaacatccattcttcttccttctaaattttgacagacaatacagttgtgtagccactaccaaatacaagatttagaatatttccatttccgtaaaaatatttctcatgcccctccatagtcagttctctcttctttgtcactctagtactgccttttctagaacgacataaaaatggattcatacagtgtctagccttctgtatctggcttattttgcttagcatgatgtgttggagattcactcatgtttatttaccagtagtttgttcctcattcttgctgagtactattcatcatgcagatatgccataatttatttgtttatttagtaggtagtaggtgtttggagtgtcccctatgtgtggcaattatgaagaaagctctataaatacttgtatagaagtctctgtgtgggcatatcttttcatttctcttgggtgaattcttagaagcagcgtggttgggtcatgaggtgagtatattatcagctgtatatgaagctgccaaactatttcctaaaatggctttaccattttgccttcagaccagcaacatgagtttccattgttctgcatctttgtggtggttgttttttttttaattttagccattctaataggtatatagttatatttcagtgtggttttaacttgcgtgttcctattgactagtaagatagaccatgctttcatgtgcatcttggccatttgtgttccttttttgattaaatatctgctcacattttttgccaatttttggtgggttattttcttcttattggtttttgagagtttgtcatatactgcggatggaaaccctttgtcagataggtgtttttaaaaatattttctccagttctgcagtctgtctttttactttctgtatagtgtcattcaaagaccaaaaatttttaattttgatttaagttcaatttatcaattttaaaattttatgtttcatgctttttgtatcctaagaaatatattcctatgcctaggtcacaaaagttttctatgttttctttaaaaagttttgttgttttaagttttgcatttaaatctatgatacattttgagtcaatttttgtatacggtttaaggtatggctcctttctttctccctccctccccctctcccctcccctccttccctctctccttccctccctcctttgctccctccctacttccctccctcccatcctccttccttcccttccttccttggtatttgggtatccaactgtttcggcaccatttgttgaaagtacagtttgcacattgatccttcttgacacgggttttttttttnnnnnnnnnnnnnnnnnnnnnnnnnnnnnnnnnnnnnnnnnnnnnnnnnnnnnnnnnnnnnnnnnnnnnnnnaccacactgtcttgaatctgtagttttataataagtgcttaaccatattgagtcttccattccatgaatatggtatattcctccaatttttaggtcttatttgactcccgtgtcaatgttttgtgtgtttcagtatacaattttgtgactttaaaatattcttctgtatatggttttgtgttttattcttcatcaccatcatcatcaccaccattcatttatgtagccagccactgtgcaaatatccttaaatacatatctaattaaacttttcaagaattccagattttagaatcatgatccgagttttacagatgaggaaaacgaggctcagaaaggttaaatagcctgttaaaatttatacagcaaacgtacccttggtcaagtgattattccaaattgtctgcctttgaaacctttactcttgactcctaaactaattttgtatcatttatctatataacttttgccttaagaccaaaaaatattggccgggcgcggtgactctcgcctgtaatcccagcactttgggaggccgaggcgggcagatcacctgaggtctggagtttgagaccagcctggccaacatggggaaaccctgtctctactaaaaatatgaaaaattagccgggtatggtgacgggtgcctgtaatcccagctacttgggaggctgaggcaggagaagcacttgaactcgggaggcagaggttgcagtgggccgagaccacaccattgcactccaccctgggtaacaagagcaaaactccatctcaggaaaaaaaaaaaaaaaagacaaagagtattataaactaatgaaaagagcgagggtgatgttgggatccatatttggcagggaagcaagatatttgtactctttcttacaacttccactgtattttgttaagacctgaatacacctctacagtggacagtccaaataaataagccattcccgtacttaagaagcatgcatatggtggagctttatgtgcaaaagcaacaaagccctctagttatattttagctcctcagatacttttctgagtgattattcctgctgcttaaatctctgtactactcccttttgcccaagttaaaatacctaaatcattggttgtagttctattattgtattcagtaatagttcctttgattggaaaagaaatacctcctttttagaattccctggcagtctgtaataactcccttttataatatttgtaacattgtgtcttaattaattgttgtcatataagtcttctcactagattgtgagtagaagctgttttcctttggctttttgagatgtttcatatgtacaaaaatgttgaatcagtattagtgttaaacacacgtacccacctaaattcactacatattaacattttgccatgtctgcattatccctgcatgtgtaaactttcttttctgacataccaaaaagttggtcacagacacagggacacatcattcctcgcttcatgcaactcctatgaataactgctctgtaggcacaggaatattatgatgcctatgaaaatgaacaatgattcccgaatagaatgtaagatctcttccctgtgaggttttccctttgaccttaagggtccccaccatttgtcttgtcaaatgctgtatactctgaatctgtctattcatttcctcatgatggaacatttttggcaaaaaaagtaactacttaagtgatcctgtgtgcttagcattctacctaaaggcccatactataattaggaagaatctatagggtgttgttttcagattgagtgagtgtcttcgtccccaaagaccttttacctcgaggtttcagtgcccattgaggagcctcctctggaccaaccattcctttaggagttgaaaccttcagttatcaagttctcttcttcattccgtgtttttttggctcatagtcttccgtaggtcacagctttacttttgccctcaaccctgccacgtcgcctatatgtctgtgtagacacatggatttttttctcattcaatttgctacatttgtttgttgtcatcgttcattttgatattcagattgtctcaagcatcccacacgtggccaggggagcctccccacaccacctcctgtgtccttttgacatggccccactagcctagaagaaagacgtgacccagcctcccactgaggtcattctggtcaggggctgtttttatctcctgctgacctactcttgggaactcaatgatgtcaacacactgcacactcattgaatgttggttgagtgttgcacttggcagtgctcttcatggttttgaatcttcttgtcattttagccttatcccctccatttctcatgacccattctagaaggacccatttagggaagcttcaatttcccctggggtgtggggaaagtgagacaaggggtggaagtagaacctcagtgggttgtgcttcctgtgttgatgctttcctgcacaccctgctggacaggtacagggctactgcagaattcctcgtgggttcccacaaattgagtctcagtccaccacagtaggcgattttgaaaataagcattaggcatttatgactaaaatcactttggtagcttatgtagttgtaagtagataagctattggatgatcacttgtcatgtgcagtgtttgagcatacaaccgcatacaacatatgtatgtattatgagtacatacatatttataagaaataccataaaagattatctatgtttttatttactataatctcatatttcaaagtatcttttattctccttacgattcatttatttaatgttttaatactttataatacttaagtatcatcataaatatttaatacttaatatttaatgatgtgtgtgacatttctccttaatacatcatccaaccaatgttaacaatgttgaggacagtatccttttatgatttatgtaaggcattccattttagctaagaaagagtttcaactttcatttataacaatgataattgtagtgtcctttatctatgaaagtcagtttaaaaacacgtatagacatattgatcttctcttcaataataagagtttttttaagaccgagttacgctcgtttctattatagtgtgttttcagatcctctatatcatgcgataagacttcgaaaattctaaactctctaaggctctattattacgtgatatattgagtatataaaaataacgtataaaattttctgctttgctgtcttgctttaggatcaaatgaattatattaagaagctgcaaacaaagtatatagtcctcattacaccataaactataattttgtatgtaatatttgattataatttatttttatacttcataacaaatgtgaatatgtgtttaaattattatactttataagtagcaaataactgttatgggtaatttaagatccagatattcccttttggtatatttgtccaataaacatcttctgcaattactgccactataaaaatgaaatcgattttgtttttaaattatatttctttcctttagtgcctggaatggtatgagatactagtactctataaattcactaagcactcagtttaaatttaagaacaggttaattttgttgtagtagttccaaatagctaaaagatgacattagtgtaagttattttctgttttatatagttttggcttttttttttttttaacaaacattcctcactctaaagttctttataaaataaagaaattgtaatatttgggagattaaatgagtaaaaattaattatatattgaataaaggcatcatgggaatgaattcatctttaaatgaaaaaaggaacaatttcaccatgggttgtttatatgggaaaggttttatgagttcactgatgagaatggacacccattttccggtgagcttcagttttaacaataatacctgaatcagcctttttattatgtcttatgcttaatcaaatatttaattaataaaacgtgacatactttttgagggcacagcgatgactcctgacattcaatgtatgcggcactgcacactatcctctgtcctcattttacaacatcgttctttctatatttttaattattctttctttcttatactccccgcccccttaatcttaaaaggattttgaggtagctttaaagaaattctatataatatgaaaacacatgtgtgagaaaatcaaagcaacaaggagaagctatctcatttctatttcaacaaatataagtgaaagaacaatgttacaaggattatagaattttgcaagatttttccaagtatgttattattttaaatctgagaaatatgatagttataagggcaaatcgtttgacttgtcctgaaaatcactaagctgggggaggaatataaggaagatatgatgatcatgaatataatctcatatctacctgaggatagtaattatagttctttggctgggcgcggtggctcacgcctgtaatcccaatgctctggaggccaaggcgggtggatcacctgagatcaggagttcgagatcagcctggccaacatggcaaaaccctgtctctactaaaaatacaaaaaattagccaggcgtggcatacctctagtcccagctactccggaggctgaggcaggagaatcacttgaacccaggaagcggaggttgcagtgagctgagatcgcaccactgcactccagcctgggagacagagcaaccctccatctcaaaaataataacaataataattattattattgtagtttttttacttctcttacattttctaaatgttcttcctttcctctgggttctgtttttgtttgtttgggcctcctttattaatgctggatgaatttttttcacaaggcccagtactcttgctcagaccctctgtctccaagtttgtgcacagagcatggaggcgcatgggctttcctgcatggcaagcctggatgggctgagctgtcatacttttggaacctccatgcttagtattagtgcttatgttctctttggctggtcattttcaccaaagaggattcttctggtcttctttctaggtttggtttgggactaaggttaggaggggttagtttaagcctccttgctgatatgctgggagctgagcagaaaagagagaggggagtatactgtttggtttgacatcaaactaaacaggtgtttcttccaggtggttcttgtcattttcttctgcttttcaggtacctcccttgtccagagagtaaacatgtggtcctctccccaggagtgagttggagagcccctcactggacatgctgggcataggcagactggatatagggtcacatttcaaagccatcagcactgttgtttttcatctcacatgtagcctcctgagtacctggcaccctccagtttctgggccttccttgggttttgcaccagggattcacagacttcctgttaaatgtcaccacgttcttgccttgagggcagttggtacccactcatcaccctctttcctgcttccagaattctcttgtctttagttgcatctcctcagagtcccctggtccttgtgggcttgtgcagttttaatatgtgccttactgtcatttaatgtgaggaactgggaatgcatgttttaaatagtttctaatttgtgatgtaggcaacccctaagtatattttgaaaaacttcagctctgtgcagactttgcaggagtttggggctaatttataacattttgaggttttgtttgttttttggactccctgtttttctctttcatattttctcacagaaaataccacctatgaacattttgccattggctttccctctacaaaagagaaagccattgtgctctgttggccttctatcttatcagctctaagaactcactcatacttggatttatttcaaatcattttaaagaaggacttgactctcagttacattcccttttcctatattctcttcttcataatattgctttacagtattgattctttggcttgaatgcgccccaaaagaaaaatcatccagaagtcatcaccattatgttttttttgttgttgttgtttagtaatatattttaaaatgttactggataattcattttcattgctttttatgatgattataagatgggtttattttcattaatatatttgaaatttaagcatttgagtgagatttcctcttcaaagtccttgccttagtgaaaacacggttaaactttgtaacaagacctcagttgaaatcatgaagcataatcccggattcagtcttcagggttctccttttattgaaaccgggcacctaccgtccacactcgtcactcctgtgtctctgtttacagctccaacagcttctgaggctgggaactgcccagagatcctttggaatttagagaacttagaagaacgttaaaatttctgcctgtgttgtgtgtcccagagagcaaatctgtgctttgtacaaagtgtgagctccagggtcgattgagacagctcttgtctggctgatgaaattaccaggagcaattttataccctgctatccaagtcacatggctaagtccatttttattacaccttcacagctcctcaagaatatgaattaaaaccctttggatttttttcttctaattcatacttagaccttccactaggcatagttgacaaaggcactgtttaaaagatatgtctcatcctgagtttccattcaccagtctgtgcttttgttagccttttgtttttatatcctgcaatgacatcctgcattcaacttgcctgtcaccgaatgtccccctgctccaccaccagcaccccattctacctgtgctgttttccttctactgagactcacttccacctgtgcccagttccacctgcctttccttctacccagcctcagttctacttgtgctcaattccacctgcccttccttctacctgtgctcagttctacctgttctccatttttcctatcaacctacctagtgaaatgggggcccaaacacatttaaaactggggcactgaggtacttccaggagggctgggggtgtgcggggacgacttctgtccagggctccctccaggagcagtgccaggcagtagccaaggccacaccaacagggggagccctgcgagagagattttttaagacaggagcttaagaaatggaactagatcaggggcaggcagggagagtttgtccctcctgccagatggatccttttctttctggaccacctttaaaaatattaacatactttctctttataaaaacaatctgggcttagtctccctccactcatgactatctggtatcttttctagtcattttttgtttttcttgtactatatattctttatattggtcaaatgtgtatacataattactgcagttttcctcttcaattattttctcatgctattaaaatattccatatttgcataatgtttcatgatttaatggttgcacaatatttcatcataacacaagttatgattgcttgacttgccaaataaaaatataagacccccagttcagcttgaacttcaggtaaacaacagttttttttttctagtatatgtatctctcatgtaatatttcattgcaacgtttgggacatatttatttttctttgtttatctgagattcaaatggaactgggcatcctgtactttatcttgcaaccctacaaaatatcacattatttacacagtttcttgtggtggatgtttagaattttcagcaatgctatggacatctttgggtatgaaattttctattttgaattacttcctttggtagattatcagaagtagaattacttaggagatgagtatttattttcaagacttttcaaacctatctccaaatcactttttaaaaaggttatagcaatttatgttcccaccaacagcacacaagagtcctcgttccctgcacccttgctcacattatcatcattgaaatacttctttgctattttggcaggcaaataatgatgtatcattttcatctttgattactaatgaggttcacttttttttgttgtttattaggcatttagtgtcctggtttttaaattttctgcaagtatatcctgacttctgtggccccattttgcattgctttgaagttataaggaatatgtcttatttttacttattgacttatttttactcagctgctggtgctggagcctagtccctatgttcaggctcagggatggttctgcacagtggcttttgctcccagcctacctgctagcctacccattgtctagaagataaaagcttcatttaggagtcatctcccaaatgcatttaaaataaatcagttaaagcacagaatagtaattttcttctgagcacacagaattaaagttttattttcacagagctcgctcacttttgttcctaataaatgactggtttcaaaaggcttccataaatacccgttttatccacccttataagcccacagatatgctgcagggttctgctgtgttcatggaaaccataaggcttcatggtatctgcagtatttgcccaaaaaaatactgataacccaaggatgggactccattcccaaagggcagggaggaaggggaggggcatttcagtgaattttaatatgcagatcatccgtttcctaatggagttcatgcttcaccttagagctgaaaaagcaagacttactttcgctaagaaaggaaagactgaacgatgcacatgacttctggaacatttccttaagtttggtaaagagggcacgcacagtgcccggcagcaccgcctctaacttgtggagatggcccatccttctggcccttctgggcctcctgtaattaatccccatcgcagttaaacaaggggccgcgtggttgccttctctgatatgctcttccagagagacttccccacggggcatttacatcctcccaggacttgttttatggaaattgctgtgttcgcttcagtttttcgttttctgtgttacaacggttttggcatttgttgccttgcatgaatttctccgcatgacgtgacagtctgctgcctgaattcagtatgtccacgtcacctgttcacgtcatctggcctgagtctggctgcactgatgtttctcattagtgttactctgtgctcataccctcagcattttgagaccccctcaaggattatgcttttctttctactttcagcctgatcatttaagctaagcacattgatacattgcttctggtgataaatagctgactttgtgatttcatttattctaatgtgtaagtctccattgtgtaactggtttgacctgcagaaaattgatttcagcacctactaggttcacctaggctgatataggcctcttcttcagcgggaaaagctcctcctctcaaggggaagagtccgggtcagcgactgcatcagggtcaattgtgggcagagtacttcgaagcctcttcttcctcaccctcttccagctttctctgatgactgcaagcgtagaggaaagtgaatctctaccttgtgttggtcatcagaagtggcttcagattccttagaggaagagttaaaatgtgcatctggatgaggggtaaagaaatgaggtcagccagtaagtacctgtcttatagtcctagagtacagcctccacacccagctttgccattcactccttcagagagtgaaacctctaagcctcagtttcactgcctgtaaagtggcacaggaagagaaatttgtgtgtgattgaaagaggtcgtattctattaaagtgacagtgttgttattaagacgattatccacgggacacatctcattgtcataaggagtagacaagatacaaaggcagcctttcttgagctgaatggtatgccaaatatttatatgtttcaaaagttcacaaattttgccattttactaatcattgcctcaatggaaaacaagcattatttagctgtttccctgaacaccaacttggaatctaaatctcagcaattatcatcattcacaaataatttatatttctgggcaaatggaagatatcatatcatcattattgtgtttgttcaatttgagtaatgcgtccttcgaggactcatttggaagtagatatgtgtactataggtataaaatggattggagaaaatattggattttaacatttcactgtaaagcctgtattccaaattaatataaaagacatttaggcattctgatatattgctggtaaaaggagagttagtaaaagaatgcaatttgagagctcatttaatagagaaaaaatagggacatgtctcaaagtgtgtttcatgctataattttaccaaacttgtactggcttaatgggaaaaaatatatatcctgtgtttcttaaaatgtcattaacttagggggcaatatttaaaagcaaggaaggctttacaatgttgttagctacaaagcctagcagtgagcaattgcagttaatggcaacagaactgcctagctcacaacccaccaccaaagcaaacacccttcagggcacgcaaacaaacgtgtgcacacccacgtccacacacatactggctgcctccatttgcaacagccggagagacgtttcagctttggccctttaccttccccattcttgattttctgtgttgctttcttttttcctccttcttttcctttccacccagctccgtctggtctgagaaactcccagctctcccacttgacattctgatgagcccacattcctcctgtccttcttctcggggaggagaattgggccataactcattgtggagttgtggtgattgcctccacatcgggcacagggggatacaggctgattttgagaaattagaggcctttctttgccatggcccaagaggagaggctgcacacacattttgccggataataagggcagcaagtttccaagagagcacaaaacagaagttcccatgatttccatcctgtctttaattttcttgtatttaatgcaaaagtatttcaagcttatttttccagtctggacaaccctgtatcaggaaacacttgaggtattaatagttagagagaataaaatacagccctgagtgtgagtgcaccagtgtttctcattcatgttactgtgtactcatgtcctcagcattgtgagaccccctcaagggttttgcttttctttctactttcaacttgatattctaaggaccccctaccaaaaaacattcctgaggttggaagtgacccatgccttatgctgatcttccctgagagaggggcagcagaacccagggctccctgcccatgccccgttgcttctccctgacagtttcaagtcccagaatctgggatgatttcggcttttcccatgagtgttgctctgtctcatctaattctatcttttgattcatttacagggaaacttcgtggcttgcatgacagctattttacgacaaatggaagattaccattatgcccacttgatcaagacttttgggaaaatgaggactgatgtggtagtaagtgtccctttcaccctgttcacataaccacgttttagggccagcactttagacaaaagcctgatatcaatatattcatttaaaataggattttgcatgagaacttgtctctgattgatttcaaatgcctcctgggaaggtctgactgaagccttgtttctaacaagacaagggtccggacttgcagacttgcttctagggctgaatggagaatgactcaggggctgagcccagggaaatctcttgtctttcttggtgacagtttcttctcctgtgctttgggataattggaaatttggagatgttatccatggatagtctcccattaactcctattcatttattggttgactttttaatagcagaagccagagtgacttttcagctttaagttgtactccattattaattagctgtaatcatggaagctcatcagcatttctccaaataattctctagtcatcctcagtaaaactatgatacaacttaattaggaaaagtataacagaggggaatttattgcttatgaactacctccctaatgacctgaaattacattgccatatggcaaatatcctctgcaaagctgcaaccaaacttgttggcagactttgtgattacatgttgacttgaactctaagattccatttctaaggatctgtaaggtcctgtagaacagggtccccaatccctgggccacacagcaggaggtgagtggtgggcaagggagcattagtgcctgagctctgcctcctgtcatatcagtggctgcattagattctaataagagtacgaacgctattgtgaactgtgcatgcgaaggatctaggttgcatgctccttatgagaatctaatgcctgatgatctgaggtggaacagtttcatcccgaaacctgccccaccaccccctggtccatggaaaaattatcttccacgaaactgatccctggtgccaaaaaggatggggaccgctgtaaaagaatactcatagatacctgcagaacatggcagtgtactagtgtttctagaacaggggttgttgcacttgacatgtaccttattaagaaatgggaagaagagaatgatctgtatgagttttttcaaaggattatttctaatacataattttcttattgttgccactatatatataatgcatagttttcttatatatctatagtggcagcaataagcaaattatgtattagaaatgatcctttgaaaaaataatatttttatacttatatatacatatatatacacatatgtacatatatacacacatatatacatatatacacacatatatacatgtacatatatatacacacacacacacacacacacacacgcagtcgtgtgttgcttaacaattctgccaaatgcatcgttaggcaatttcatcattgtgcaagcctcatagtgtgtacccttacttaaacctggatggtggagcctgctacacacctaggctagatggtctagcctgttgctccgaggctacacacctgtacagcatgtgactgcactgaatactataggcagttgtaatacaatggctatgatgtcactaggtgataagaagtttcagttccattacaatttttggaccactgacatatacacagtctgtcattgaccaaaatgttattacgcagcacgtgactgtacttcaagatttctaaggagaacaaaaatggatctagaccttaaagctctagcagtttcctctaaataaaagtaagggaacaagaatatgtatatgtttgtatttctgtgtctggttttccctgaatattaataagtagttgatagtaggagtatattcaaatgtgtaacctgtatcctgtttatatcccatgactctttggaaatcatggcatagcgaaatcaaattttacatttgtaacattttattccataattgaatctaaactacacccgaccccctgctttggtcagtgtaaagcatagttgtagcttaaagctagaggaacagttttgcagataacgttccaggttgaataataaagtcttcagaaatagaagaattactcacctggaaaagtcaggactccaattagtactttgccctttttcagaacaatcacttcataaaagtccccatgtgcaaacatgtaatctgaactattaagtgctgtaattgataaggatccttcaaggtaagtgaaaagcgatgatgccgaatggcatttaaaaattactgtagcttgctgaattccaagtgtgtgccctctgtctttgctcagatcccaggatcagatgtttactgtgtgttgtggtcccaatttcccaggggatgtttttccatagacacaacagtttagaaaaatcaatgatttgtagacaatttgacttccattaagaaatgatgttggccgggcgtggtggctcacgcctgtaatcccagcactttgggaggtggaggcaggtgggtcacctgaggtcaggagttcgagaacaacctggccaacatggcaaaaccccgtctccactaaaaatataaaaattagccaggcatggttggggggcacctgtaatcccagctactggggaggctgaagcaggagaatggctggaacccgggaggcagaggttgcagtgagccgagatcgggccactgcattctagcttgggcgacacagtgagactccgtctcaaaaaaaaaaaaaaaaaaaaaaaaaatgacgtttgtggttttttataccacaaattagactggaaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttgagacagagtttcacttttgttgcccaggctggagtacaatggtgcaatctcggctcaccacaacctcctcctccagggttcaagcgattctcctgcttcagcctcccgagtagctgggattacaggcatgcaccaccacacccggctaattttttttgtattttttagtagagatggggtttctctatgttggtcaggctggtctccaactcccaacctcaggtgatcctcccgcctcggcctcccaaatggcctcccaaagtgctgggattacaggcatgagccaccacgcccggcttactctgacaactattaaataaaagattattttgtacagaattatttgatgttatttcgtatttcaatatgaaagtggccaaaacactttccatttttttttaaattttattattattatactttaagttttagggtacatgtgcacaatgtgcaggttagttacatatgtatacatgtgccatgctggtgtgctgcacccaataactcgtcatttagaattaggtataactcctaatgctatccctcccccctccccccaccccacaagagaccccagagtgtgatgttccccttcctgtgtccatgtgttctcattgttcaattcccacctatgagtgagaacatgcggtgtttggttttttgtccttgcaatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccacaataaacatacgtgtgcatgtgtctttatagcagcatgatttatagtcctttgggtatatacccagtaatgggatggctgggtcaaatggtatttctagttctagatccctgaggatctagaagccacactgacttccacattggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttttaaatttgtttgagttcattgtagattctggatattagccctttgtcagatgagtaggttgcaaaaattttctcccattttttaggttgccttttcactctgatggtagtttcttttgctgtgcagaagctctttagtttaattagatcccatttgtcaattttggcttttgttgccattacttttggtgttttagacatgaagtccttgcccatgcctatgtcctgaatggtaatgcctaggttttcttctagggtttttatggttttaggtctaatgtttaagtctttaatccatcttgaattaatttttgtataaggtgtaaggaagggttccagtttcagctttctacatatggctagccagttttcccagcaccatttattaaatagggaatcctttccccattgcttgtttttctcaggtttgtcaaagatcaggtagttgtagatatgcggtgttatttctgagggctctgttctgttccattgatctatatctctgttttggtaccagtaccatgctgttttggttactgtagccttgtagtgtagtttgaagtcaggtagtgtgatgcctccagctttgttcttttggcttaggattgatttggcgatgcgggctcttttttggttctattttcttgagactatttccttttaacaagtactaattcaggttctcaaatttagccctttttggttgagtgagtcattttcatacaaaatcacacttactatcaacaccagtgacagtgagcatatagagcacaagcggaatgactgatccagaagagaaaaacaatagacatgttcagctcagaactctgaggacagagaccatcccaacccttttggattcgaaccacaaagaatctgtagaatcttctacactggagatgctgacctgcccaaggggctgctggctgccacgtgtccacgtctcagtaacagaagcagagaatgtgccccgattctctgtagttagctagaagggaacaatgacggctttggtacttctagcggagaatgttgtcttgccacttgtcacaaattcccactctgtggctttggaaaacacactacattttcctacactctcacacttctgtgaccagaagtgtgtgggtctctcccaccgcatcccattccctgacaccagctggatgtcctacaattcaattcaattctgacaccatctacctggagttagcatcagattctgcaaggaaaagggcttatctgaccttactcagatttcaccagtgttttacttattctctttccactgtggatcacaaaaaattttacaaatacagaaaagctgaaagaataatacaatggagccaggctcagtggctcatgcctgtaatcccagcactttgggaggtcgaagcagaaagatctattgagcccagaaattcaagaccagcctgtgccacatagtgagaccccatttctacaaaaaatataaaaaaatagccaggtatgatagcttatgcctgtagtctcagctacttgggaggctgaggcaggaggatcactttagcctaggagtttgaggctgcggtgagctaagattatgccactgcactccagcctgggtgatagcatgagaccctgtctcccccccccaaaaaaaaaaaaggaaaccatgattcctgccacctcaattcatccgttgaaagcacgttggcatatttgcttccgtcatgtgtctccaagtgtctctatctatacagccaacccctttcagtcagtgagagacagggatgcacctgccctaagctgttcagcaaacgtctctggggactaaagacattctctattggtcatattgctccatgagaattcagcaacaacccctcatgccatttgtattcagatttcctccattctttccaaatttttttgtccttttcacgcattgcatttgatgattgtgtctctttaatctttctttttctaaaataaatccatcaccatcacactgttttattttcttttcatagcattgcttttcagtttttttgaagagaccaatccactagcttttgtagactatctcccattctggactttttttgtgctgccttgtaatatgcctttcgactggtttctttatccccctgtatgttctgcaaaccagaagcttgttctgagattcaagctcaactccttggcaagagtgtttcagcattgctgtcgaaagcttcctgctgtgttacttcaggaagtaacacaggaagtgggcttgtcatgctgacccactactggcgatgctgaatttcaccactgggttcaaagctggtaacttccagatccctccattgtgaaagtatgtacctcttcctacctttgcaattgtcagataatctttggataaaactttgaatccacaaaaatgtggccatgtcctatttccctaacaatccttcatcggatgggttgaaaatctgtggctggtccttgtccataatggttactcctttggctgagcagaatggaaatttcctaagtctaagagtgaagatgctttgtctttagtctaagagcattgggaagccattggggaaatgggttcagtgtgatgtctggaaagcattgatgccttgatgagatttgtcatttgaaaagtgaagcatggggacaagaaaggacaaggatggacctaagttgatggatttggagtcccctgtggcagtccaggtgcgagaggatggctgttttattctagtgggtgggcacagggatggaaaggtgcagacagaggtatgacacgattttgcctctgaagcagatggatggctgctattagagcagcctgcttattgtataagacatcctgtgaatagtcaaactaaaacatgcagccgggcacagtggcttacacctgtaatcccaacactttgggaggccgaggcaggaggattccttgagcccaggagttcaagaccagcctgggtaatatagcaagatgccatttctactaaaaataaaaaaactagccaggcatggtgatgcacacctgtggtcccaggatactcaggatactgaaacgggaggatcacttgggtcccagggttgaagctacagtgaactaagatcgtgccactgtactccagcctgggtgagggaatgaaataaataaataaaataaatagaaactaaaacaaaaaatgcaacaggaataaatccacattgaatgatgaaattttcacaaaatatcccttgttgacttggagaccctagtggaacagtccggtaagcctcatcagctgctcaaggcaaacacagttgttaggggccaccgccatggctagtgaattatgcagaaaacaaggacgccttgcagaacctcatctcccactagatgcagcattttgtttgatcagcaaagtaccaaaatttaacagctgagccatactaatgaagtatgggactgtgtctcttagaaaagaaagagaattgggaaaatatgcttctcttccagaataataaaaacgagaggctgtagctcaattattaggctttgagaagtaatcatcaagaaagccagcaatttcatgcaaatagagatgtgactgaattacggtactcagcctacaaaatatgcagcctggtcgttaaaatgggaaactcttgacaaagtgaggaaactcagtagtgaaatatgaatttcaataattaaactggaaaagaagccatttgttgtgtcggaagggaggactgggatgctcccgctcctgagagcaggtggacacagtgcccacgtacagagtttggaggacatctggactgacttttccaacttgattttgtctgggtcactaatgtctcctagactggaggcatctgctctaatagagtgatcaggatcactcattttatttatggtgggggcacaccaaactcctcacactacagacttcacctgctaggacctgactttgccattagagttggagagaaagtatcttaactttgaacattagcttgttagtgtcatcaattttaacttgtgcctctttgcaggagctgcttatttagaacttcgtactgggaattgctttcttggctgcttaaattctgttcaccaccttggccttcacagccattgcacctaattatgattcaggagattaaataaatgagaaatatccactcatttggcaatccctgaccatggcctcatttttctaagacagttctcggttgtcttttcatttcctaccttgagtgttgagtgagcttggggctaccagggatgtgtgctttttgggatagccacttgttttgttcaggttagctcagagcacctgtcaagctctggaaagtaggaaaccttctaattctgatagacacatactggagtccctaggaaccggctaccccttcctgatgtcaggcacattccatggaagcagggtagagcagctgggtgtgtacggaaccctgcttcttttcagttgccctgcgaagtacacagcatcatctaagacatcagaagcataactcggtagcttttggggatgtagctgccatctaggagagtttggcaacacggccgcacactcaaatggtttattgcatgccaaatctgtgcagatggtcaggagtacctgttggagcctttcgttttgaaattccgtaagagaaaggaacagacagtagtatcccgtattcaatctgatgtgtcctgttcatcatgaaaaattgatttagagcaaacataagaaaaagctgtaacctgcaagccttgtttgttaaaatcatgttttcctagaagcagaaagggcttgaatgcctattcctaacctttggggatttactctttaactattagagagacatgctcagggactgtttcagaatatattcttgaagaagccgtctcagacaggaggtgctcaggtaaacagaaagacaggtctaattcacagctcctatgaaatatatcttcattacttttcaggatgtgttcattcagcctttaaaatggggtattttataatctaattgacaggagggtatcatgtttacctttttctttgtgggccatttcagtgttttgtttttttatttcaggatttcctaatggaaacattcatcatgtttaagaacctcattggaaagaacgtttaccccttcgactgggtgatcatgaacatggtgcaaaataagtaagtgtggggaaaacggctctcaccttttctatggctcccaattcatgtctgctgggaacagtggtgttgcctggagaccaagctggcttcaataaaatgctctgcaaacgctgttcctaattctgtgctgcagacagttctagggagacagggactctgagtttgtggtgacttccttatgacaacacagggctctggctctaagaacttgagctccgtcccctggagaaaaacagcctgaagctggatctcccctagctgtcatcatgggcacaggggttctgctcgacgtcgctctgcgctctcatgttacccacatatttgtatcagccctaggcactgtcagctccatgcaagaggcttttgcaaagtgttgacatttcacatatttcagtttttttaatcatgagcattttcttcatactcattaaatattgaacttgtgccttgtttataatctccagtgagggctgttggttaattttctagcacattgggttttatcatttctgtaagcactaacaatgaccatagaattctcaatcacgtgggatttttaaaaagaactttctgttcatctctgtttttctttctcattgcaatttttatggagataattgtgggttcatgtgcagttgtaggaagtcatagagatcttgtgtataagggagtcgatgatgcgattcactgatcttactcagatttcctcagtttaatttgtattcattagtgtttgtgttgagttgtgtagtttcagcacatgcatatactgtggactccaccaccaccgtgaagccactgagtgtttccatcaccacaaatgttcctcttgttgcccaattatagccacatatacctctcccctccccactccaccatccgtaagctctctcgaccactcattcgttcttcatttgtataattgcttcatttcaaaaatgttacataagtgtaatcatacagtatataagctttcagcatggctgttttcactttgcttaattcactggagatccatttaggttgttgcctgtatcaatagcttattcctttttattgctgggtagtgtcccatggtacgcctggaccaagtgtgatgaaccattttcctgttgaaggacgtctgggctatccccagtttgtggctcttacgaataaagctgccaccagccttcgtgcatcagtttttgggtgaacatgagttcggttctgtggcataaatgccttcctggacaaatgctggcttgttgggtaattgcacatttcgtgacgtaggaaactgccaatctatggctgtaccattttacgttcccaccagccatgtaagtgattcggttgctccgcatccagcctttgccgttgacactgtttttgcttttagccatgctgataggtgtgtagtgtatctccctaggatgttaaattgaatttccctgtgatggctttgcctctctttaatgcctattgtccttcccttcgacaaatccaaagcagcacgacctttcctttggcctcctctgggtttttctgctttactggggcagcagagacagattggccttgtgtaccgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtggttccaggaagcttctggagtctgtatttcagttttaatggcacagctggacatgtagttttaccacctacggcttagaaatggacaaaatcagcctctgtggtctcttatgtatttgtgtgcttgtttgtctttgtctctgtgaacataccttttctcgatacacggggcttgtaaaatgtaattaaagacaatgtctattagttttggtgatataacttgtaaatcaagaatcaaaattacaggatttaatgactatcccaaagtacggtgttcacttggttatgtccaagatgggaactgataggcgatggcctgacattatagctgtgctctaggatatgagagtaccagatggcaagatgacatttaagatgagcacagcacagaaacagtagaagtgtgcttttgtgctagcacccagaagtgctttataatcttcccagaggggagcagctgctaaggtttcactgaagctctcaggttctgttggaagcacagacctttccctgttggcacctacatgctggtatccatcctggaactcttattagctgacttgctcggattcacgctttgtgtgtgcagcatagtctaaatggccagcaatcataccatggctatcatagaattctccttggttgttaatgagaatgtgaccacttgcttgaatttttgtgtctcttctagtcttagggtttgccttcgtgctccagtagggtgcttgagtttatgtactaataacccctactagaattttaagtgataggaatgacctggtaggaagtgagtctgccaggtaaaccgaatccctttgtcacctcgaagaaaccgtttcttattaactgctttacttttgcttgagaaaggcatttctacaacatgtggtgggtgagagagaggccagtactgaatgtaattttccctattttggaattagactttcttgttcgtattgactacatagcgtgtaacaaaaccttatccacagttgtcagctactgagacttgtaacggaatttttaaaaattcaactactccagctcacagcttccctagtcctccctgcctactgtaccctctgctctcaggataataaagacatgaaaccagcatttgcatttcctcagagctagtgtagtttgcaactgtgattatcaatcgcttccaggcattcctctctgttggcataggttttgtgtttgagacttcctgttctttttcaggctaggctgggacctacgggaaataatgattagtgttttgaagcccacacactttcatagaggacttggtatgtcttgcaagtaaaggttcatataacatgaatataaaatagaatatgtaaaattgtagagaaaacgatgctttctagaagttgaaatactcaaagctgactgcaggataaaacataaaggcaaataagacggttgccgggttctcactggttggtgaaaatgatccttgccatttatcacgggaagctggcagtttacaatgtagattttttttttttccaagacagggtctcactctgttgtccaggctggagtgcagtggcaggatcatggctcactgcagcctttaactactgggttcaagcaatcctcccagctgagcttcccaggtagctgggactaccgacacataccaccgtgcccagctaattttttgtgggtttattttcttggagagatggggtttcgccatatggcgcaggctggtctcgaactcctgggctcaagtgatccacccgccttgtcctcccaaagtgctgggattacaggcatgagccaccacacccggccatgatgtagatctttatataggagacactgaacaggagaagatcatagggaaggaatcagttgagaattcaaaattctgcccatagaaaacagaagagattattctctcagttaggaaatgcgtaagatgttaccagtcagcatgttggttataacagtggttggttataattggacttgtctgaaagactagctcatcaaatgaaggggatttagctgacctgatccattcagtcttgtctagtcgttgaccatttcaacatcagagattgtcagtcaaaaactattgtttggttttgttctatctgcaatcaattaatcttatacttgtcctttcaaactttgaaatttcatcccgatttggagtttgtgagatcatgttgctatttatttccagtgtctgtgtgttacacattaaaaaaaaaaaatcatggccatatggagaccatcccaaacagatcaggatgatgcttgcagtctgcaaaggatggaggattttgatctcttgacctcattttgacaaccaccttggctcatttctctgtggcctctcctcctctccccatgattcatccttctttcaaccaggaagtgttttcctcaatccattgacgtagcatattacattttcaccagcctgccatatatgatgtctatggacacctcataatcacatgcagctcctttcatgaggaaaatcgtccatgcttatttctgtaacttaacaatttctccctttttaaatagaatgcatttcctcacttataagtattatctaccagatgtatcagagtccaggatggcaagctctctgctatttctgccaaaattaatttggcttatagtcaggacaggaaagggccttaagccctagaaagggattccaccttggagatgccagttccttaaggataagtcgtgttggtgctcagaaggcaaatttgcagggtaggctgtttgcaggtactttgccatttgctttcgttgccgtgaaggaatttgagtcgttgaccacactgagctgagggcttggatcaggggaaaggcaccgcttgccttaggatgggagagagggaaaaattagtgcccacgtgcagggggcctgcccccaggaccatggcaccagtggcaacctgtggatggccaagtcaggaggactgcttgttttctttcctgttctacctccgtccagagaagcacctctgcatcccaattaagggtgcatagttgaatattctttgtgcaggttgaaatcatggttataaagcatttggggcttgagaaactcttggattattacttcttaacatcttttttcctttctttgaagcctggattttagttgatgttgtgacttctcatttaatttatttttaatatttattggcttactattgaggttttgcacagccaatggcttgatgattttaggcacactttagaattatttttttcctttgaaacagtatacagcagttgttgacagcaaaacacaactagctaagtaccaaaacacacacacacacacacacacacatatatatagactgtactgactatacattttgctttgcactgagagatgtttcatgcataaaatagagagggcacttggctttggtcctcataacatgaagtgcctcctctggcattaagtgccagtggaatgtggcattaacgccagccaggtgctcacgatgagatgtgcatggtctctgagaatttggggtgaaaaaaatagcaattgaaactcagtatagtgaaaacattctggaatgaagatttccctagagttctccatacctgcattttactacagctcatgcacttaataatattgctctttgagccttcttcctctccaagaaaactggcctaacctgagacatttcacagcccagagtccccagtttgcaggcaccagggccacagttctccttcctaggctggttaacttgggctgtacctgagtgcatttctggcaagtcacccagagaaacacatgagacttttctgggggctgtgttggccattgtgatgcatcaggatttcaagacagatactgacttggatccagtaatgatgctctggaccctccagcaggaaaaggaccccactggggctacattgctatgtctatcattttagttttatctccagaggttgcttttagaggggacacagggacattggcagttctctctcagcagcttttgggcctagatatggttgcagatggtgtatcagagcccactgcaccttgggatggaaactgacctacgaccaaatgctacctgttcgagttctgttcattcttaaggcctagtcataaattatttcagatactttccataacagttattctatttcatgtctgcttttgctctttgcttaataactaaaacaaataatttccagagttttacctggttgtttataaccaatgtattgcacatagcctagatattttaaactgtgtcgtcttattcagattgcctgttttaaattttaattcagagatgaaaaatcaacctactctcaaaggagtggcagtgatgaagagctctcagcaggactcttatttagggaagcttgctttaaaggaaagtttgaaaagggcaaagtctgtttaagaattctcagagatcacgcgcacctcgtcgggagtgcctggctggtactgatgccgcatcccgctggcacttaatgccggaggaggcacttcatgttacgaggaccgaagccaagtgccctctctattttatgcatgaaacatctctccgcacaaagcaaaatggaggagatacactttattatgatcctcctcccggtcctctcatgctaagttttaacctcctgtgctactgggacttggaagaaggtctgtgcagtataggaccctctggtgtggtgcttttacgtctagaacaggaggaagaggcagccaagtgaactgagtcctcgcaggcttgccaggctgtgtcttccgtgtctttttgatagttctcaatgaaggacagttgtttcccctagaggaaaatcgacaatgtccagacacgttgttgtcacaacttgggaagagagggctgctggcatttagtgggtagaaaccagggatgctactaaacatcttttcatgcacgagacagccccctgccgcaaagagtcatttcatccataatgtcactagtgtctccatgtgatagatgaaaaaacagagtccagagtctcagtgatgctcagtaactgttagaaatacatagaaatatgtgtgcagtggctcatgcctgtaatcccagcactttgggaggccgagggagttcgagaccagcctgaccaatatagtgaaaccctgtctgtactaaaaatacaaaaaaaaatcagccaggcatggtggcatgtgcatgtagccccagctactcaggaggctgagacaggagaattccttcaacccaggaggcggaggttgcagtgagccgagatcgtgccactgcactccatccagcctgggtgacagaccgagactccacctcaaaaaaaaaaaaaaaaaaaaaaagaagaggaaagaaagaaagaaatatatgtgatttattgcagtgactctcttctccttgtttccccatttctcagccacccttctctgccatgtgacctcagccaaaccagcgccctctagaacaaataatagcagctagctgctgaagataggactggtcttcacttattaggggggtgtccgagaattggaggtggtttccccaagtcgctctgccaggggctccagtgtctttgcaggagatttttgtgggctttgatttggggtggtgtttgggagcaagatggcattggaatcacagtgacatgaatgtacatgccagggctgcctccagtcctgcctggcatgtgggacacacgttgaaaatattagcaagagcctgttctcagggtgcttgggctgccagcctctacaccccaattctgccgagcctggggtgaaagagtagccacaggcctttcctctctacctctcccagccagaggccaccttcagtacaagggttggaagctgagccctggagtcagtttgtcaggtcaaatccgtgctccaccacttatgagctttgtaaatttagtgttgggcagatttaccccgtgctgtagtttcttcacccgtaaattagagacagaagtcaagcctcgctggagtgttttgggggaataaatgagaaagcgcatgtggggtgctttgttcagagcctgacctccagtgaccttgcaacaagccatgtctgtgaccccctccatttttatgaagatgacatgatagtgtgtcattgtccctctgaatctgagaattgagcccacaggtaagggtgtgaagcatagacattgccctggagattcagagcactttgtacatgtattgagaaattacattataaaaaaatacaattctttgctttcatagattcactctcttcttgtgaggatatttgtatatattcaaattgcggtttcccttgatttataggtaattaagtcaacccattttgcttgctgttttcctagaagcagcatttgtgaattgctttatgtgacatggctgacactctgtcaagcataggtcttgtgcagttgtctctgttcagaagccagtcaccaaaatggtggtcctatctgccctggcatcttggaaggacagagctgcagtccccagagaggatcctgtgttgtccctcatgtgcagatgaggttctgagattcaggggggttgaatgagtggctccgggccccctgtgtgagtagcaggagagactgcagaactggttgctcttaagccacatccaaggccaggcacataaaatgtggacagtgacgcccaccacccatgcagtccttgggaagccccgttggcataacgagaatagagagcttgacgaggaggtcctcagtgaatgaatgccagctcctgaccacgctcagttttggtaacagtaagtggcactgtctacagagcctctcaggaaccggggactccacctgcctcctctccttctcccaccctcagagccaatcatacacaggacccagtggataggactggagttccggaagccagctccccagcgcctcctccgagctgccatccttctctcctgtggcaggggtgtcttcctctgaaatcagtgtccatctcagtcctggccgcacctccacaggctcccgatgtctggcaagaaaagctaagcagggacttccaaacgtgtttgaacaaaactccaatgaagaaaaacatttccaatcactgctcgatgcacttccccacccccatcaaggtgtaactcagcgagaattccttactgtgcagagccctccgatgtttttattctgttctgttctgttctattccatcccatccattctatcccttttcacttaataagtaaataaatacaatttcgcattcttcccattctattgatttcgtgctccactgaatgaatcacagctgatgccagcctgtgccacccagcacagaaaatgccacatggctgactttcctccctccctccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggtcaggtatctgtgctgtagatatctttctccactcagtgactgcaggattttttttttgtcacttaatagtgttctttgttggatgacatttaaaatgtcttttgaagacacttgcagaaagaacctgaatggactcacctgctggtgactgtctgggtagcaaggctcagcatgcttgctatgtggaagcttcacgaaatgccgtttaaaaaataaaattatcttcaaaaccaaacatgcaattccaccattctttgtcaagctcctgctattttttcaacacgaaattggaaataaagttgaataatatactttctccatcttcaagaaagcctgactgtgatatacttaaatttttaaaaattcacttatgtaatacatcttcaggtctataaaaaaatgataatgtttaattgtaatttttccatggaaccgaaatgttaacagcattgtgacattttctatacattgtttttcatgcaagacccttctgtgtggcacttaatatttgtcatgtgcgattttgtgcatttgtgcatgggtctttggcactgggggggatatctcttctgaacatttcagtggctgcactgtacactgtcccattacccaacacacagtaggtgctcaacaggcagtgactgtgtaactgctgggctgaaagaaggtgtatccctaggaaatgttctaggaacaaagtgaaccaataaaatacatgaaatacttttgtagcagttcattttggagaataaaaggcagttactctttttatatttgagtccacaaagaaacaattgcagctataaatatgcagtgaacaaatacctcttattctctttaagatctattagccagagctaattccttaattgaatgttgttctaaatttaccaccaaaatgcatgagggcgatctgtgtttgtatgtttcagccaactgcatgacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattctgcagtttggttgatttaggaagaaaatgaactctgacagcttgatcttttcagttcagtggattctaatgtttcaaaacaaaagacctgcactgaagcctctttcctccatgctttggcagagacaccactgtgagctcttcttcatgctcaaacctcggcagctaccggctccatgtcatggacacacagagtcctaggaagagatagattctgctaaatgctaatgtttgtaaatataaatattaaccataccccaaaagggaaggagttcttttgctggctgactgaatgggtagcttttagcacctgccacttttctcagcatgcaatctattttttatagacagaaaaaatctctttttctagtttttctggtttgctgctgttgcctcagtgatattgcttgggatgcagaggtttggcaaagaggttggaggagcacccctgcattagtccgtgttcacgctgctgataaagacatacttgagactgggcaatttacaaaagaaagagtttattggacttacagttctatgtggcttgggaggcctcaccatcatggcagaaggtgaagggcatgtctcacacggtggcagacaagagaagagagcttgtgcatggaaactcttctttttaaaaccctcagatcttgtgagacattcactatcaagaggaacagcacgaaagacctgcccccatgattcaattacttcccaccaggtccctcccacaacatgtgggaattcaagatgagatttgggtggggacacaggtccctcccacaacacgtgggaattcaagatgagatttgggtggggacacagccaaaccatatcaaccacctttcctcttctgttctgtggttatgctagacggcctcaccttcttttcttattcttattcaggggaaaacactaaagtgaagtttcctgcaagagccagaaaatcctaagttaacaaattgaattctgcaactgagatgcagtgggtggatgtagggctgggctccttggaccgaggctgaaccataaatacctcccactttggtattgctttgaggagcttcccagcattcacccttcacccttttgctgtgtgccttcctttaccttagctaaggaagtctaggcagctgtgcaggatttgataggtggcagctttagctcagactctggaagttccctgctccctgctaactccaagctggctccttgcagctgtccccagtgtcccttggactatggggccaggcatctgatttgattcttcaaactgaatgttactgcttctactttatttaagtaaatggccatctcattgccatctgatgctgtagcatactgtgcgaaaggtattttgaattagctgttagcagctgggtgcggtggctcacacctgtaatcccagcattttgggaggctgaggtggccagattgcctgagctcagaagcttgagacaagcctgggcaacacgacgcaaccccatctctactaaaagtaaaaaaagttagctgggtgcgatggcaggcacctgtagtccagctacttgggaggctgagacaggagaattgcttcaacctgggtcgcagaggttgcagtgagcggagattgcgccgctgcactccagcctgggttacagaggagactgtctcaaaaaaaaaaaaaaaatagctattagcctgcagatgatttggatatgggacctaaaaagcaagctgattaattgatagatgtatttatttatgatattcagcctgagaattaagctggatttagaataaagtgtttcttatgagatacgcttgggggtaaacatgatctgcatgtaattcacaggtcctggcatttcagagcagtattcaaatgcatgtctgccatggactgtgagctcccaaaaaaagtgcatgatgaagtgagtttcgaatactgacagaaacggtagagaaaggacatgtcctggtcctggctaccgttgatattctgcttggagcttggatttggggttgtgttttagcttaaagaaaccatatatacctccagtgagaaagagacttttgggtgaagagggactggagggaacccatggaacagaacaaaggctgggcttacggtgatagcccgcattcatttagagatggaaagttgctggaaactttaaaacagagcactgctgtcactgcctgatgtttttcagggactgtttgggccactgtgcagagcacagggagtaggagatttgtgtgcaaactggagggccagcgagagccctggggataagctacaccagcgatggccatgtctttggctaaggtagtcattgggaagagggaaacaatgagagatttggggcatgttttgcaggccacatgaacctgtacaaactagatgtaagaagtgaagaaaaatgaacaatcaaggaaaagtcttaatatttttggcttgagccaaaagtgattggtggaaagtttaaagataaagaagcgggcttgcgaggtgggagtgttcccgagctctgttttggcctagcgcagtgtttctcaaccctgtttattttttttcccattatgaccctcctaaggagagaagtaaattcactttaattaagaagagaaatttaatgctaaggaataagaatttgtggggtagggtgtgctttggaggaccacaagcagaataatatctaaaatgttctttaccctcctcccaagaatcaatttcacccccttagtggagatgtttcccccagtgtggatgtgtggcctggttaattctcaggtgcccaggaggtggcccaatagagaagtttagctagcaactggaaattctacactgacgttcagaagaaaggtaaggctagaaggtacaatttgggatttagatgatgatattcaggccacctggggggcagtgtctctagggaagagaagccgacccaggctaatgcctcagggctctttgatatctaggggtttagcagtggaagataagtcagcaaaggagaccaagagcaggagtcagtaataggaagaaaaaaaaaaacacaggagagagaagacagtgctgaatttctgagagagagcatagaaattaacagagaagtaaccaaaggatttggccacatagtggtcactgctcccatggaccagagctgcctcagtggagtggagtggcagaggaggaggccagcctgctgtgcggcatggaggaaggcatggaaggaggtaggcaccctggctgtgggcgttcattgggttttcatggcgctcagggtcagacagatggtgtgtcgggagctgtgataccaggagagtttgtaggaatttgctgttgatttacggcatgttgggaacactggtggagatgagcggatgatgggtgaaggtggaaacgctgggatggaggaggttcatgagggcaatgagttctagatgaaagggatggtacaggaggggctggcctggagaggagcaaggtcaggtgatttgttgcaacaggagaggacagagggaggtacaggtgtcaacctgtgtgtagatgtaggtggtggttggatgatggaaaaaaacccatgtgacttctgctttcctactgcagaatgaagtcaggtaattagtgagaaggggtgcagagaatagtcaaatattatgatctctatatctctgtgatggccatattaatatttcacctttcaccaatttccccgctaatgcccacgcatggcgtacaggccgcgttggagatccctgcggctcatgctgccttattacgtaatgccctggagaggcctcacaagtagaagagtctaaaacgatagattgctttaaataactcatgctaaatcatcctcctgtgaacatttctcgatggatcttgtcttttaagcttcaacaaaccctattagccatcaaaatcctccagtctctcaaaatagccctcatcagacttgctcccacatgcttgcgtcatggctgggtggccactggagaggttgggtggagatgctggctgtgtacataggaaccagagcccctagagagatgacttgtgtctgagcaccattcttaaagctttccaatacatgggctgtcagtggctgtatgcatcttctctgtttgacttggcttagggatatttgggaggggacaggggggacaggcagcattaagcatccttttgctggtcctctgtctttgagtgcagttctgtgatactcagatgtcttccagaactatcggctgtttgattgtggaaattcctggaagaccagggctcctgttccttctctcgccacccgtgctttttgtctttctcaccctctgttcctttaagaccacaaagcagggactcggacactggtgacacggacatttcaggctctagctgtgggacgcttcaggcaggcagcctgatcttttttccattttgtttagaggtatagattgtacacctctgctccgagctcctttatcaggccccagaaatcatggatgcagcaaaaattttgaaaatgaaatttttcctatattatcccaattactctttggtctccatgaagccattgtttttccaattcctctattgcagaatgcatgcagggaatttagaaatcacatggtaaacgttatgggccatttcctattgctgactttaccttcctagttcctcagagatgtaagatgaatgtccctggtgccagtgagcagccagtcagtgtgcacagagctggaaaaactaatagactagatgcatcttactgatcacgttgatgtggaggggcctcatctctctggtccagctggaaatgtgattgcttcctggggtggccatgactaagggattcctgtctcagctgcctctatatggagaactgagctcaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagataggtctatagatgagtgtttgccttcgttttctgtgagccagttttcatacctttaaagttgaataagggctgggcatggtggctcacacttgtaatcccagcactttgggaggccgaggcaggtggatcacctgaggtcaggagttcgagaccaggctgaccaatatggtgaaacctcgtctctactaaaaaatacaaaaaattattagctgggtgtggtggcgggcacctgtaatcactgctactggggaggctgaggcaggagaatcgcttgaacctgggacgcagaggttgcagtaagccagaactgtaccacggtactccagcctgggtgacagagcgagactccatctcaaaaaaagaactgaagacaatcgatgaaacgatttgaacgctttttagatttagtgagtcttttaagttgtctctcacccatctgacttgacagcagtttttcaagtgagtcatctttttaatcttttcaaatctttagaattcgttttcatgtaaaagtcaactttcttttcatagccctattttatataatatttcattaaaacagttataataacagatttatttggtataaagcaggtatggagcacgcacacagctgtgtccactcactaatccatgcgcacacgcttccctcttagctgtagacaccacatgatcacatcactaggggagctattcagtggaaccccatgctgtccttgttaggtggatttttaaacactctgttaaactaaaaaagtatattctcactggccagtgtccagtgtaagcaaatttgcacatggctgtcccttgagtcactgtagttaccttttaaaaggaaagagagggaaactccattgtgtagatctttccccagccaagagaccgttagcatgcggtacagtaaggcagccactcattaactgtttgtttacctggcaaagagggcaggttggtgagctcccaggtcctcagaaaatgagactaagttttattaagatctgaggggaaaaaaataaaccaagcagaactagaattcactggaccagaaggttttgttctcccttttccagctaatctctctcatccaatctgagagaattaagcaagggtgagggagttgcagctggctgaattcaggaagttaccaaagaaggctgatttaactgaaaagacatatattcttcccaaagcccaggctattgagccagagtacctgatcacccagcaaagcaccactcaggctgtgaggctggccacgcacagggaggcaaagagaggaggagagaggaacttaactttgtttttcttcaaaaagatgtgttgtttcttggcaaaatgtaatcaccattgttagcaaacccatgagatgctctcagcaatgtttatcaaatagaaagagcttccttctgtgtgacaagcaggggatcagagtgacagtgtttagatctgttacttacaaggtgataggggcaaaaattaatacctgcacaggctgactcctgaagtcttcatcaccagaaatgccagcatgatgtccaggccctaaggtgcctaccatgtccccatgagagacacacagtgccatgaacagtctgggttttccagaaatacttgatttggttaattgacaaattctgttgttcctcctttatagttaattaataattttccagtgtagcgtttcctatcagggggtgtgaatccacacacgtggctttttcacaataaaatagcattcatggtgccttaaaacagcttgaaatgccccaaattactagacttgtaggtggatttctcacaaattattattaaaggtaatgaaaatcaaaatcaaagcatttcatatttattgtgtctttagggcaggccatactttacaagtaccattttaagaaatcctctcaatagccataagagggcaggtcatatgatctttatttttcagttgaggaagctgaaggcaatactgatttagtatctcacacaaggtcacatggctaataaggcagagaagaatcagctttgcttgactccagagtccgtgttctgtatagacaaaggcatgaggtcatccaataaggtaatcgcttggagaaacatttttccctacttgttttgatgtagaacttctgtaccaattgtaaccctctgccggttgagtaaatatttggggttaaatataaagctgaaattcaaataaagaaacatgttactgttctctacagggctggtcctcaccttttcacaacgcactttggaaaaccagcacagaacaaaggcccctcccagcctggtgtattcagacctcagtgctttgcctgggctgcagctctgttgggaaaaggtggcagttcagttcccgaggctggtgccctcggcaagaatgggagagcctggtaatttataaaggattatcacatgcaaaggcaatgtttgttttattccatcatctctcattctttcaaagcagtggcgttttcttagtatcgccatgtaatagagttcgagaaaagtgaccttaaaattgaggcaagtgtcacactttgagaatgcattaatttttttaaagacattttagtggttttaaaattttatttcatatatatatatatatataatttttttttttttttgagacggagtctcgctctgtcgcccaggctggagtgcagcggcgcgatctcggctcactgcaagctccgcctcccgggttcacgccattctcctgcctcagcctcccgagtagctgggactacaggcacccgccaccgcacccggctaattttttgtatttttagtagagacggggtttcaccgttttagccgggatggtctccatctcctgacctcgtgatccgcccgcctcggcctcccaaagtgctgggattacaggcgtgagccaccgcgcccggccttcatatatttttatgttgtaaaaaggggaaacctttgttctttgagtaaaatgccctggtagtgaacattttttaaggttttttttattttgacagacatacccacatttcacgcagcatcatgcttacccattcacctcatcttgcattcagagagctctcaggcacttgcaaaattgaaggccagaatgaagggagctcagtcatccttgacaactgctggggacaaagttggcaatttgttcattgttcttgcaagcacttagcctcttgccgagcactttaacatcagagaattctgggcatagatcagaaatcagtggctgcagaggcaagctacgtgcaggtaagttaagggcttactatagaaatgcaaaatgccaccattcttcactgtgttctgagaggtttcatactgttgtcgacacctgtgctggtgtagaattgcagatctctttctgtcttttttttgttgtttttctccttttcattttttcattttttactccacgctaagaacatcggaatattttcaactttaccattggtaaaatagtgcaaaggaagtgaagatcacgtcagcccatggtccatattttattccttgagttaacaaatcaccaacactatttagtttagcgagttactcctttggaatttacagtaaagccatatttaatatatttccatttagcaagtatttgttttaaataacagccttggcttccttgtttggtttgtgagggagactttgcttctgtgtttccaacgtggctggaagtggaggctccagggctttgcctcactcatacagttttatttttaaattgaaaagtggatttgtttaacatcctccaagaagcaaactcataaagctcgggctttcctaaaatgcattgccaaaatcataattggtagaaagttagcaagaaagaaggattagctcatcgagccgtggcctagcaaattgtaatgggctcaagtagttttgtggcttgttgagaaaatgatacagagtttaggaagcagaaggacacagcaatgacacaggagagcctcacaaacaacaaacactgcctttgccaggagaattgggaatgggaccattcttgaccttcctggaagaactcagaaggacgtttcactccaggaggcatcaggagggaagtctttcattgttttcaaggaatctgttgtccctgggagtgggtcacaagtgctgcacacacacttggtgtctctgaaggagcctcaccacatattagagatgaggttcctccttgcctcaggaccccatgcctcattggcattgctgcagggagaccccaggggcttgtggcagtcagaggtcagcagaagacacgcagggttgatctgtgctcatggactctgatctcacatcaagagccaggttccttttgaccgggatgatttgagaaatggtgggagcagggcagttatcaattcagatgagtagatgctgacttagctctgtacagctccctggcaccacccatggtacagggaggcagggattaggagaatgctggcctccctgtaggtcagtgatgttgcatcagtactgggattaggctggggtgtccaatcttttggcttcatgttggaagtattgtcttgggccacacaataaataaatacactaatactacaatagctggtaaactaataaaaagatctgtgcataaatctcatgttttaagagtttacgaatttgtgttgggctgcattcaaagccatcctgggccacatgtgacctgtgggttgcgggttggacaagcttggattagaggacagaagaacttgcagctttcagcttggttggttgcttgggtaagggtgcactcttgtgttctctctctctctttctctctctctctctctgtctgtctcttttctctctctctctctctctgtctctcatctctcactctgaaagaagtcctgttgggggagtcccaaaagctaaaccattggcctgggggagaaacgtgtgctggatggaaaagaggacaaaggcatagacttgttgacttgcatctccgaggtcctgtgatgtggccaggtggcctgcagctcacctgagagacacaggcaggatttcctctcgctttagaaattgagcagcctgcttggagcaggcttgttctcagattcattgacacttctgcccatcagggtgatctgcaggaatgaaaagtggttagaattctgttgcaaaggttaattttaaaaggccagtgaacacccacaagggggtcaccagggcaaaaccacagcacacacccgcctctccgtttaactcacactagtccaggtgctctgcctgctcttacctgcttttcctcttggttgggtaacaagcattcagttgactgtatattctcctccctcagtttcttctgacatcttcgtgagacctgagagcaagctctgccttggcgacaaccagttgtcatttcttagtggcagcctttatttttcaaaaaatgaagaaggataggcagtctctgcagagtgatagtggggagctgccagaggggcagcagggtcctgcgtgtatcctaccaactgtgtttccattctcttttctcccaccacagaagaacaagtaagcgtagagctgacagggaaaggtctccccaccagggctgtctgtcctgagagtttagaatgtgctgggagagcagagcattctttggggcctgtttggcgccaacaaggagcgttacgtggtctgtgaccagctgctgcacctcctgctttgctctggaaggaggccttgaaggccagttggaagttctgctcggctgccttgaataatgaaccatcaattctgtttcccagctgtgcttccacaccctcactcttggatgggactgctgggttccttgtctgccacaagcagcaattgctggaagtagcaggtcagaaatgggaaaggaggcctggactgcatagccaggcaagccagtgaggttggagcaaacccttgaacaggggctgggcccacctttgtagtcttgtcaccaaggaggttactgaagcctccagaaggcacactgtctgatccaactcacatgccagaggaacactgaatagtttccttccgatgcattacgttcattagttatagaaggaataaagccatcctatatcttctctgaaaaatgaaggagtgaaaagagcacaatgtaatcctattatggttgcaactcttcccagtttggttttctgcagatctatttacatgcatactttattctttcataatcatggtgtaatatcatctgtgtactgcattattttacttaccattctatcacaagcatttttccatgttactccagcattttcattgccaactttcttattggctgcatgagagtctatccagtgggtataccataacttgtcagcacattgtatcattttcataaatttaggttgctctcaagttgtatctgttgcagataacattgtagtgagtgtcttcatgcatatggtttctatattttgcattatttcctaggacacattcccagaagtcggattactggggctcgatacacattgtcaaattgctttccaaaaggattttactgattttattgcactctcgccagaattcaatattgtcttttaaaaaaattgttaatgtaatggcaaaatgttgttttatttttactgaattttcatgtcttcagtgatttgcaagataaaacagttcccagccattttctttccaaatgtagtttctgtttttgtaaactatttacatcctttgctcattaatctattggttttagtgttttttcttgagaactgtcttaacattgttatactatgctcatagtaacctatttcatatttccagttattttttctgtggtggtgtttgcccatctcattcggttaggtttttaaaaatttgtttttattattttacatacaaatatttaatttatatctttccatcttttttaatgatttctctgtaatagcaccctccctctataaatttgatagaccattttaggttttattattttatattaaactttttgtttgtctagaatttaatgctttgtattaaatgcatgtaagttgattttttaaattgcaactagttattacagcaccatttattaaataattcttcatagtttaaaagtggttcttccagttaaggttttaacataatgttagggataatttctgggcaatttgttgcttcaataataacatgtttggccaagcacagtggctcatgcctgtaatcccaacactttggaaagccagagtgggaagatcacttgagggcaggatttcgaagttatggtgaggtattatcatgtcactgcactccagccagggtgaaaaagtgagaccctgtctctaaataacagtaatcatcatcatcaccttttattcttgggttagtaccacattgttttaattaccatttctttatggtgtgttttagatatttggcatcggccaggtgcggtggctcacgcttgtaatcccagcactttaggaagctgagacaggtggattgcttgagcccaaaagttcaaaactagactgggcaatatagtcagaccttgtctctacaaaaaaaaaatttaaaaattagctgggtgaggtggtgtgccccctgtaatcccagctactctggagggtgaggcaggaggattgcttgagcccaggaggtcgaggctgcagtgagtcgtgatcgtgccactgcactccagcctgggcgacagagtgagaacctgtcaacataaataataaatcaatatctggcagcccttctctgttttactattcattttctgatttttcttctgtagtttaacctattgttctaccaaatgtaatttaaaatcattctgtgaaatccagcaaaaatagctttttattttaattttgattagatttgcattagagctcagtattaaaacatgcacaccttttggtgccagatttcatactcaacatactttgttccttttgtgcgaaggaaattatgtttattatggaaaacagtgaaagatgagaagtaaatggctcatcctccataaatggccatcgctgactgtttcatgtagaactttctggcctgtgcccatatcttctctcttcaggctttggcagtggggctgatacttcacaggctgttccagtaccactgcaccttcactctggaggtgggagtgggactccgtgctgaggaccctagatgcacatctgttcccttagcagggagccatgtccagagagtgaggcatgcagggagtggtcatgtggaaggtgcggtcagaccgccaaggtcatgccatcttctgggcactggtagtccctatggagctgctgctggccagtgggaagatttggaggatttgaggatactcttcagagtgtgcttccacagtctaaccctcctgcttgacgacctgttatgtgtgagatggtggctttgtcacaggaatcacctgaaagacctctatctgggctccgtgaaactacctaagcaggtcagtctttcagtgaactgatctgatatcattgggctatcacgagcctgaggctggctccccactttcaaatcatcctcaaaaggcagggcaagtgttttcctctggttggtgatggtgtcctagcatgccctttttccagctggcttcccactgggctcagcccgatgcgtctactgcaatccccctttcctgtgttgccctcggataactccatgtgtaggcctgaatcgtgttcatttccaggaaaagtaaatgatgcatatcttactttccatctgtggtcattttttttctgcttgagaaacacctgggtctgcttgtttttgaattctctttttgtttgtctgaaaaagaaatctattttatttcaaaaattcaatattgaaggataattcagatttagaatttgaggctagcagttgatttctttcagcacttcaaagataattattgcaccatcttttagctttcattgtttctgttgaaggtaacatatctttttctccagtggagatataatctcagtgctttttcgtctttgtttttaaactttttattatcaaaactttcatacatgtacagaagtagaatagtagttatactattactattatattatgtagtatatactacagctctgttttaaccatcgttcacctttaccactgtcaaccatagctaagtttcttagatttatcatcccagctttgtctttctcaccattatgttgaagcaaatcttaggcattatatcatgtcgttcataaatatttcagttgtcattcaaaaatatctcttaaaaataagaattttttaacacctctatattattactccttagaaaatgttgttttatacatagttcctatagtttgcccaacttagtatctaaacaaggtaaaaatattgcctttggttgttatatctagtaagtttccgataatctttaggttgacacccctactttttttctttttttttttctttttgtttttttttgagagagagtcttgctctgtcgcccaggctggagtgcagtggcacaatctcggctcactgcaagttccacctcctgggttcatgccgttctcctgcctcagcctcctgggttcatgccgttctcctgcctcagcctcctgagtggctgggactacaagcacctgccaccaagcccagctaattttttgtatttttagtagaggctggttttcactgtgttagccaggatggtcttgatctcctgacctcgtgatctgcctgccttagcctcccaaagtgctgggattacaggcatgagccactgcgcctggccttttttttttttgaagtacatgatctcactctgttgtccaagctggagtgcagtgatgtgatcatagctcactgcagcctcgaactcttgggctcaagcaatcctcctgaatagctaggactataggtgtgcaccaccatgcccagctaatttttagtttttttgtatagctgcaatctcaccatgttggccaggctgctcttgaactcctggcttcaagcgatcctcccacctcagcctcccaaaatgctaggattacaggaatgagccactgcaccaggctccccattttttttccttataatttatattgcaatgtttgttcaagttctgtaggaaattccacattctggattttgcagattgaatccacatggtgttatttaacgtgttcctctgtctgctatacttttgtaaactgatagatctacagactcagtgagattcaggttttgtttgtttgtatgtttgttgttgttttttagcaagaatacctgataagtggtgtggtgttcttcccattgcatcacaccagcaagcacatcatgtttttctgtctctcttataacgtgaagattgattagtggcatcaggtgctgccagcatttatccagattccttcaatatacagtagtttttcacctaattgttatggcagccaatgatgatcattgactagacccattattcctttggagttaaaaaaatccttactctaattatgttattctgtctgctttcattagccagaattctttcataagatggaaacttttttcataaaatagatggtaccctgagagtgtttattaaaggaaaggaaggataaatgcttgtctctttcattttaattatctatttgctaaatagtgaattggttccctggcatcctccaaggatgaccagtaaatttttttctttaataccttcatgaattttcatgtgtctaagtccgttgtagttatgattctttttgctgaacaaattcttccatcttgttccactaggagtcttttcaggtggattcctgggtccttaccaccctgcttaagtagtctttgataatggctttctttttgatgtgacaaaatatctcaggttgatcttttacattttccatcccaaacctggaataagccaagaatatatagttgcttttagtgggaagtggtatttagaaatcataatctggacaacgagggtgctcactgcaactgagttactcattctttccaagccttttagtgggcagagctaggaaatacattttcttttttttaattctcttttccctgcaccaggatgtaaagtaaggaaatacattttccataggaaaaaaaatcaacatgaattcatactatatttgcatttccaatttaggattatggagattttagttaccttctttgattttatatgtgtaatttgtctcttacactgaaaatttgggtccctaatgacacaaacatgatgtcttgttgctttgtatgtatatataaaatatataataatttgtaatatacagcataatatagaatacatagtatatactatactatgtatatatttcacacacacacacacacacacacacacacacacacaaaatagtttcagaataacaataccaattgttactttaaaagtttgttttctccttaggatatatcctgcagacatacacaatcaagtcatgtttctcaggcacttgagatgaatccttgcatgtagctaaactcatcaatttgatatttaggataattttattttgtttttgatttttagtgattgcacttttttatttagaataatgtgtctcagatatactaagcaagtgttttcatagtattttcacttctgcccctacctttccctacaggaaaccacttttattcatttgttgtttatatattgtaacttaacttttaatatcagtaaatacacaccacacaaacacgcacacacagatgcgtgcaaacacatacttgtattcccatccctttcttattaaatgggaacatcaatactgctttttaaatctaactttgtattctggagactggcgtgttgtagtatatagagatatttctcatcactttttaccactgtgcagattccattgcatgcatattcatattttcttgcacctgtcctctaataatgggcgtgtgatggtttttcatcttttactgttatagatggtgcttcatctatagcctcatgcacacaactttacatggttttgccagtgtgtcttcatgatagattctttgcagtgggttgatgtaattggaaggcaaatgcatatgacaattttggtaaataatactcaattgaatgccataaggttattgaattgtaacatctcaccagaaataaacgagcctgcttatttctccacaacctttccaacctattatgttgccagacttttgtacctttgaaaatttatcacatgagaaatggcatctgagtgcagttttatagatctcaatgtatgttttttggtttgtttctatactgcttagagtttataatattttggaaaattctcagacagtatctccgttatcattacttctacctcattccctttctcttcttcttttggaactcaattacagatttgttagaccttaggcccacatcacatacatgtcttatgctttttttttttttactttatttttcattcattttctctctgtattttattctagctatatatttctgatatattttttacttttgtatttctttcttctgtcctataatctgctggtaaattcatgcatttttgttctctgtttctgttatggagttttcatttggttatttttgctaattggaaactaaaatttcctattcagtcttttggtcccttaaagactcttggtggttctgtttctgtggatgtgtttctgttgagttttttgggaagaagtcagtcttgttttatgatcacgtcctggtttctggtatgcctggattttcctgaaatgaatgctgtagatcatatgtaaaagatatacagacttaattgaaggtacgatgatgttatcttactccagatagtgtttatttttttccataatttcctgtgtttttatgttgtgtatatttgtttaataccatgaaactccttttctgtgatattcaaaatgaaggtcgtggtagttttgagtggaaggcagttttgtattgtgtttttaaaactttattttccagcaattaaagatgtccacagttatgagaaataatacaaagagatcctgtagcgccttctctcagtttcctctagtggtaatatctggcataactgtaatatatcacaaccaagaacttgtgtcactcttttataggtcaagcctcttttctcctcctcgccctaccccgtttctgacaaccactaatgccttctttatctgcgtaactttttcaccgtatgaatgttacataaatgggctcatacagtaggtaaccttttgagactggcttcttttccactcagcataattcccttgaggtccatccaggttgttgtatatagcaatagtttgttccttttattactgagtagtatcccataatatggatatagcataattattttcaaccatacaagggcatttgggttgtttctagttttgggttattttgaataaagctgctttgaacatttgtgtgcagttttttgtgtgtgcacaaaagtttttatttctctgagttaaatgcccaggagtgcagttgctagatcccatggtaattgcatgtttagttttgtaaacgtctgggaggcaggactttaaggttgctggggcctcagggatgcataggacagctggggctttgcatcctcgactgcttcagctgaagacacagtctagagtctgtgtactctggcttaggttgagattgggaagacatcccttgttctcacttccagccctctcacttcagtcaagacttttgcttacaaagggcagcacagaggctcaccgtgcttaagtgtcacgtggatttactggacagaccatttgcacacatgtgaggcaagtggtatcgaattttacctggtagcaggtgccagcttccttcctgcatgccctgtcccctttatcctcaaagcaggcagagaatatggccacttggcattctcagtctcagcccccacaaccccacccccagacagagatgtacactagccccttcatttgagttccagatgtcctaaggcagaactctgaatgtccctttgggtcctatgtctagttctgtccctggtggccagtgccagagtcttacagcacagccccatgtgttgggagcgccagctttggggtaattgtcatagacagtagcgccctgtcgggtcagttccgtgtgagaacctgagagggaaggagagttgctcacggtcagacaggagctctcatcagcagctgagcctgcatccccaggcgtttgcctccttcctttggttttgctgatttcgcttccttgtggggagacagagctcggcctttctgctctcctgttgcgctggctgtgtactgtttattatagcctacgtagagagaatagagggacagacagcatttctggtgacagggcatatccagtgaaatgcagacataaatcatcttttaaacaagggtgggtttgcggtaggaaggcctgtgtgaggaaataggccctctctgggctccctccgtccttcacagagtgcctcctgacccagggtcgcaagccaggttctgtgccaggcaccactccagagcaggtatctgtggcttgacaaggatgcacagggcagccgatccttggaaagtctgtgtgtccaaagtgcctctggatatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcggggtggggggggcccacttctatctgaaaatgcccatccagacactgtgggttctgtgccaatgccagggaaggaagctcagggttctgccctgggccctaagaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagcaaacaggggccttggggctgtggagtcatgctgggaagatgaagaaaagacagttggtaactgacaaattgcaggtgtgatcattactctctgtgactccctgtttctcagatgcactgttgcttacatctttgtatgcttttgcattcctgctgattgattcaaggtgcaacgtgcctgcttgtcaggtatgctgttgatcacattatttaagaagaaataaagtcgttcccgcagctccacctgcagtgatgggctttaatgttttgtgcttcccgaggaaaacctgccgatgatgtgaagtgacattcaacccgccgagagctgatactggcagacaaatttcatgtcctgtctcctgatcaccagtttgctgcctccaagttgttagggatattaaaaacaggggtgggaagtccccacttgacaggttcaatttgtaatgtgaaaggtgctgagaaacaaagcaaggacccaggcagctttctgccaaggctgctggccccacactcagcaaggcaaagagaaaggggatctatctgctagtagcatgagtgtgggagaggagggggctgttgtagggtgccgtggaggactcatacatgatcctgggaagagcgctgctgctagcccagggccacaaagcgtcaaggacgttgagctcctgtgcatgctcctgtagccttgtgtcatctgaagaagcacagaagtggcaggaatggccttttcatagggcatgggatgctgtaactgatgtgcaatctgttatctcaaaggagaccttagcacaagtgggaaaggaaaaactgcccgaccatggagagaacacaagtgggctgagtgtagctgcctctccttacctgtggctggtgccatgaaggagtgctgctgtcattggacactgtggggccagcaccgggttttgtgtgtcacttgcattctcccttggtacacagagcccagactggtttcctggtcccttcccagcgagcactgtgatggctttgccattgaggtggatggaggtccttgaccaaagcatgcttccccctgaccccatcccacccgcaggttggcagctcatcctcttccacctgctgtgaaagggctgggtctggggacatgggatgagggcgacttgcctgccctatgaaccagaagatcaacccctctgaagccaggcagcagattctgcggctagatcacccttagatacagcacagggcctaacgtgttggtggcacccactgtgtatttgtgggatgcttgaggaaatcaaaaagaaaccaacacaaaagaaaagactcttcattgtaaaaagcctgatgagaacagacaggatgtggcctctgccaaaaccaccatccacttccccacccaactctctgcctccagtatgccctgagaacccgcctagtcatctgatctgcctccatcatgcaggcgtactgagctccttcactcctcaggtgaagccacccggagcacaccgcggatatgcagcttgagaaagccagtgtgtgctcgcccacgttaccctccagggcaggtgcaggtgaccacttgtctcagcccacctggcccctcaactcattttgtgttactgaccctctctcttccatcctcatggtacttggggtgtccagtttaaggcctgtctcagatatacttataatgcaatagaacagattttatttaccagttgaacttccttttctcccagagaccattatttgcactaaatgtggttttgttttgctttttgttgtcgttttttgttttgttttgttttgttttttgttttttgttttagatgaattctcactcttgttgcccagcctggagtgcaatggtaccatcttggctcactgcaacctccgcctcccaggttcaagcaattcttctgcctcagcctccccactagctgggattacaggcactcgtcaccacgccaggctgatttttgtacttttagtagagatggggtttcaccatgatgaccaggctggtcttgaactcctgacctcaggtgatccacccaccctggcctcccaaagtgctgagactacaggcgtgagccaccacacccagtcaaatgtagtgtttcatgtgagttgccctattttttttttttttaagatggagtctggctctatcacccaggctggagtgcaacggcgtgatctcggatcactgcaacctccgcctccctggttcaagtgattgtcctgcctcagcctcccaagtagctgggactaaagatgcatgcccagctaatttttgtattttttagtagagacgagttttcgccacattggccaggctggtttcgaactcctgacctcagttgatccgcccgcctcagtctcccaaagtgtcaggattacaggcgtgagccaccacacctggccaagttgtcctattcttaaataaggatagcacatatagaattattatggggattcaggtgtaaccccagggctttgggaggcctaggtgggaggatcacttgatgccaggaatttaagttttcagcctgggcaacaaagtgaaaccccttctgtgagtccattttgtgttgctctagaggaatacctgaggctgggtaacttgataaacaagaggtttatttggcccatagttctgcaggctgtacaagcgtggtaccagcatctgctcagctctcagaggccttaggaaacttttactcctggcagaaggcagaaggagagcaggtatgacacatggcacgagcaggagcaagagagggagaggaggaggtgccagcttcctttgaacaaccagctttcgtgtgaactatcaaaccagacctcactcattgccacagggaaggcaccaagttattcataaggtatccactcccgtgacccaaacacctcccactatgccccatctccagcattgggggtcacatttcaacatgagatttggaggggacaaaacgtccaaaccatatcgccccctccctacaaaaaaaatttagaaatacctaggtgtggttgtgtgcacctgtactcttagctacttgaggggctgaggcgagaagattgtttgagcccaggaatttgaggttacagtgagctgtgattataccactgcagtccagtgagacactgcccaccccaccccgataaaaaaaaaaaaagaactgtgattgggagggtttggggccaaggttgcttaaacaaacacagcccacagctctgtgccaattgaggtttgggattcctgcctcacccctagataaccaataaagtagctatgatacattaagttccttttgttcttaagagaaggtgatgggtgtaactagagtgttgacaacatgaaaaacctaaaatcaggttggagataaatatttaaatctcctctattggatactgataatgatgctcttaagtaaaaataaatatagcaggggcctattaggggagacaggctctggctttcttacagcatgctgttgctgtgtggtttgggtcacgtttcttaacctctctgggatttcctttcctctggtctgaaatgagcagttgttgtacttgccgtataatttctgaggcctcttcttactcagaacttctgactgtttttaaaagatggagcattacctctctatacctgactgtgccgcatgccattcgattttgttatcgaagcaggtcagcccgttgtttttcacatagattcttacaatgcaacaaagcatcacagttactcacaagggaaggcaggggaggagggggaatgtggtgtcagaagccagacccatcctcacgtagtggagctgcacctgcccatctcccagaaagtccttcaagcccctttcagcgcctccacctgcaggcctgttctttgcaagcctggctgtggtctgttttgcataaaagaagattatccagcagtggggtttgctcttctctttttacatggctgccatagcaagccaacaagaaacctgccgtgtggagtgacggtcaggaaccttgcaagatgccgtcgaggctctgtctacaccaggcaaagaatcttccagattcctgctctctaactcagatgaaagtagttgctgcagagtgtgtttgcttctctgtctgcctcagggctgagcttctaaacatacctggtctagtgggttgcacagctgattccaggacaatgggatgagggaaggggaagatagaggctggcagaggtggctttttgtggcatgcatgggaaagcggtagggggtgctcttcacagttgtgggggaggcttagcctgaatctcagggcacagctgaagaaggagagcagcctggaaatgcgtcctaaagagccgctcagccacggcagctgtgagctgtggcccatcagtggctggaggtgggaccatttgagcttttcactgagatagagcctgtgtcaagtgttctgaacaacttgctgtggcctcatgtgagcttggctgtggaatcagggaggccagcacagagcgtggggcagctattcccagttcatcagcatcagccacggtgtgcagaggaggggtgggagtgagggatggtcgagagggagaacctgttgatttgcccgcaagctagttgtggaagacaagcacaggccaagaaatgtgggtggacaccattaatggagatggaaggaggtgttggaatggaggaacacggtcattgactttttgcacatgcttagtctgagatgcctccagggcagtaggataagctaacctgtgggaatgtggagggacgaatccatagctcagaagcaagcggtatctgcaggaatggattatactggctggatcatagggggtcagtgagtcatgagaatgagccctaattgtagagagtaggatgtgtgatgagagaagtggggacgcatcgtcatggggaccatcttgatggagggagggagaaaagagaggagagataggcagtgagcacagaaggaggagaggagaaccaggcaggagctatgccagtgacaccaaggaagggtgcgtttgctgtgatgtgttttcatcacgttttcataattaaccaacagattaatattcctcagaaatacaaagcacctctcaatcatgctataccttcttcccaactttacagtaatacatttcttaactttctagttatgttttagcaccttagaatattgaaaacataaaccaaaccctcatggcacgagcatgggaagcccttgtgatgaaaatcagctcaatgagaggggaaatgcgggaagcatttttagcagaaagtgatgacagcttggagcatcccaaagctatgcattattcagacgtgtcggagcgagagtgcccgatttcaccacccattacctattgggatgccttcttctctgcttgctaatctgaatattactcatttcaaggttttgtttatattatcttgaggggaaacaaacagtacctaattaatcccaccaaacataatattggaaaagcaattattcccaccacgtgtaataaaccatctgtagggaaaataatccattaagtgtgaatcagtgtgaattttaaaactattattaagatcagattggttcctcgttatgagcaccataattttagtatttgttcatgcatactgtgttatgccatgttctgtaaccttaaatccttaatgtccaaacaaataatatctatatgctaattagtgtcaaaaatcacaggtcagccaatcaggtgtttcacagatgagccccttttttgggggttagctcgaatctgtgattaattagaaagtgagtcccctattttgaaattctagtgataattgtagcagagggctgaatttatttgcattttcagtaaatcatccattaactgaaatgaaatctttttgttaaattactgctcctggttcagttaggagggagttttcccttcatttttaaatgtactggagtatccttcagttctccttgagtgagaagcaatcgctttgaccattgtcaaccagaaagaatttccccacggcatttctctctttcccagctgggccataaattgtctcatgactgaggttgctgtctgctcctgagcaagctggaagcaatgatgagctcagagctgggctttattaaatcctaggaagacacataaaaattgttagcagttgatttcgcaggaaacacctagcaaacttgtcggggtttatattacaaagcccagggcctgcagttagcagatcatcttttttgaaaagcatttgggtacctttgtcagagcttttctgcattttgacgtaggaggatacctgagggccatggttgtgagaaaggagagaacccacccaggtgtcctggggattgttttattcataaagtaattcggatgatctcgaggtggtccagggagatgggatagagtcagccaaggtgtctattgtaagatagattgtgaacccctcaaagataggctgaagtccttattcctgtcacctgtgattgtaaccttatttggaaatagggtctttgcagatataatcaggttgaggtgggtgcatgttggagaaggatgggctctttattttttgtttgagaccatgtcttgctctgtcactcaggctggagtacaatagcatgatctcagctcgctgcaacctccacctcccaggttcaagtgattctcgtgcctcagcctcccgagtagctgggattacaggcatgcgccaccacacctggctaatttttttgcatgtattttggtagatacagggtttcaccatgttggccaggctggtattgaactcctgacctcagatgatccacctgcctcggccctccaaagtgctgggattacaggcgtgagccgccgcgcccggccaagaagggtgggctcttaatccaatggctggtctcttataaagaagagaagacacagacacacaggaaaaatgctgtgtgaccgtggaggtggatcagagtgaaacatctgcaagtcaaggagattgccagcaacaccagaaactaagaggaaggcatgggacagagtcttccagacgggcttcagagggagcatcgccttgccagcacctggatttgggacttctggcctcttgaactgcaagaataactttatattgctttaagccccccagcttgtggtcacttgtcatgccagccccaggaaactgacatgtcatctctccgtgtgactggttaagtcttgatgtgatctcctagacctacgtactttggagctagccagggtatgatcagcgagaggcttaggacttggttagttcaaccaagctgttggagcccattcttgcctcaacctagtgaaatcaaaccttgcatccttttctcttgcctttctgaagatgtggatttgaaaaaaagaaaagtattcctgcaaagttccttatctcaggctccatggcatttctcagagcatccggccattgagaactgactccgtttctccaaattcagccttcccatgtgagttctgtcctgagatgtgattggggattggaagccaagcagacccagcaaagggaaggtgaccagtggactccacctgctcagcaaacactgacctggcttttcctttctgggaagttccgcaggccagctggcatcctccccgatggcatttcctggagtcctcacctgaactcttgggaattgccgcctagagaccaccatgcaaagcaggatgttgaagacagattagaaggcttctttcgcgctgcctctcctgtgcggcttctctccgttgtctgtctcctctcttgtgctttctggatctcttctaaagcttcttgggaaaagccaaacaggaaatgagccaccaagagactgggcttagacaatgatggccaagtagaaaagattctatgttctagcattggggactgcagaggagacagctgcccctttccaggacctgtcgaaggacaaagtctaaggtccgtggggatcacccttcaggaagatggcatcaggccacaaaaatagaaaagagatatcgccctcccttttatagcacaaatgttaccagtcatgctagtatcaaaaattatattccagtttactttctgcttccctttcaggcctgagatgcctggttgatccatcttcgaatactttcagggagctagtttttcttgggcctttttccctcttaggggccaccacagaatggcctccccagccgttttctctccctaattctggagcctggcctgcctgtcctcccgagagccccacctgactttctttgctttgctttgcctctgtggctcagcttgtttcatccgttcctccttgccattttgaaggcagtgccagcactggagaaccctatcagtgcttgcaaccccaccacgaggccggcagccgggagggctgggcgcatccgctcactgtaatctccagaacagataccagcttttcctaaccccctagcctgttctaacccttgaactgcttgagagatgtcaaaatcataactctctggggaagaggagtcagtgtttctgtcctagcagcacgcatcagtgcaatcagagctctgtaaaagccaggatccaccaaggggaggatttgtgaagctttttccagttacagtgagaactgggcaggcatcgagtctcagtttcagtgccgcttgaatacagggtgtcagtgtcacttgagtgctaggcggaagtgcaggttaggcctggatcggagggttaatgattaggtttctcccgggctgcttttcacatcagtgctgtgcaataagcacttttacaagtcaggctgcttcctttgtttgagctgctaaccctgtgtattgagcctagctaaataactccgatattaggataatatacaaatgaatgtgtaaaacacacttcagtgagtactgtgctaaccgcttcttttggtggagggaggaaagaagggtgtttacaaaacggcttcgctttgctattgtcatgaggagaacaggaatttctccaggctgtgtggtcaccggtgaatatatgcatctaggttttagtatttatttggaaatcaaatgtattatgggcaagggtatgtaatgaaccagccatttaaagatccctggacataaaatgcaagcttttggctgcgcgctgtggctcatgcctgtaatcccagcactttgagaggccgaggagggcagatcacttgaggtcaggagttcgagaccagcctagccaatatggcaaaaccccacctctactaaaagtagaaaaattagctgggcatggtggcgggtgcctgtagtcccagctactcgggaggctgaggcaggagaatcacttgaacccaggaggtggaggttgcagtgagctgagatcgcaccactgcactccagcctgggtgagagaacgagactccatctcaaaaaaaaaaaaaaagaaaaaaaaatgcaagctttcgacaaagcctgcctgcctgctttgtgtgtgccttccctttttcttgcagtggccctgtgggtttgcatggccctctgtggccagcctcaggatctagggtcctctctgcttgtagtataagctttgaatgctgtggcccggagcttttccacagcctgtgtttcctgcttctggtctgctctagagaaattcaagtcaggtttggcctggcttggccaacccgagcttgccatgtacctgagtcccaagggtgtctgtcccctaactctagccacctgttggggaggtaggaaggtctgggagggagatgctgaggagagcagagtcgtgtgcagaccaggtgggactggactacaggagagaccaggtgggactagactacaggagagccctggggggccactcctggggccaggagctgctccctgagggaattctgaagctggtttgtgattctgtgtcacagccacctgcatcccagtgaaagctatggttgctttccataggtaaaggcaatttgaggacagcaaacatattttcccccacacaatccgtcattgtctggtgatgggctgtcagtccaaaccgtagcctagaaatcgtagctcaggaagtagagtgctgagaggaacaattcaaacaattttgtttcctaaatgtattcttcagttgaagtctttgtggttaatgttgatagtttgtaggcacaatcactattctatgcatagggacagcttttcctaactctggaaaagagggtgtgtgtgtgtgtgtgtgtgtgtgtgtgtgtgtgtgtgtgtgtgtgtattgtcaaaaaccaatggaagagaaacacttcaaaatgggtgagaacagagaacagcatgaaatatggacagcagacagccctgtatgcaatgaaaatgcaggtgcatggtcactagaaaagatgcctcattctttgaatttttggctctttgaaacacctgtgtgacattaaattttttactgaaatgtggtattattaagtcttgcgtttaagtttataatcagaaacaaaaacaccatgtcctgttaaggaaagagttattctgacaacggttagcaggataaagaagattttactcaggagtattgcaataggtgtcaagattccacagaagaggagagagatcagtctcaactcgaaatacagtacaaaacttgggatttatagccaacaacctgggtggggcaggtgacagtcagtggatggaaaattactaagaggacacctcaaggataggaggtgtcttgctaaatgaacctaataggattcttcctgaaaacaggccaatgacttagacagcaaaggtggaggatgagtaatttgatctcatgtcaagggtgtggattcactccaaactctcttagcaggatagagccaaagtcaatgcctagttgagaagagagctcagaggagcctggctaacatttagtcaaaaagagtctctgtcagtgctcgatttagttttattactcaacactgatactttctgagctaggcactgggttaaacacttaaaaaaaagaaaaaaaaaggttggccaggcatgggtggctcacacctgtaatcccaacactttgggaggcccacacctgtaatcccaacactttgggaggccacagtaagagcatcatttgagctctggagtgcaaggccagcttgggcagcatagtgagaccctatctctacaaaaaatttttaaaaattagccggatcatggtgtgtgcccgtagtcccagctacttggaaggctgaggtgggaggatagcttgagcttgagaggttgaggctgcagtgagctgtgatcccaccactgtactccagcctgggcaacagagtgagatcctgtctcagaaagaaatagtttagtggcaggtgagagagcatcatgtaatcgcgatgtgtaaaaacgtgcaagaatggaattgtgcagaaaacccagtgcgggcttatcaacccgaagaattccctctgggccccagggaacattcagcaaagaagctaccttggggattgttcttagattttaacaatttgctgggatgagagtatttgagagtggaaagagcactgggctgagggaacagcacgtgccaagcgatggggaacacaagagccgggttctgtggctgctcagggggcagagctccagccaggcctacaaggcacacaggatgggggtgggggccggagctgaggctgcggagcagtcggggaacctcttccatcattgacaagtgagcccaaaccatgccattccaggagtgttaccctagccgcttgttatgaagccctctgttacttgggatgatctgagtggccttccacgcacttcagaaaataaattccttttttatggtgagcgaaattctaatatatatttgtattttcactaaccttaccaaagagaaaaatgtcagcccttttcctgaagtttcttttgtccacttgtgactttcaattaaattttaaaacctccagagtaggaggaatcccccacagagacaataagttagctgattaattgaaaacgtggaagctatttttatgattaccacataccttgtattttatttttactgaaaacacataagtgaggtcaggtgtgttggctcatgcctgtaatcttagcattttgggaggtgaggtgagaggcttgcttgagcccaggtgtttgagaccagcctgggcaacatagggagacctcatctctacaaaaaataaaattagcttggtgtggtggtgcatgcctgtggtcccagctactcaggaggctgaagtgggagagtcacttgagcccaagagttcaagattgcagagagccatgatcataccactgcactccaacctgggtgacagagtgagactttgtctgaaaaaaaacaaaacaacaacaacaaaaaaactcacataagtgtaccttaggctttttttgttttttgtttgtttgttttgcttaccttttatgtaagtccaatgcttctttttgaacgtggttccactgatgagcttctataatgcctcatcaacagttctgcctacaattttttaaagtggagttagtcacatttttcaggttttccagttgtctcaccccagtctaattttgcatattttttttagctctttacctttattatagcctttgtaaagcattccatttagttttccaaaactggttctttttcatggcactaataattcattttctcatgtcacatttatttgaattacgtaattatagtagcaaggagaattggtattaagtaagttttaggtgaaacccatcgactttgggattgtgcactctgatgagtcgggcagaagagtccaggtgttctaggggagcctgtcactggtcagtggtcagtgtatcccgaggcattgcaaatcctcgcttatctgaaggacttgcttccctggaaatcttgtctgaggatttttgtgttcctcgagtgcccaacacacattgctggaccttaaggggacacttggatatacatgatctggtccagccataagggcacacagtgtgggagacaaggggccattctgggaacagtaaagaaatgagatgtgccctcagggagctcagacaaggagctgctggagaccagcagggaggaacagtgactgtactcaagcctcaacacagatcctcaggaacatcgtgttgggttcattggactctgtatacagtcagaaaagaatccagaggaagcacagctaagagaattgagacagcaatttgctgtggcatctccgcacagaggtagaagtttattgatttgtttcctctgatttcagaagtagtttttcgttttgttttttcagtttctgttcatgtcatagaccagcgacccctgctcctccatgccccttagtctgctgggttgaccagatggctggcacccagcactgtggcatctatgcatttaaatattattattagaggctgagggttttatatggttagctcaagtacgttttatgcattttttttcctggttttttttttttttttttgagacggagtctcgctctgtcacccaagctgcagtgcagtggtgcgatctcagcttactgcaacctccgcctcccaggttcaagcaattcttttgcctcagcctctcaagtagctgggattacgggtgcccaacaccatgcccagctattttttgtatttttagtagagatggggtttcaccatgtttgtcaggctggtctcaaactcctgacttcaggtgatccgcctgccttggccttccagagtgctgggattacaggtgtgagccaccgtgaccggcccattttatgcatatttgatttggagttggtgaatcaactcgaaaacctcaaaagggggctgtgagaacactgggctttttagggataggtttccacgttcaccgatttcatctgaatggactgttgatgcttggtgctgtggccatgcccttggctcctgcatttaggagcagtgaatgtggcgtccatctgcagacgtggctcagcatcatacgttacaagcacagcttttggtacaggagctctcgggtcgctgggagattgaggattatgagaacttccttctttcacacaggggtttatcccctattcagcattacatcagctttctctgactttggcatggtgttaggaatttatcagggaaatacgttctgtttatactgactacattacgggaagcttggataactgtatgggggactttaaaatttatctctctgtgatagtttttcagctattatgaaactaaaccaaacgaaggcagtgggggccattataaaggaagtttgagaatctgaaagtcttgatttcttaaaaggaattttaccataatctctctctcgataagaattaagaaaaatacttacatgtattatgtgcaaagtgtacccgttaaattcaccataattgaaagatgcaatactctgtcaatagtttgggaattgttttaggattaaaagtgagatccatttgtaagaaaatgttttcattttagtaatgttaatttgataacttcattatattacttctcaatatattactttgagagcaggtaaaaagagttttccagagcctactggaactatgctaatcagatttatggtacctcttattttcctggcctttcattttgtttttgtatttaagtcttctgtgttgacagctgtcatttgatgtgagacaggtgaagctccttcctgctttggcccacagttgggcagcattgtccccggcctgggctggcctcatcaagtgaaacatcatgctgccatgtttcgacattttaccttttcaggttctgcactttttctgtgggaccatcccctcttccccgcctgccctcttctctctggggtgttttagattttaacccagcctctaacactggacacacaagtcctcagtggagttctgtcgttcagtccgctgtcttggcaaacagtgcccaatcaagaaacaaacgtgctctgctggctgcaggctgcctcatttctccccgatccgaggaggtgtcacatagtcatgatccttcccgggcctggcctggggcagaacaggatggcaaacacctctgcaacctctgggtttccagtcctgccctgggtgggcctggcttcgcctcatgaaaccccgagtactgtttgactccctgccatagctgagtgcctgccccaaccccactctgagttcagcgcacatcctggtgtgaacgccaccatctcagggacatcctgctgcaaagctcctctctgtctccttggtctcttgccacctacagtctttctcatgggagccccacccctcagaaggctccccgtctctcctgtccgtgagttttcctggaattgtcacaatgcagagaatgagttctgtggggagggtggggaatgtagccctgtggctgtcccagcaagtggcccctgtgggctggtggctggctccatttgagactgccttgaaccatggggtctcctggggaggggctggagctgtcaggcttctttctgctggatgacgttgctgtttctggcagcaccattggctgcatctcagactgtgtcccttccttcaattctgttgatgtctcagtttgtggaaattcggaaaccacatgcctttctctctaggggtgacagcattgttggcctccatcctcctgtcagtccttacgagtgtcttcatgccaggtggtgccgtcatggcatgtgttgggcagctaaccagtcccttcagtgtggggcctggcctcctccttgccacctcgttggtggaggtgacctgggatgctggacccactcttgtttggactcagtgtaggattctctacctctttctcccagttacacagccttgaccaagcttctttattcctctgatcttttttgtttgtttgtttttactttaagttcctggatacaagttcagaaggtgcaggtttgttacataggtatacatttgccatggaggtttgctgtacctatcaacccatcatctaggttttaagccccacatgcattagctatttgtcctaatgctctccctccccttgctgccaaccccctgacaggccctggtacgcgttgttctcctccctgtgcccatgtgttctcattgttcaactcccacttatgagtgagaacatggagtgtttggttttttgttcctgtatgagtttgctgaggatgatggcttccagcttcatccatgtccctgcaaaggacatgaactcattctttttttatggctacatagtattccgtggtgtatatgtgccacattttctttattcagtctatcattgatgggcttttgggttggttccatgtctttgctattgtaaatagtgtcgcaataaacatacgtgtgcatgtgtctttgcagtagaatcatttatattcctttaggtatatacccagtaatgggatggctgggtcaaatggtatttctggttctagatccttgaggaatcaccacagtgtcttccatgatggttgaacaaatttatattcccaccaacagtgtaaaagtcttcctatttctccacagcctcgccagtatctgttgtttcttgactttttaataatcgcccttctgactggcgtgagatgctgtctcgttgtggttttgatttgcatttctctaatgatcagtgatgttgagcttttttttttcacatttgttggcaccatgaatgccttcttttgagaaatgtctgttcatatcctttgcccactttttgatggggttgttcatttttttcttgtaaatttgcttaacttccttgcagattctggatatcagacctttgtcagatgggtagattgcaaaaattttctcccattctgtaggttgcctgttcactctgatgatagtttcttttgctgtgcagaagctctttagtttaattaaatcccggttgtcaattttttgcttttgttgcagttgcttttggcattttgatcatgaagtctttgcccatgcctgtgtcctgagtggtatagcctaggttttcttctagggtttttatcattttgggttttacatgtaagtctttaatccatcttgagttaatttttgtataaggtgtaaggaagggatccagtttccgttttctgcatatggctagccagttctctcagcaccatttattaaatagggaatgctttccccattgcttggcttgttgaagatccctctgatcatttttaaggctggttgagaccagccctgtggaggacttccttaattttcagtggcaatgtttttaatcagtgagatgactcacaacactaaacaattccccatatatcttgtgtgttaggttaagggaataccatgttctttttttttttttttgagacacagtctcactctactacccaggctggagtgcagtggcacgacctcagctcactgcagcctccacctcccaggttcaagcaattcttgtgcctcagcctcccaagtagctgggactacaagcacgtgccaccacacccagcaatttttgtacttttagtagagacagggtttcaccatgttagccaggctggtctcgaactcccaacctcaagtgatccgcctgccttagcctcccaaagtgttgggattataagcgtgagccactgcgcccggcctgctttacactttttacatagatcctggtgagaatcggacctgggatttttctatgaatgagagcctgttgtatgccatacccccaccccacccccttacccccacccctacagccttcctaatataaggaagaaatgaagcagccgagccatcattaagcagatcacctctgaaaatgaaggaaattggatgaaagctctgccccggcagctgagtgctaaattagggagaatcacgggaggccaagggcatggccgggctttgtcgctgccttattatggatttgataagaaacaacttttttgactgtttacattatggaaatgtgataacccgtttgtattacttaaactgtgcattttgtaagtgttgtcaaagggagggagtaatttgtaacagaagcagagtatgtagaaactgttctcgtaaaagcgttctctaaattgctttgcttgcagctgtggaggttgccataaagaatgatttctcatattggattttcaaagccgcaggagtggccacagagcaggcaacggacagcccaatgatttaagattatttaatgccccagttgtcgtgaaatagaaggaaataaactccagtgggctgctagaacacattactacaatctcttaatgccccaaactaggagactgatttatctcctgttatgtcttattaagtgacattcagaagaagaaaagaaaaaaaaggacagccaaagctgatggctgaaaattaccctgaaatgagtgtgatgcaggcaggcttgtatcgttcttaagttcaagaacccaaacttgaactcaacactttttcagtgtgttttatttgttagtacagagatatttgaagatgacagattgggcataagaataggccaaaaggctgtctgccccagtgcttcccagacttcattgagcacacgaatcgcctggggctcttttaaaatgtagattccaatccagaaggtctgggaaggagcctgcaactgcatttctaccaagctcctccatgcttccaaggcagctgttcctggggccatgctttgaaggagcaaagttctcattcatcctgcagaaggaacctgcagaaattctcattcatcctatagaaggaacctgcagaaattctcattcatcctgtagaagggacctgcagaaattcttactcatcctgcagaaggaacatcctccaggcagaaccaaaaacagctcattgtcttcctttatgcagtacacttagggcatccctattccaaacatccgaaatccaaactgttccagtgagcatttcctgtgaatgttatgtcagtgctcaaaaagtttcaggttttggagtattttggaattttggatgttcagattagggatgttcagcctataagcattccaaaatccccgcaaaagaatgaaatctgaaacacttctggttttaagcatttcagatcagggatactcagcctgttgttctttatttcacagtcgtcctttcgtcctttacataactgttgtccctgtctctgcacagctgattgtgagtgatcggatttgaactccctacaccctctatctaacccattcccctcttgcctcatcctcagtgaggacaaagaaggttgctctgggctgcttaaattgactcctacatgctcagtatatatcctgcatgtacctgttttttattttttttatttttattttttttgagatggagtctcactctgtcacccaggctggagtgcagtggggcgatctcatctcattgcaacctccgtctcctgagttcaagtgattctcctgcctcagcctcctgagtagctgggattacaggcccacgctaccacacctggccaatttttgtatttttagtggagacggggtttcaccatgttggccaggctgacaacatatattctcgtggttcaaatggtggcttttgttttcatggcattctgtcatgaacccagagctcttgatgcctaagagctgcctaaggcagacccattactgcctaagaagaagagaattggggctattaaacttgcaggtttgcaggtatcccagccagcactcttgagaggcagtgtccatagaaatagcggtgatgatcaccaggctctccagtacggattcctaggacggggcagcagagccatgcactccccagtgcactggctggtactggggccctcaatgcccctctgggggctgcaaacacaagagatctgggctcccaggccctatgcacttctgcagggcacaggctgcttcttgcattcttaagtccccatggataggaaagcccaatgaattgggatggtctccagtgagggcttcacacttcctttataacatgcagcattttaggttggtgactggtgtgcactgggccaagggtccactctgtctctgtccttacccccgggcttgaggactagcccctgccaaatgtcttacgggctcatcccagtgggcttgttgagtgggctgctgagtttgcaatgcctgtccctcctctatttaccaaaagcaatgttttctctcttcacttgctagggtttcccattctccctgtgcctccacccccatcctcctggcagccagatggtcttccccctcacagccatcactccctccctccttccctccttctctccctcccttccactgaacaactcacctgctggtctctggacctcctgccacataaaccattttccacactgagaccacttctctctcctgctggaaacctttcaaggattgccatttaggagagatgttaagtccactcccctagcctggccattgaggccttggctccctggcccctcccagtcctgggctgcaaacaaactgaagctctgggctcccttgaccctcagccattgcccgtgccatcctctctgctagacatcatgactcagccagacctcagctgtgtgacccactccaaacaccagctactctatgaagtcttcccacctggatgcaagcaccagaccctcgtcttcctctatttccatgaggcaccatgggcacccctcacctcccctcagagtgccacccatatgcgatgcaatcactctcaatagccctgacacacacaagcagggacaatgtcctaagcatctttacatcccaggacaagctcacgagtaggcatgcaatgacggaatggaagagtgggtaaatggacaatagatatcactgcttggtaccttccactacaagcactggacttttagggaacagcatttaagccatagcgagaaaatagctaatgggatttctgaaatccacaatgaaatgtcaagtaaaatgtttcctccttgggtcaatcaatgagctgatttcttattctctgatattgttgtgggcttgctttagacctaaccgtacccttcagggggcttactgcaggtgcacattttcagaaggatggagtcctgagagaaggccctcgttcctggtcctcacccatcctccacccctctcgacccgcagcagacacccccaggtctcctcttttccccccgcctccctggtttccctttggaggtgctttcaggatatgctgcctaatgctggttcctgttagacaggttcgcctgagggctgagggatttcatctagaactacagcccctcgaggggactccaagaactcttggctctttggctcccatctggctcccagcttgctcgtatttgtttgatccgggcctgtgtgtgttacatttttataggatctccctccgatgtgcacatcgatttgttctgttcagatgctttgtgtggaacgtattttatgtggtggtttttggagtgttgcaccctctagagaaaatgacctttcatgcccgtgaataatgaggctggaaatatttctcttaactcagaagcatctgcacgcacttgttttcacacttgagttgatgagcctgctcatggcatgactttcctccaaagacctggggatccgaataatgcctatttttagtgcctcctgaaaacaggaaagggcagaccatggaaatgtttcctttgtgggagtatttagcttcaagtttagcactgggcaggagtgtgtgtgtgtttataagtatgatttgatagatcatttttctcaactacacactgaagaaggggaaaatgaatcataaaggactacctggagaccagtagtggctccagcagtgggttctgggcaagctgtggctgcgcagtgcctgccggcctccagatgagcatcccattcatgctggggagaagccgggacagcttgagcaacttccagtgtaaatgggcttcattcactgtgagttattttgaatgccctcttggccctgtagggagttgcagacggtaatgtatgcatgtacatagaggcaaaacctcatagatcctgttttgtttttgttgaaacactaggtttttgttgaaaattagaggtcacaatgtgacaaaatccctctgttcttaaagtaagaagagccacccaatcccagaagcatattcatgggaagccagttttcatagtcttcccagacttcttcagaaagtagctgttggaaagaaccctgtctgtcagtgtctggaagctcattgccatgtgtgtgctgacctcgcaccctcctaggggaggcagggggctgagaccatctgaagccaccagcattgtaacacacagtagcagtggtgtgttcagaaagcacttggactccaagatcaaggtttctgccactcacatgggcagacagatatctagaaacaaccatgactgtaataacagcagctggtcaccacggagcaggggagtgcctgcaggggaaggagcagcccctgggaaaagcaaatccgctcctcctggcccagggcctgaaacctgggaggctcctcgtcatagggtgggctaagccagctctttcttcctaatgtcagtgaggttatgcacttggcatggcggagagctgccccctcctccgtgagagtgggttagaagatggtggtggtgttaacaaggaaaaataacacctaatgtacacagagctatatccacgggaacctgttctgtggactattaaaaatccaaaattcatgttgaggtcctacctctcagtaccttagaatgtgactgtatttgcagataggacccttaaaaaggtaattaaggttaaagaagatcattaagatatggcctcatcccatctgactggtgtctttatagcaagaagagactaggacacagacacacacagaggagaggccatttgaggacacggggggaagatgaccctctaccagccaaggagagaggcctcagaatgaaaccaacacatctcacaccttgatcttgaacttcagcctccagaactgtgtgaaaagaagtttctgttgtttaagccccactacctgtggccttttgttagggcagccccaacgaactaatacggagtcctattaccaatctttgttatgagagctgcccctgaagtcacatcagttgcatttccggattccaaataccttttccacatagctgggttggggtctctctctgtcgcccaggctgcagtggcgcaatctcggctcactgcaacctccgccctcctgggttgaagtgattctcctgcctcagcctaccgagtagctgggattacaggtgcctgcccccatgccgggccaatttttatatttttagtagagacggggtttcaccatgttgcccaggctggtctcaaactcctgacctcaagtgatccacccacctcagcctcccaaagtactgggattacaggtgtgagccactgcaccccgctggggacaggcttttgaatccttactctttaaaaagaaaaaaaaaaggtgtatatttaaggcctacaatgggatgtgttgatacacgtagtgaagtgatggctaccttccagtaaattcacgtatccatcatctcacatagttacctttcagtttttattttttgtggtcagagcacctaaaatttactcacgtagcaaatttccagcatatgatacaatattattaactctggtcccgtgctgtacctaagagctcttgacttgttcatggacagactgcaactttctaccgtttaacttatatctgcccattttccccactcaccccgcctttatttagaatgtgggggaaacagagactgatgcactgtatctatgtgacgataaaactccatcatattagttagaagggaggagagtaacgttgcttttttatttctggaaatcagaaatcatattgagacaaagttagaaaaagccatctgtgttttgtttggccttgtattggattcattctgaatcgactactaaaaacaaaaggctttgcttcatttcttctttcctttttatatttgaaagcactgtttgggttgtgatttttgtgatgcctttattttattttctgggactgtgggtgattttggcaaagatgtatgacccttaactcaaaagggcgcggtttacaggctaactgagggtgggtttatgagcagcattattctgcaggaacacagaactgtacagacaaggcggaccacagagtggggcctgaagcagcaacctgtcagcctccccttgctgcaaacacctgctctgccccactggatcccaggtacactcgtggccatgtgtgtgggtgggcttgaacattgccactccccctccaagaacaaacaccccctctccaacactaagaaaaatatcagcatggaacataaacgttcccctcagataatcaaataattcaccccaaactgtccactgtgccgtcactggctaaagcgagctgacttttctgtatacacgccatatcattttcctggattatttcccaaaacttgacagaccttaggaaagctatttttgagactttgctgacagtttttctggacccacagtatgtatttcagacatttcagtaataactctgtgacctcattatatgcgtatttttgtatgatcctgtgggtattggtgtgaggacacaccttgtattcttatttaaaaatcccaagttaaaaacagccctggccttttcgagtcacgtccgtacatctgagtttggactaggagagtgacttagttcactacaacattttaccaaaagatattgaagcaatgttttttccaaaatatggcataacacagaattcttggatttgctgaaatcctacagatttttctgtgttcgtttgtttgccatattcatgcaggtgatttgcaggtgtgcaacctggagtccagctgtcttgctcttcatgctgggcactgtttgttctctgctcgcccagcacaatttatattacagaactcacagcgaggtggagagaagacacagtgtccggagtcaggagctctggattcgagtgcacattcacccattgataatactgagcaggcaattcaccaaaaccaccttgtgctgcaccctcttgaatagcaacttaatacatgtccgggagccgcctcatatagttgggttagttgagataatgaacttggccagctttgaaacaggaagtttttgaaacttgccggtgtgcctgcatgttctgtgtgtgccactctcatgctgctagcagtgccttgcctgttcttggtgttcttggaagatacctgagctcttactttgactcctcaaggtgtttggttcgcattcattgacaacagtgcagtttgtacccagaggctctgacttcactctgttgaaggttaaagaagatagtggccttaggggagtcatcaggccattctactgaaggtgggtggcatctttaatgcagctggcagcctgtctggggcatggtccttgctcaggacttatttcccttcttttttctcacctttaagtagaaatgtacataaggacacaactagatattgatttgctaagttcagtgatattcaaagtgaaaatgatacatatacttctggattattttcgttgcaaaatttgttcattctttccctattcggtgtgcattgagtgcctgctaagggctgggcagagtgctagaagacgggaactgtgtgagccagcacaggtgtggagcctgttttctgggagctgagaagttgggggtggagaggaggcacactggacattgcttgagcagccaaatgagatgacaggtgtgatcccagcacactgaaggagaggcacacggttctctaagagtgtgtgaggagacgagtagggctgggatggctgggagctgtgacattggaaggacttaaccatgtgtgcaggaggcagtagcctcctggggagaggcagcagcatgtgcaaggatgggggcccagcactgggttcatcctacaagcatgtgtccgggcctcaaggccactctgatgactgctttccctccctgagcctcctgcagtgagagtgaagctcacgaatgctttgggtgtggcatggcagtgtggtctcattgtgtaaggtgttttgattatgtgtggacttttgcgccaggactattttaaatgctggggatgtcgtgctgaataagcctgaccaagcctctgccttcgtggagtttgccttctacttaggcaggggctcagatagtaatccagcaaacctataactgggccctgcaatgtcagagactatgagtgttatgaatagaaatagatacagtttaacaaggggccagaggggcctgaaaggctgcattgctgtgggcagggaggtctgggaaaggctttggagtgtgggtgctggggctgtcccttgaccagagactggaatgatgaagccagccttgccaaagggtcccctctgtgacttgctctgacaccctaatggcagggatctgcctccttgcctcctctctaccacacaaaactgattgccttccccaaggacaacaaaggagaagaaaagaaaacgaagaaatcagaaaggataaaaccaagagagatcaccaaaggcgcgtggtgcaaatactgatcacatcagtaagaaaactgtttccatccctgatttgcttttcttttaaataggatattcagtcatagcttcactataaaattgatttattgtgttgaaataatttccgtagcaggggaactaattggattgtgtagcataaagaaaatgtatgtgggacaatggggaagaattgagccaaaatgaatccaatatattttaatctctgcaatacagattatattttcaattaagaagcttaacttgcatgtgttcggcgggcgggagcttcccagagcacttctcgcatgtgtttatgggtaataaatcacttagcattaagaaggtagacgatcattagcccatgatcactcagttgcctcctgttaatagcaaagtcaatgcacaccatcactgtggccatattcgggtggtaaaatgtggagttacatggaaagtggaactgttatattggtgaatacgatttactagacggaacaaggaaaacctgaattccatcccctgtgggccatggaaagcccatattcacagtcaagtgtgaaagtggcttttgggccacccgtgccctgcctgaaagcagagcatcatgtggccacgtgtctgctcggctctgccttactaattgtgtttaacctgagctctgctacagacagactttggtctttgctccatgcgtgcttctggcatgacctaggagttgcttgccagtgatgggcagagggcgagggcaagacgctggctagcctttgtccagtggtccacttgtctgggatcgcatttcatcttaaagcaacccatgaggtggaggaaccatgatcatcatattatataggccatggaatctgcctcgtgggctgtcgtagcagagcagtcaacaagttagaagccagagcccttgtgcactcatcggtgcccacaataactcattaggttttttccttttcttcctctcagtcccagtagccgtctaagagcagaagcttctggggcctggccttgcagacactgacctttgactcacctctttatgattaagacaagagcatggaagaaataaaggggtcattaaaaaaaaagaaaaggaatctggcaggaaaagcagaggcagatgtggagctggtttaaaaatctatttcaagtctttccagtggctggctgggtaggcaggggccgccaacacgcaggggccaatgcagccaaggagcagttgcgtaagtccttgcgtaagtagaatgagatgcccagggctcccttgagcgcggccacgtggctgggaacctgtcaggttttatagcatccaatcagacaccgtgcaccaggatggagagcccggaaagaggtcagagctggggaaggcaggtgggggctgtaaacccaacagcagtgtgaggaatgggctcaaggcggatggagtgagcagaggtgtcccagggacagtggcgagcccgaaactagacatggggagagaagagacagagacaagaataacaatggtagtaaggtggcagatcctcagtttaaaatctggccacgatgccattcacttaggcacttgcttgttctagaaatatttattaagcactaggtgtggcaggtgtagaatggatttgcccccaggaaaccctggatctggggctccgagtcatctgtctacgtcctctggagccttccttgtcgattgtcccttcacctccagattcttctactgcagggaagctcccttgacctcaccctcaccctcactgtggacacctctgttttgtccttcacagccagaccacacagagtggtcccctaggtccccagccttcactcactcttcatctccccatgaggctaatgaaatctgttctactgcagttatcaatggtgtcctcatcaataagcccacattaccgccctccccagtctcagacactgttgatggcgcccttgctgttaagtgctcttgtccagtagcttccatgaccccgcgtcttgcgctgtttccctctggcatgtctcattccttctctccctctcgctctatctctctccctctcctctcctcccctcccctccccgtcctccccctctctctcctcccctctcctcccctcggccctatcctcccctcccctctcctctcttccctcccttcctcccttctttccttcctctatcctcccttctctcgctctctctctagctcattttttttttcttctgcccggaagaaatactggcattctccaaggctcttttctcagccttcttttttaggttcttattctaaaatctctcttcagtgctctctcattgatttccaaggatttctttataagtggactgagattgagtacaaaatgtaccttcaactcttgaccttcacctgatcccagaccccactttcacctgggtccccaaggctgagcacaggtccctcctatccccaaggaggtgctctgaacccactccccatggctgtggatggctccccaaccttctgcatgaggtagacacccagttacctctgcagcgtccttcccttcagccaaacccctccccccgccgcccctgctaaatttactttgtcaccctttctagaccaggtcagttccagacatgacctggatgctccttctccttaaagagtgaatgagcaagaggctgggcgcagtggctcacacctgtaatcccagcactttgggaggccaaggcgggccaatcacctgaggtcaggagtacaagaccatcctggtcaacatggtgaaaccctgtccctacaaaaaatacaaaaatcagccagatgtggtgggcacacacttgtaatcccagttacttgggaggctggagcacgaggatcacttgaactcaggaggtggaagattggcaggagcccgaaaccatgccactgcactctagtatgggaagacaagagcgagactctttctccgaaaaagaaaaaaaagagatggaaaatgagccagaatgatgggnnnnnnnnnnnnnnnnnnnnaaaaaaaaagagaatgaataatgagcaagaatgataggccatggcagattggcacacacataattttataatttcccctttttttttttttttcctggagacagagtcttactctgctgcccaggctagagtgcagtggtgtgatctcagctcactgcaacctctgtttccagggttcaagtgatcctcccgccttagcctcctaagtagctgggattacaagcatgtgccaccatgcctggataatttttgtatttttagtagtgatggggtttccccatgttagccaggctgatctcaaactcctgacctcaagtgaaccacccatctcagcctcccaaagtgctggattacaggaatgagccactgcacccagctggcacacacataattttctaaaccaggggttgacaagctgtaactgatgacccaatccagccctccatctgtagtgtgtatgcatgtgtgtgtcccacaagctaggaatagattttatgtttttaaaggattgaaaaaaggcaagaatactattttataacagatgaaaattatatgaatttaaattttgctgtctatacataaagttttattggcacatagtcatacccattcactttttgtattgtcagtggctgcttttgcgctgttataatagcagagtctattagtgaatgcaaaagagaccatatggcctgcaaggcctgacttctttactgtctgatcatttacagaaaaagtgtactgatcccttgactagactgtcaagaatggaaagtgcactgttaagaatgggcacatcttattcacagactgcaatcaataatcaataatcaatcactctgatgtaacctgagaacatactgtgtagaaagcatgctgtagaggatagcgtgtgcttccccttgtgctccccagtctgtttcacaagttctggatgattgatcaatgctcgatcaatgcgagctcccttctccatcatgggaagaatgggaagcctgctcctcccctgtggtgcatctggcatccgagctggtgttcatcgcttccctctctgctgggtgaggacctcgtgggtgaggacttccacataaaaatgaggggtaaggcgcaaacatcagaccagagtcacaggagacattatcttccccgtggccgccctgcctggtgagtttactgatttgcctaagggtggtgctggtgtgtgtcttgcaccatgcctccctccagcctctcagatatgtcctgtccggtggggacgtctctcctgtgtatatttttggtggctgagcaaagtgcttgtggttcctttcagccaattgtgctgaggcaaaggcgggccacttaaattgcagtttctctgatgtatcttctaaaagccaaacgtcgttatccacaaagggtacttttgtgtaacaccaggcactcgagtagatctgtggggtcttccctctgtgggtgatgagtctgggtttcagcatcccgcttccccagaccacatggccactgatccgtggggtgcacagaaggacaggcagtcacatgcctgcttctttgagttctgccacctacgagctgagtaacctgggcaagtggtgaacctcatggattctttgttgccaccagcaaattggggagagtaattgagagggcatttctgagctcctggctcagcaggtagcatgttagagctgcttgatcaatgcgagcccccttctccttcatgggaagaacaggaagcctgctcctcccctgtgctgcatttggcatctgagctggtgttcagtgcttccctcactgctgtgtggttgccaaagcctcctgtggagtaaggccctgcactgcttcatcctcctgggagagcaggcagtggagcaggatgctgcatacagagctggttcttggttcttgaggagggggagcggtggctctgccagctcagctgtgagtggtcccaggatgaaggaacagcaggaaacaaagatactctcaaggccatggagaagaagtgtgaggtagatgctggcgcaggagcccacggtgggggagaatccgcttctgatgtcttccaccctggacctcaagtgtcaaacagcaagagatgggctgagcaaagatcacccgtctcaaattcagttgacaatcagcaccagccacgtctcctgggaaacatgaagtggccttaaccgtcacctgcctgtcatctcaggcttgccattagtcaggcattcgttaaagaattctgtcaataatagaaatcagaaatgcctggaaagtagatttcttgcagggcagatggagaagacagcctctgggtctccaaacccctttggctctcactggggcttctgggcaggactggggacccatgtacatgtcatctcagggcagctttctttctaaacccattttgcagatgtggcggctgaggtctcatccagcacccagtcacgcctctcttgggggagagccccaccgttgggagctgagcaaaggcaatatttcggttttttttttaaaagatactgtgagttggtcatcactagacttgggtgtaagttaactgttatctcaccactttgctaccaggttataatcaaagaaagtcttagatcaaagtcagccacacacacagacatttatgaaaaatagttttgcacaatcagtgcatactgtctgttcttaggcttcataaaacccccttccctgtcatttgaggtgctctgcctgagccttgataaatgattcatcagaagcaaatgagaaagtattctggaggcaagattcaatttgcatggatagtcatcttagggaaccagcatcctccagacccacagcttcttgccactagaacacagggtccagcgttgggcactgtccttcaacactgggcttcctacacacacacatccaatccacgcacagcccgggagagtccctgaaacattttagctcatccacataccttgcatggtgtggaattcaacaaggagaacccatttctcttaatcattacactcattaagaaaacacgaagctcacaacagaaaataatttctaactattattattctgtggtttctgcttttgatcaagataagaatagccgaagcacccacccaggtcactctcatggaatggggttttctgattaaagattggcaagcaactgacaagcttgtagcacatcctttaagctggcactcgctgtttgagtacttgagagttatttgcagacttcctaagtctttcgttttgctaactgtgtgtcaggaactgttctgggcactctatgcaatgtgagcttatttaatggttaccacctaggaggctgatgtgctcttgacacccatttcacagatgcagaatctaaggaaatctgctcagtgtttacacagccaactggtcagtggtacagcctggatttcatctctgggtgtttattcctggagtccctgctttaaccaccatattaacctgcttctgaacaccaaccaaagcttgaatccagccttccaaatctcaagcctgggcttttgttaaggaggacgctcagggtttcttgatagccgaactcctgtatgtccaggaaagaataaagaccagatggtcttgatatgaaaaggcagcagattttaactacaaaatgggaaatgagtaattcgtttacgaggacaaagtagtgaaaactgttcttaggcttagggtaggtgattatatcttaactctttgaatgttcagtcaaagctatatattcaagatattgtgggttccctaccagaccaccacgaaaaagtgaagtttgcaataaagcaagtcacacagattttttggtttcccagtgcatatatgttatgtttacactataaagtattttattaagtgtgaaaagtatgtcttaaaaaaacagtgtatataccttaatagaaatactttattgttaaacaatgctaacaattatctgaggcttcagcaaatctaaatctttctgctgatagagagtcttgcgtcaatgttgatggctgctgactgatcaggatggtggttgctgagggctgaggtggctatgacagttttttaaaataaggcaacagtgaaatttgccacatcatttgatgcttcctttcactcaagatttctctgtagcctgtgatgctgtttggtagcattttacacacactaaaacttcttttcacatgggagtcaatcttctcaaactcggccaactgctttggcaactaactttatgtaatattctaaatcctttgtcatttcaacaatgttatcagaatcttcaccaggagtagattcatctcaagaaaccactttctttgctcacaagcatgagtgggaactccttatccatccaagttgtatcatgagattgcagcaattcagtcacatcttcagagtccacttctaattctagttctctgctatttccactacatctgaatttacttcttcctctgaagtcttgaaccggtcaaagtcaaccatgaagatcagaatccacttcttccaaactccagttaatgttgatattttgacctcctcccatgaatcatgactcttctaaatggcttttagaatgctgaattttttccagaaagttttcaatttactttggtcagatccattagagaaatcactatctctggcagctatagccttataaaatatatttcttaaataataagacttgaaagtcaaaattgctcgtgattaatggactgtggaatggatgttgtgttagcaggcatgaaaacaacattcacctccttgtacatctccatcagagctctgggttgaccaggtgcattgtcaatgagcagtaatatttttgaaaggcatcttgtttctgagtatcaggtcttaacagtgggcttaaaacattcagtaaaccatgctccaaacagatgtgctgtcatccaggctctcttcttgcatttatagagcatatgcagagtagatttagcataattcttaagggcgctaggatgttcagaataacaaataagcattggcttcaacttaaagtcgccagctgccttagcccccggctatagagtcagcctgtcctttgaagttttgaagccaggaattgacttcttctccctaaatatgaaagtcctagatgacatattccaatataaggtggtttcatttacattgaaagtctgctttttagtgtagccaccctcatcaatggtctatcctaggtcttctggagaacttgctgcagcttctccatcagcactttctgttcaccttgcacttttatgttatggagatggcttctttccttaagaatcaacctctggtagcttcaaacttttcccctgcagcttcctcacctctctcagccttcccagaattgaacagagtttagggccttgctctcagttaggctttggcttgagggaatgttgtggctggttggatcttctattcacaccactgaaactttctccgtaaaaaagtttcaccactaaactttgcccactgcaagctgagaagatccttcggagacctctttggaaacacatagcaaagaaaatgacagaagccgccatctcttgtatctttaccatgctttcaacagtagctaccaattattgaacagctggtaggacccagcctctctatagacactgaggcttctaatctccttcttctcaagacctcaataaggaaaatgagttcagagctgttattaacttgaggaaggttgcacagcctataagtgacaggacatgaatcaatatgacctgtcacttatagatcacttatgaccttgaggctcctgctctttctagttcttcatttctttgtgtgtttcctgtagctcttctccaagggcacaccccacatagagagacccaccaggcctggcttgagtgaaactaaatgcgtagtgagtagaagttgccaagcaccagtgagaatgggaaaatgtggacaacgtcaccacctgccaggtagcaagcacctaggctcctacaaatgggcaaaaaaaaaaaaaaaaaaaaaaatcggtctcagttttcagcctatggcaaatgagccttcagcaaatgacatgagcatgctaaatgattgcagtgtccatagcaggtcttgaaaatgaacccggataaattttaagcatcactggtgtatgctgagcgtgaaataccttgaaagcagcattctcttttgtaaggatcctattttctcttaagcatttctgccttgaaccgtatggtttgctcaaggcctctgactacttcctttttttctgggctgactaggattcatttacactgtttttgtaaggatgcgttgctggatgctgtggggaataaagattctgcacagatggaccctcactgtattgttgtagaccaggggccattgcctgcagggacctctgtcctgggtggtgtttggtgatcagaggcttgccagggatggcagggacgccagggacagcaaggacggcagggacgccagggacggcagggatgcgagggacggcagggacgagagggatggcagggatggcagggaggcgaggtctctggttgtcgtgattgggcgtctgggtgtgtgtttgtttatgcttgtttattaatgccccacctacttccagagagatctggttctctgggaagtgaaggttagagattcttattcccgggttgttttgatttattttttaatcatgaaactgagtcacaccaatggtacagatatgaacagaaaaattatgagtcccatgcctgcagtttctgaaacatgccctctttccttcttgtgttttttcttttttattgtgattttatatatataaataaatattatatatatgtaaccacaatagaaaagaaaaaatacatacattacaaagtttgccatttaaccgtttataagtgtatcattcaatggcataattacatccacagtgttgctcagttatcactactgttgatttccagaatgtttgttcaccccaagcagaaactctcaactccctgttcccatcccccatgtatatggaactaggaaaagactccagtggcagctgatgacacacattcctacaccccggcaagcagagcatccaggacaacctgtcctgtgcccgaggggtggggcacggtcaccctgacctcccctgcttcccctgcccatccatggctgtccttcactcacccaattagtgatcataggacaacaggaggagcctgggagaggaaggaggaggcctgagggatggacactggggtgctgaggcggaggtctctggggtgagcagacactggggtgctagggcagggtctctggggtgctgtggtggggatccctggggtgaacggacactggggtgctggggcagaggtctctggggtgagcagacactggggtgctggggcgagcagacactggggtgctggggcggggactctggggcgacccaagacccttctttatttgccgggatggagtcttacagtcaggctttgccctctctcgcggcctcccccagcagtagagacttctcacttcctgatgttcgctgctggacatttctgatgtgtttgtcttggagatggttttttcattacccaagctgctgctaaatccgtcaacatttattttgtgaagttgaaataggtggacgaggcaggattgggaggaggtagaggcgaataagaaggaccaagtagtggagagtagagggagagtgggtggccttatgatattgaaaacacaatcctgaaattagactgttagtgatgacaggcttggtgctctggaggtgaagctgagggtacctgcctaccttgatttccagactggtttatcccaacacttgctaactccacgttagggctcttagtggctaattgtctctaagcttgatttccagactggtttatcctaacacttgctaactccgcgttggggctcctagtggctaatcggctccaagctttggagggagcattttaaggtcttttcaatcaacacattttattttctgatgacctagaaacaggtgtgaactctccgactccccaccaaaagaaagtagatgaagaactcttcaaaatttgtagagaggacatatcagaattgaatcacaacttttcaggccttggcaaaattttctttaaagaaccaacacaggcacacctactcagcactgctagtgtagtggggaaatggctggctaatccctactaaaagagttttgctgtgttctaataaaactttatttaaaccacctcacaccgattaggatggctacatcagaaaaaaaaaaaaacagggaaataacaagtgttgatgagggtgtggagaaattggaacccttgtgtactgttgctgggaatgtaaaatggcacagccactatggaaaatagtaggatggttcctctaaaactttaaaatagaattaccagatgatctggcaattccacttctgggtatcatcaactgaagaatcataaggtacataaatttggaaagcagagctttatttctcataaagggttgcagcctgcaggccagccattccgcagaccaggaagcgtagcctccagcttctgccaagagcaagcacttccagggaggaggaatgagacaggaatttatgctgagtgggttggctaagtatacataatcaataagctatagaagaagtcatgaatattaatgaaggagaaacacacacatgtgtgattgagccatgcctcttcgtgggtcccgtgttcaaaaaaataccagcattaggatgacccaagggtggaggttttggccctctgatgtcaaaagttcaaacagaggccacgaaaaccctcactgcacatcctccttcgactggccagagccaccctgcagttggtagcctctcagcaggagggcatgcagtgtcaaactggcaagctgtcacgtggaaactgcaaagagggagggggagtccacttatggctcagacaagtggctaaaggtgatataggaatgagttgtctgcttcttgttttctagagccagtttctgcttcctccttaggagagaattctggttaaaggctattaaggaaagggtatactgaagcgggtccaacctcccatctcttcatggtcatgggctgactcagtttttgttgttgttgttgtttttgtttttttttgttgttgtttttagacagagtcttgctcttgttacccaggctggagtgcagcggcgcgatccagctctctgcaacttctgcctcccaggttcaagcgattctcctgcttcagcctcccgagtagttgggattacagacgcctgccaccatgcccgggtaatttttgtatttttagtagagatggggtttcaccatgttggccagattggtcttgaactcctggcctctggtgatccacccaccttggcctcccaaagtgctgggattacaggcgtgagccacggcgcccggcccggattcagtttttaagtcttctctggggtccctttggccaagaaggagtctgttcagtccattgggaaacttaggattttatttttatttctcaatatttatccaaaataattgaacataaggacttgaagagagatctgtacactgatgttcatagcaacatttttcacagttgcgaaaaggtagaagtactcaagtgtccatcaacagataaatgggtggtatacacgatgtggcatatgcatcccaaagcctccatttcctcatttgtaaaatattgtgtgattcataccccgcaagacttgtgagcatgaaataacatgatctgtgtgaaagcaatgacagtgtctggaacttagggggtgctcaccaaatgcctagcagcaaagcagcagaaactagaggtggtcgtgtgggagaggatggaggaaccggtggctgggaactgcctactttcaggatttcttacctttggcccacgacaattccttggccaggaatgctgttttggtggaaactgggatggtatgcatccagcacgtcactctgtttattaggcatcagactggtagacaagggcccagtaatctcggctcatggagacccaagtggggatgacacggcctcaggctagagcagacgcaccctgggaatcctctgtattcttgttggcatcacagcccaagcctgtgtccagcagggctgaccagaagaaaggtctggggcattttaggttttagttaagagtttgatggaggcttaagcttttattgatttgaaaaagaaaagaaagggaatcttggaaaaaagtaactcgctgtagtgcagacaggaaataatagcaatgaaatcttttggcttccctgctcctgaccccagaggtcccttcctcgctttaaaatcctcaggcaccccctccacccctgttgcccacaagcaaatatgcagactccagagccccacatccccgtctctcacggtctggcccagttgatctctctcacctcattccgaaaactttctagtgacattggtcttcccaccgtttcccaaatcccaaagacacgaggcagatcccacccagtcccccagctttgcattactttgcccttgtgatactgggggacgttcttagaagtcacttctttccacatatatggtttttgtttcccagtcaaggtcccaaggtaggaagtttctggccatgtgagtcaccacctggatgaaggagccaccctgccaagtgtggggaggtgccaggagacggagcggctgagatgaagcattcattatctctccttcccatggaactgaagtgacattctctgcatctctattatcacttcacctcaacttgcctcttcccagcatccctgaattatgcagaaatcatttgaaggcaaattcccagctactgttgctagactcatttttctgcagggatggaggaatgtgttgctagactcatttttctgcagggatggaggaatgtgtcacttttaatttgtttccttttttcccacccattttgggtaaaacattgtgttaaaagatacatcgtctccacccccaaagcagcctgtcttcatgcccaagggatttaaatgccctcatattgaagtgtacaagctaattatgtaacttaaagtaagtttagggaaggaatttaaatacccccacagcttcacaatgtgagaaatggggctgtgcaagcccctggaagttccctgcctttctccacattctccctctgtagtaatgaggctcctcatctttctgttttattggcagcaaacactgggtaacaggggtgctagaagggcctgagggtctgtcataagcaagggcctataattgtgccaggagcctggaatagttaaattggttcctgattacttttcactcgctaagttcccctcagctcaattaacatataattatttaggactatgctacttttgttactggcacatggctttccaaataggcagctttgggggatgatctccctctggagcccacgcactgcatccatccacccgccctttttgttcaagaacaaaagcaaggctggcgggacctcctccagaaccttcatgctgcagagaggcttggaccttggcaggtgcctcctgcaggcagagcctcgccggccacaccagcctgtctcccaaagacgcgcagaactgcagaattcacagggcttgtctttctcttttaccaaatgcgactttacattttgtaaggtgtcagtggagatcatatcagtgttcagataactttgtatcatgtggtgatgcctcttccttacctttaatctcaaaaataaaaaaacaaaacctgtaggttcaaagttccagggagcttagaggcactggggttgagtgctttcatttgtcagtggagaagatgagggtctcgaaaacttgagcaacattttttttgttttaacatttttaaaattctattgtaaattgacaaataataattgtgtatgtgtatggtatgcagtcgatgttgtgatacatgcattcattgtggaatgattaaatcaaatgaattaacatgtctgttccctcacatacttctcatttcttggtggtgttgaacaacgttccgaaggtcaggtagctccacgtttaaatggacatgaagccattgatagatagatagacatacttgaattaagactttaattgtacaaatgtgtgtatgtgtaggctacaattaaactcatatttgacactgtcaagaattagtagtttttgttgctaatggggttaaatgtccaggataggaaagcttactggtttgttgttgctttaattgcattggcttgggagtgaacccatctccctttcttattgacctcacatttttttaagtggataatgttatgacaagtttgataaaaatgatgcttctgactttctggagacaggaatcaattaccaagaagagataacatttctctccattgagccattaaaaataaaattcacaggcttctagaccttacggctttttgaatctttttaggttgacataatttgcctgtgattctttctggattatttatttgtatgtttggttttatctcctgaattttagattacaaataatccttccttagattttgaccatttttaggacagcattcctgaaagcatttaattctcacagcatttgttattgttttttagaaattaattaattaattctcctggctcagaataagacataatttgtgtggttcacaaggtggttgatcccttccccctgagtttctggcatttctggtggaatccctaatgagaagtttgcataagaagaacctgaagagagctgaatcccaccgcagaaaacctacacggttttctgcaaggactcagggagagccaggggcaaccaaatactctagcctccctgaggcctctcatttgggccagagcctgaccttctgagccagctctttcatccattcattcattcacttactcttccatccacttattcattcattcctgtgtcagttacctagtgagcatatactgtgtaccaaatgctgacttggcactgaggacacttaggtgaacaagcaggtgttgccactgccttcgagatacctatgctttactcacaatctggagggcttctcttacctaaacccaactccagcagtgtccagcacagatagagttgtcaggatgcagagtcaggcgcattcataccccacacgccctcgaattgcctgctgggcaaaggactatgatcctgcactgtgtggagcccctcatttcatttggcaaggcatcctcccatccaaacacttggcttagcttgcaatccttctcatattcctctgtaacagaaagcggattggtatgcaaaagcttctaatatgattttcttattttccctactttcacatttattagaaataacttatgaattacagtaactaatagattttttttttttttgagatggagtcttgctctgtcacccaggctggagtgcagtggtgcagtctcggctcactgcaacctctgcctcccgggttccagtgattctcctgcctcagcctcctgagtagctgggattacaggtgcacaccaccaggcccagctaatttttttttttttttcttgagatggagtctcactctgtcgcctaggctggagtgcagtggtgcaatctcggctcattgcaagctccacctcccaggttcatgccattctcctgcctcagcctcccgagtagctgggactacgggcacctaccaccatgcccggctaatttttttgtattttttagtagagacggggtttcaccatgttagccaggatggtttcgatctcctgaccttgtgatccgcctgccttggcctcccaaagtgctgggattacaggtgtgagccaccatgcccagcctgtaattttttttttttagtacagacggggtttcaccatgttggccaggctggtcttgaactcctgacctcaggtgatctgcccgcctcagcctcccacaccacactcggccgactaatagattttcttacctaaaagttagtctctggttatgtttctccttgcctcattgggtgattggcccggggcatagctgtgtttccgtcccgtcaggtgtgggctgtaggatatcatttatgcatgtcctggaagtttctgtgcaagtgacgcagcccttgatgcattgagcccaagcatcatctgatctttgtttactgcactgattatggttttatttgatctttccttcagctttcctcatgctacttgaatttccacgttgtttttgtcccggcatttaaaaaaatttatagggaatctgaattacagaatctacctctcagccctgcactttctcagtcgtcagtttcttaaaaggtttttgttcagccttcacattattttagcatgacatacatagttttttttttttttttttaatttgagacaagtctcactctgtcacccaggctggagtgcagtggcgcaatcctggctcactgcaagctccgcctcccaggttcgcaccattctcctgcctcagcctcccaagtagctgggactgcaggtgcccgccaccacacccagctaattttttgtatttttagtagaaacggggtttcactgtgttagccaggatggtctcaatctcctgacctcgtgattcacccaccttggcctcccaaagtgctgggattacaggcgtgagccaccgcgcccagctgacatatttctttaagtcattttgagaactgtctttatttaactagctgcagttgtcccagagcttaattcgaagcagcatattgcaactgtttgggtgctatcttgaggcacaataattaccctataataataatgtgtgttttagtaaactggtcattattgtcatagagggctggaaagagtgtcttcttaaagctcataaggaccctagggtactctgcaaatagcagagttctaaacctgaaggaaaaaattaaggggaaaaaaaattgtgttagtggtcagaagccccgtgtccttatgcatcacggcacagcccaccctgtaatgacaagaaggtgttgtattccactgacacttgggggcttttctgtgatctctggggttgctgcatgtacatcctcagaggctctctcaacacagttaccaagggtcaggtgggttacttagaccatctctctagctcatactttgtacttctgggggctgaaggtgacaggacagaccccatcccaagactggggggctgattagagttgccaggcatcccgtatatgcaaagcatgtcctgaattttgcaacttttgtcctggatcctttattaatttgtcaggatgctctaaatgtcctgtattccgctttttttttctaatcaattacagaattcagcaataagagctttattcaaatttaactgggcatcctatatttgcaaaatctggcaaccctgcggctgaggaatgttgctgcccagcctgtgttcttggttaatggacaaggcagcaatgcctgcgtccctccattaatagtcacttagaaacactaattcctcctttctggttatattttaatgtccccggggaagaagtcaaataactccacctgcagttttctttagtgaccaaaattgcaaactctgtcacaggccctttgtcacagctgttttggtcccagagctagccgataggtttcttgatgaaataatgtctgcgaatccctttctcagagcggcacgcagtgtgagcgtgagagaatctgcagtgacagcgggtgatgggcgggaggtggtggtggcaggtggcgatggagacctccttaaaaccccaggtggtgaatttcttcttccctcctccctggctcactgccttttagcggctgtgacatggccagggcgtggggagcttctccaggcacgcttggctgaagagataatgctgtcagaggacagcagttactagtaagtaacctacatttcccttctactctggctgctccttgctgtctaaatagagaaagtggaattaggtttatcatctgtgacctaatactaattcctcttacatcctgcctttgtgcaaagggaaaagggccatttaaaaagtagtggacgaagctttagtattgtaagcactttcaagcgttataaaacaaatctgttgaatgaacaagcatgtgagagttggtattctagagtcacgtgtgatcgcccaaattgtatatttcattacaaaaagtatataaagtcatggtattatagagtgttaaaattatactttatcaatgaatcaagaaattaaaatttctgagaaaattcttgtcaaatcactttcatgtctactaaagcttttaacttcttctctagtaaaatagtggtcaaaattagcatgtggaaagtaggccaatgatactgaagtcgtaagccatgcttccaagcctggagatattgcagcaacctcttccaagcctgacagctccttgcgaagagtgctttcaactgggtagcttgaaaaagccagctaagcaaagatcagtggaatcatagaacattaagacatggcaacttgagaaaacgatttaatttgcacctttttttttcttttttttaattagattttgttttaagtcatacttttcaaatgttactttcagaagctgttattttggtctgtttctttcatcctgcatgtgctaatttccttgattaatttggagaacatctgcatataattccgtgatcttttcgttggcaaaacctcacagctttgcgcaagacttggagagttcacattccagacagtctgggattgtatctaattgaaatgccaaacctaccgaagtgccagagcgtaagtgtgtaattatgtaattttctcttgatctttcagagtcttcctgcgagcaattaatcagtatgcagatatgctgaacaaaaaatttctggatcaagccaactttgagctacaggtaagagaagaggtagacacgacctttgtggagaaatcatgttaaaacaaattgctggtccgagccagtatcttacagtatttctaatccttgaacttaattggtctcccatccaagatgcggaaacggaatttgtagtatgtactattggaacctgaggagtgaaaattatacttttggagtattcgcttaatttagcaaggaaagagatagagttgtttcagagagaagctattgaatcagagtgacaagaagggactcttcaagcagggaggccaccaagtcccggtgtgtgtatctgccaagattgtctcagcccatcttactgtggagggaggatcagcagaggaggagacccaggtctgcacctcgagctcagcttgcttttataactctgtgttccctccatatcctctctcggccttgtgctactagcagtggcttttaccaggccagagaccctgccccccagaccccatggtcctcagaaatgctcctttggtgaatgcagtgtgtgagagagagagagagtgtgtgtgtttgtgtgtgtgtgtgtgtgtgtgtgcgcgcgcgcatgcatgctgtaaggattgattttgcctggcctgatttgtgtgtgtgtgtgtgtgtgtgtgtgtgtgtgtgtgtgtgtgtgcatgcatgctgtaaggattgattttgcctggcctgatttcttactgtgcatccaaaatgtgtggctctcacttccattgtactctggatgtgtttctgctaataatgattttatctgtcattattattacttagtttattttagtaaagtatacaaatttttgaaaagcatgcagatacaaatggcatgtttatttcctgggcaagatgattcactctctcaaaaggaacccgaaggatttttgttcacccattgggtgatccaaccccaaaataagttacccaatagcaaataataagtttacccaatgctctttcatttgcattgcccttatttttataattttttaattttaagtgtttgttgtattggcattacaggatataattagataataatatatcaggtgccatatatctaaacatgttacttgtttataaaattttttatcattttctctgctgaatgcctgttttcatatgtcataataacatactttctctttatacaatatatatgtgctgaatatcagtttagcaggtaaaataggaaacattccttcctaaccctttgctgcctctcactgcccctctgcagggataacttttaactcattgttctgaattctttgtcacgctttcagcatttatatgggcctgtgtgtgttttttttcagcctttaacatgaactggatcataccctgtgtttttcagctctgtcatattccacgatatgaatgtaccaacatttattcagccatttctgcactgataacctagaggctgtttccaggtgtttacaatcacaggctgtgctaccgtgagggctgtgatacatgtgtctcttagtacacgcattgctatggaaaaggttgatctctaggccaaatgatatgacattttaagtttgatggaaaatgatcaatttccttcctaacatgattttagcaatttgccaccccaccaaccttgagagcagccactttctatctagaatcttcttcaacactgatttaaaatgattgatttttgtttttattgtcatttttctgatgattatttaggctaagaatacttagtggccatgtgggtttctgctgtgaattctctgatcatttcttctcctaacattcgtatttggctgtcttttttataagttggaattcttgatataggctaggcatgggtttaggcttatcatatagaaatatttcatttttctgtagtgaaatctgttatttcttttacagctatctggtttcatgttttacttggcaaatctctccttgccttaatattatatacttctaaattttactgttttgtgttagttaggatctgctaatacctgtgtggttttgtgtttttgtttttatctttcaggtgtttaatccatttgggatttctgtagttagtataggggtaaggatctaacttcactttttcccacgtcatttcatgaatagatgactctttccccaatgattggaaatgctacaattaacataattataaatgtatgtgtgtataaattccattttctgtgttattatcctagaggcttaatccttatacctttgtacccagctagcagagtcgctacttttccactcgttttctactgcagaattatcttggctgtttttgtgcatttcctgttccatttggagtttaaaatcagatagctgagtttctcttttaaaaacatactgcttggattttagctggaatcccattgaattgataaataaatttggagtaagtttatggtatttgagggaatactttgcagtatttttttccccatctcatactagactatttaagtatttgttttgccatttttctggtttttttctaggtcaggtctcacacatgacttgctgggtagattcccgtgtgttttagttgtggctgctctggtgggggagcctgtttctcaacatgttggttctccctggctttcgtcctgtttcatgaggatggccccttggactctcaccgtgagcccgcacaccttacaagccacgtgcttcagggcccacatcgagcgtcgccccttggcaggtgtgacacacatatttattgttgtttgaggagggtttagcaggaatcgctgcctgctgtcggctgcattctgagagtcacagtcaggggcccatctagcatacgacccatgtctgcatgtacccagcacagatcttaatttaaacaccaccgtcaccaccatgagtgctctggctcaaaggcagccctggtcctatgtaggaaaagaaagaattaggagttggtgaagctgtcatttaaaaagaagcattcgtgttttgttgttgttgctgctgctgttgctgttgctgttgttgttgctgctgctgctgctgctgttgttgttaaagggagcaggtagaaatgaagatctattgtgagtcctcgcaggcatgggtcctattctggctgagcccctgaccatgattctcagaatacaggtggctgcagccagtgattcctgccggtgctgtggcaaggctgaaatcggtgggaggtgtcagtcccaaaaacaaaaggaacgacttgtattttattgactggcactcccctttctttataaagggggctaaaaaaaagagagccccattgtgggctctgaggttgggggtgcctggctcagacccccattctgcttcatgtgttacctgtagctttgggctggtctctaaatctcagctctgcaatggggataacagcacctacttggttattctgtggtaatcaaatgagctggtgtattactatagaaagtgtgctgttcatgggaagtgttggataaatgcaagcccaacagacttttctcaaatcctacaaatgctcttaaatttccccttacttctcaggtaattaaaaatagagtcaatataatgttcacactttatttttatagaactctttgcagctatctcctttgatataatacatattatccctggtttgtaaatgagaaaactgagacctacaactttcttcttctaaaggccgttgtcttttaaaccgcatatatgtagtccataaacccttgaaatatgggtttattgaaagaagaaatgtttgatctctttacatttgttttccttgtctagtgtatgtgtgatttgggggtaaagagtcctaaattatggaaatctatactattcttaagtgaggagcttcataattacattaataaaagttaacattggccaggcatggtggctcacacttgtaatcccagcactttgggaggctgagggaggtggatcacttgaggtcaggagttcaagaccagcctggccaacatggtgaaaccccatctctactaaaaatacaaaaattatccaggcatggtggtgcacacctgtagtcccagctactcaggaggctgaggcaggagaattgcttgaacccagaaggcagaggttgcagtgagccaagatcatgccactgcattccagcctgggcaacagagggagactccatctcaataaaaaagagctaacattgatgaagtgcttacacatgctctgtaccgccttaaattctgtgcatatatttacttctttgatcttctgagcactcctataagatagatactcttgaaattcacattttatccatgaggaaactgaggcagagagaggttagagtctgagtaaatggcagacccgggatttgaatatgtgcaccgtgacctctgagcccacacgctaaggcctgaattacaccgtgggtggctggttagcaacatgtatagagtgagtgtgggttttttttttaacttttcagaagtgtgtgctgagcaaatgataaatgtctgagagcattgttgagatcctatatcaagctgttcaacaacttagcatctcctcctttttggttttcagctgtggaacaactactttcacctggctgttgctttccttactcaagagtccctgcaactggagaatttttcaagtgccaagagagccaaaatccttaacaagtaagttctcatctagctctgaaactgcaggcaggagcctccaactctaatcgcataattttcatgtcatttctaagccaacttgatacaaattgagatgtaatcacggtgtaatgaaagggtggttttaaatcaccaatcaggtattgccttttctaacccatgaatcaagatctaaaattgcaggactcatcctggaaggttccaggtcagtgtaatccaagactattagtgcaacacagaatttcagcttccggagataattccttttgctatgcactattctgatgtcatttcacatgtggttgactttattgcttaattcttcaattcgaaaggagcttctgatgaaagctcttggctctattgggattgttgaacagctcactggggagttagagctatcggggttccttcttggcagcagataacccctgtcttcttccgggcaggagctttgaatggactgaagcggcaccttctatcattgtaaataaacctctccaaagctccatgaaagccgagatccttgccggcccctccagctctgtaaccccagtttgcatcatgcaccgctcatgactcagtatcaagaagcaccattgttgcatgggtttccttcccctgtttggacacccggagggtcttgcttcgtctctttctgcctccgtttcactaatttctcactgctgtcggtgttcctttcataagtccttttgagaagagttctgaaattgcattggtgttgccacgtcatcagtctctgtttgtcattttataaatacctctgcaatatctcgactgttctaaggcttggccaactccatgctgctagctgaggttagagattccagaaagagtttcagaaggtggcagctgctcttatatcctgtgagtctgtatctcactttcaaggcaaatccaaagcacatcatctctggagagtaagaattatagtcataagctgggctctggtgctcagccagtagtggtaataccagctacttaggaggctgaggcaggaagatcacttgagcccaggaggtcaaggctgcagtgcaccacgatcatacctgtgaattgccatgcactccagcctgggcaacatggcaagaccccctttcaaaaaaaaagagaagaaagaaagaattatagtcacgtactgcataaccacagactacatgctgtatttttactgtaacttttctttgtttagatacacaaatactcaccattgtgttacatttgcctgtggtatttattgtagtcacatggtacattacaaacatgttgtacgggtttgtagactagtaacagtaggctataccgtatggccgatgtgtgtagtaggctgtagtatctcagtttgtgtaagttcactcagcagcgttcacacgacgacaaaatcacccagtgacatatttctcagaacatatccctgtcattaagcaaagcatgagtatatttcagcaaatcatttactcagcctgtactttatgtcagtgactttctaagcatttcatgtgcatttttcttctataatcattaaaaagcaaaaccattccttaggccctcgtatctgccctagtttctagatgaggaaggtcacacacagtgaccgagccacttggccagtcccacacctagaatgtggcaaagcagcattctaatctaggcgattcagggcccacgattttcacctgggctgcttttagaaccttcgagcttttggtctgcacctatctaagtaaagatcacctttcacctggccatctttccttcaggcctcctcagctgggtgattcctgcctgacagccatctgtgtaaacagtgatcattgttcagaaacaagaaatgcacttgctgagccaagcactgagaatggtgtaggcagagtgggtgctcgcctgtgactaccgaagcggcacgcagcagctgcagcccaccaccttggggcctgcacaggtgtctgtcgctcgtcctggcttccagcatcaagagacagacttctccaggctgcatcttctggagactggctcagcaggggcgcgggctcctgctttgtggaatgcacgctccctcagggcccaggggaagggagggatggtgctttgtaattgttgctgttcttgttgatttgcctttgtgctgggaattgtagtgcagacggtagtgaccaacacacacaaagcacagtgcggcacaacgcacttcaacgcactgtaatccaccaggtgcggacacacctccttcagcacacgccccttgttgtcccgtccagcaaaaggacagctcggccacagcaggtgaagccacctgcccaagtgtccagcgcccgctattgggtgaagctgggacccgagcccagccacagctcctggcctcggagatgcctgcgggagaagagaggtgaatttaaactggaaatctgcctcaaaagagctggcatcttcttagtggtggggccgagcaccccgcaagccccagcagggcagctgtgtgctgggcccttccttctgttggtgtgagcgttaagagcctaaggcaacatcaagacatgcactaacagcggtgcggtggctcatacctgtaatcccagcactttggaaggccaagatgggaggatcacttgagtccaggagtttgagaccagcctggacaacacaacaacacccccttctccacaaaaaatacaaaaattagccaggtgtggtggcgcgcacctgtggtgccagctactcaggaggctgaagtgggaggatttcttgagcccagggggtcggggctgcagtgagccatgatcacacgactgcgctccagcctggctgacagagtgagaccgtctgtctcaaaaaccaaaacgaaaagaaaaaaaaacattaacctcgaagggccttggctactaaagaaaacgtttgcttcccacgtagtggcgtggattcagaatcttcaaagccacggaaaattacacacagccagctggtgtcgccccctcaggagccacccagggcctctgcctagggctttcgtattctctttgtcacaacgatagcaacaggagactctggatttcccccaggaaagtccccaggcagttcagaagttgtctttgcaagacactggcaggacagcctcagggctttgtgctgtctgaggggcctctccaggggcatgagttctgctccgcttgtggaggtgacaggagatccaggacaaagcccccggagcctgagataaggctgccttgaccttcaggccacgcggcacacacgtgtggagggtcagccctatttgttgtagtcttcatgccacttgataagccttcagcccttcatagtccatttgcaaattttatttctaaatagcaaaacctgcataagaaatacatgacgatgtcctaccccaatgcttaaattttctcaggcacatacagtgcctagaaatgtgatttgtttaaaattgtccgcataaaagggattcagtgcccactctgtgctcagtcgggccatggtcccggtgccggggacaaagacacagacctcgtgacgaagaaggtcatggtctagtggggtaaatggagaagcaaaaatcatgagtggagtggggcacgcatgcagtggtgacggagggccttggcagcccggagacggcccgtggggctcagccgtgggagacagaggcctcctggcagcttgggcttcccggctgggtggtgaaggcagctgagaggtttgccacgggacatcgagtgccaaagggcatggcgccatctacatatgagcagagacatgatctgggttgtcgaagtgtaagggagcagcttggagcttggggcggggtgtgggggctcgtggtctgggagtcaacctcacactctgggcaaacgatgggcgctgacttggagccccgtggagcttgatgcatgcacctgtctgtttctcgggggaaaggcatgtggtataaaggtggagccatgacacacccacttagtaggctcagcactgcctccatctggggcctgtctcttactctagggcttgtgaatccaacctaaggcatctgagggagcatccccaacccctcagccttcccttcccttcccttcccttcccttcccttcccttcccttcccttcccatcccttcccttcccccttgctaagcccttgcagctcctcacatctgcttggtccacagctttgtggctcaaaacaatagaaattccagcatcaggaaacctgcctgctccatcctcctaatgactgaggttggggagataattaggattttcattctaaagacattccccaaagtgcatgggagtaaataaaagaatgggccataccacgcagagaactgattatgtcagacccaaattgagtatgagattcgccagtgtaccacaaaataaataacccctaggaatcaagtccataatatgaaaatttaactggctcaaccttcagacatccttggtgctagtgactcccaaggaaggacagagatgtcaacagaattctaagcctgaccagcagctcttcctcccatcccagccccctagccttttttacattattggggtgcaggaaatatgtctaaaatgtaaaaggaatgacttttgattagcagccagcttgataattttgttatgtaagacacgtgcatcctggtgtgggacagtgtgttgaatgactgcaaaggagcttctgtgttcaggaccggaagaggaacagggttcatgaattgggcctcccacatatctaagcataaaatgctcacttaaaatttcagcgcaagaggttaagtttgatggcaaagtccagctcagtgcagagagaccatccacaaagacctccccacctggtccctaggctgttttcagttttggcgggggtgggtgggttgtttttgtttttgtttttttgtaattatagaagtctgcagtgttctaagaggataggtttcacaatgggaccaaaatatccccatctgaccaaacactgggttctgcagaatcttctccagaagattatgtcaaactctagatactacctttaaggaaactaacaggaaataaacatgccatgcatgccgttttgcagcgtgacctaatcagaagctgcaattgtatattcctgattataacaggagatacgatcaatttaatttgtgtctgtgctcatttttttcaagagactgaaattattcaaaattaaattcacttattagaaggagactcagggagttagacttaacaagtggtgacctgtgccaacttcaagtcagaaaagctcactgtgtcccacatgcaccggtggtgttgtttttgatgtcccaccccctctcacctctttaggaacccaccagtctttcccatgaagttaaaaatgcctcaccccagccatgagctccctccagcttcctttaggtccatctcagccctttccttgtctcctttccccacctcccacccactccgatgctggctctgggcactgcattgccccagaacctcagccaggtcctggctgcccccaagcagatggagggtattcagctccctagatgttctccccacatcctcaacatgtttcttctttccctccatctcagaacatgcttttcttcgctctcaggactctcctgagcttttctccaagctttttggtgtctgctctctcttgtcagattcctacccctgcaccccagcatcaagtggcggtgggggttccgcacaccttggtcttaggccttcacactctattctctttccttaggaaagcatttttcaaactgcaggtctcaacctttgattgggtcagaatattcacttaaagggccatcatatccatttcctaggctggtctgccataacagtgaacacaaaccgggtggcttgaattgattgtctcacagttatggagggcagaattcccaaatcaaggtgtgggcagtgttggttccttctggaggttctgagggagaagctattccctgcctctctcctggcttccggtggctgccccggtctttggcattccgtggcttgtggctgttttactccaatccctgccccatcttcctgtggccttcttctttgtgtcttcctatgtgtctgtgtctctcaatctccctctccttataaggacagaggtcactggatctagaggccactctactccagtatgacttcatcttaccttgagtacatctgcaaagactctatttccaaataaggtcacagtcatggataccagggtttaggacttcaacatagctttaaaggggagacaatccaacccacactagtcatgaccaatagacttttcttttcttttttcagtgaaatagaatctaggaaaaaatatcagcattcattgcaggcagtaaggttaagcatcatttcataaaactttatacacatgcatgtatattaatatatgtgctggttaatacatgtattttttatgtcagaaaagtttatgaaacttaaaaaaaaagtggcggcagcggggacgctttaaaaaaaacctgcctcctgcagcctctgctcacggtgcaccccctcaccccctggtctctcaaacaggagccagctctgtgttctgtagccccacccaccaggcactcccctactccctccctgccatggggccttggcgcctgctggtcctcctgcccagaatgctcttccctaccctcttcgtccagatttcgtctctccttcaaatctcagagcaaatattattgtcctagagaactcctgccagagccaagctgagcccactgttacattttctcacagttcccatgttttccctataaagccatgatcctggcttttgcagaaacaattcctctatgtatctatccgtgtttatcttgtgtgattattttattaatgttcgtctctcctaccatgctcatagcccactgtggtttgtgagtcttgtctgttctccatatcatagtaatattaatattccaatatgaatattcatatttccacattagctttgtgtctggcccaagtgctcaataaatgttcactaaatgaatcgatctaaatgaccattgcaaccatgagaggaatattgtgcccagcctgagattttaaaggaaggacctagagtggctccagtgcttgccagatagacagggacatcatcactctcttgttgttcacaaaagcctaggattgagcaccatgcaccattctggcagcactacagatgaggagactgagggtcagagtggtcaagtaaattgcccggtgtgcttagattcaggctcaggctggccttacccccaagcctgagctatcactcgggggtatgtttcttggagtgaaggtgcaagaaaccaggtgctaagattaggccacagggaccaaattcacacgattttatgtccgggttacagcctggatgtgggatcccagatctccctggacgataggaagtgtgcctcctaagcgtaggttctcctgctcactcacaccgtgggtgggctcaggtaagaagctctgggcagagcacggtgaccccagctctaggccatcctggctcggtggagtcgggcatgtgtgttccccactgtgaatctcagctcttattgagaaaatgggcacagaaatgtcagcttgctcagctcatagtcttattccaaaatcaagtgaaaggaaagcactttgaaagatgtgacgctgtgtcgtgctgtggaggcatggaaagtccctgtcctgggggtgcgtgctgtgggtgtgggagtctgaggacttggattctctactctccttcccggtgaggatggccatgtcattttgcttctctcctgtatgactagtgcagtccccttggctgtttattgctagagaggaacttagttatggtccccaggactgccaccagcccggggttctgcttccaggcaataagctttattagccctacgctctcaattatccttttttcctcctccatgggaagaactaagaaatggcttgggaagcccccttgaggtctggtgacagctgtgactttatttggggattactctggggcatgtatagattcatcaaagctcccttcttattaaaaccaaggaaaagatccctctcactgccagggacctccagccggcccttcccctcacagctccccactcttcctcactgctgctgctcccttgtcctatttgacaattaaaaccgcatctttagcaccttgatgcccgcaggcccggctctcctgaggggtgggctcttgtatccttgctaatcccccagttctcaaatactaccagcaactgtcatcttccacctacaggacagtaaagtctatctgagaatggaaatccctcacccctcagcctccttcaccacccaagggagaagcactgtgcagggaggcggggaggggtggggagcatcggggaggggtggggaggagcagcatccgggagaggtggggagcatcggggaggggtggggaggggtggggagaagtggggagcatcggggaggggtggggaggggtgggaagcatcggggaggggtgaagaggagcggggaggggtggggaggggcaaagaggatggggaggagcggatgcacctggcctcccaaatccagattgtggtgccagctctggaaacacagcaagtcactcctgaattacccaaaccgcaagtggaaaatccactgcagctgagtatcatgtactttaggatgtctgaactttaggatttccctgggatcattatcattctaatcattctgggacctgagagaagtaactgagtcgggggccagcaaggcacagacactgatgaagttcagcctagcagtggccagtttttttttcttgatacagagtctttctctgtcgcccaggctggagtgcagtggcgagatctcagctcgctacaacctccgccgcccaggttcaagcaattcttctgcctcagactcccaagtagctgggattacagacatgtgccaccacgcccagctaatttttgtatttttagtggagacggggtttcaccatgttggccaggctggtcttgacttcctgacctcaggtgatccacctgcctcggcctcccaaagtgctgggattacagacgtgagccaccgcacctggcctgggccttcctattttgagggaatcatcccagaatgagaagaactctgtgtagctgggatgtgagaagcatgtgcagagcttgagtgggtcagtacatgctaggccgatcccactgtgagcatttcacctctgctgggggacatgggcgcagggggtgtttgtgttcaggggggccacctctttctgatgccactttcctgggcttgtccaacccctgcttggctggaaggggactcacccacctgcacatcgagaacctcaccaacctcagaggaaagattagaacagggcttcaccacagttttgctttctgtgtgtcccacccctgggaaatgctgcaaggacgtcagcctgccaggtcaccctgcagccaactgcatcctttcccagccctggccgcagcagctgctgggatccctttgtcattagtgcaggagcaaaatgggaatgggggagccagcactacaagcctccaagcagtgttcaggtcgtgtgtttcctgggcaattggggggcgtgagttatgcagggcgctttcctctctcccacccacccaagtccagtagctttgctgcctgcgtgctttccccaaccatggacgggcctctcctaccatggcctcaatgctgggccgtctccccagctgagatgccccctccttaaccgagtctgcctgcatcagtgctcacctggtttagggctgcgcttagagctagcgtgtcctggtagggagtggcctaggctccagttccttttcttcaccagcactgtgggccaaggcgcatggcctcccacgcaccacagcagagctgccaggtgagattgatcttctgtggttgagatgatcactcttggctgtagcccactcatgccgtgagtgacagacaggtgcttagggcaccagagtcttctctaataaggtggcagctggccgcggttgttgatttaccggccaggatcttcgcctcaagaaccacagtgcgctcttctgtaatcagtgctttccttctcacatctcctgacacgaggatgagcagagcaggctcgatgacacagctgctcaactgtaatcctgtatgataattttgcaaattattatttttaatatcagctttttccttaggcaataaaagaaaaagttaaattgctcacaaactaataaaggtttatcttctggagcatcaaattctgtttactcatgaaacacacacctcctctatgcacccatcgagaggaaaattagcatttattttccctgataaacaaaaacagtggaagatttgttggcatcttttggtgttaagcccttccttacatttaaaatgacatagaggaatgcaagaactttggaagaggtctgccctgactctggatttaattttaactttggaaagcaacctgttgtgtgcagtaggatgttatgtggtgtctgcagtgcctagacgctaacaacatgcatggaaccaagctcccccttgggcccaggagccaagagattgaagaaagggaaatgctttcatgactctccacaagttcctccacgttcccaccggggggaagatgttgtgtaaccctcagtgatgagaaagtgagatttcccccagctagattcctcctcctttgattcattttggtggcaagagaagttgaagctttgacactctctttatttgcctcagtgctagaaggctttaattgcacttaaaaataattccagtccgattttcaaatgccttccggagtgattcagcgtttttcttttccctgatttccaggtacggagatatgaggagacagattggctttgaaatcagagacatgtggtacaaccttggtgagtagcctggatgtgggggcatagtgaatatcttgcatccctggtgggtcatggcactggccgtgttcatcagtgttgggatgtcttaagatcttaatggcttctgttccttggacagcagttgctactctttgtagtaactgttttcaggaattaagagatagaagaccaaaggcaaggaaagaaaatctcacgggtggggcaaaaagaaaaatccacagagcaccctcttgtgttgtgtggacacgtggcttggagctcctccctccctggtgttgcctccctccctcagttgcctcagttccttctgcgtcaaataggaagctcatcctgctgtgacatttgccatcacttaccatattcagttttacagactctgccttctaaagggttaattcccctcctcaaaaccagatctacctggtggcagcctaacatgctcctgcactcaaagcagtgaagggtctgtgtgtgtatatgaaattaataggagtttatttgtaaattaagtaattttttccaactacttttatcatgaacagtaagaataaattctctattaaaattttaaccaatgtgacatgtaattcttatagataagccccttcaagaaatcaatgactgacaataacttggtatcttcccagcatctttacactaccctctaggaatctggcctcactcctcgttgagatgaagctctctctggctcctgccgtcagccctcgggcttgctttgtgccgaggtgtcctaggccatggggtgctggtggccttgcctcagtcctgagcaaagcatcagttgcttttctgccccaggatctccaggcctctgcttccttccttcaaatggacacgagaagcctgcattggcctgttgcaagaaaccctccactctcccctctacctcagagaatcttttcctactagaaggaggcaggggtctgtccgcatcactctgttagcctcgtagcattagggtttcacttgttgcaccagggttgggacaacttagctgcaccccagcctgcttacttcccaagcagctgtgactccctgcagtggctggagagcatggcaagaaagaagcagaacccagcgagccacgcttcacttctagctcactgtttgcttttgcatcttccttgccattctttggtttgacatgaggcccagttaggttctcaggaatggaaagccacagcagatgctcctgggtggggatgaagagcgggtcagagtggccctgtctgcctgtgccctcccagtacaaagagaacctgcaccattgcatcctttctgcgtgtcagtcctggagtcagtggaggactcctcgaggaagctctgtgctaggtctctgcacatgattttgctgcagtagctcctatgtccagaatctgagtactgggtctcagctgtcaaagggcctgctgatctctgcaacatgatacctaccaggcaccatcctgtccttggccttcctgccatcccagggaggaaggtaggggctctaggctcagagtcaagagagatgataagtcccaccttgaagttttcatcctctcccactcctgcctccccgtgaggcctgattcacatggctcagtctttctgggccgttagataaagtggttggactgaatttttcaagagccttccaattccaaaactcaataattctatgacatatatatacgatgatctcagtaataacgtgctaaggcttttagaacagggaggaggaccatccgtgattcattccaattgatctctctgtgttctttgttaaaatcctgctctgacagatgcatctgtcatttgctctgttaggccagacggcaggccccacaccaggcagggacccagtgtggtcccatgagagagagagagaggcaggagacgggggagggctttcacagcaatggcatggaggggggctgttctctgttggaactcagtgagtccaggacttttataggcaccaacgttcatgaaggaggtgatatgagctccacctgccacagttgggctctcagggcagaccccagacctcttctctggacacaggctctctctgaggccatcttttaccctggcccctcctaaaagagtgagtccattttcttctgtgttgttccatttcaactctaaagtatagacagggaattgcctatttcccccaagaggacacttgcacatatactttcaaatgaaggttctcattctggaatggctcggtaacatttcacatcatttatgataattagagacaccaccctagcggagggtctgatgggtcattacatactgaaatgcttccttctccccgtacacaactgcagccaccatttgactcaccctggcccctgagcacccccaggatcctccactgctctccatgtgccaaggtcattgcctagcaccaagggagcctctaaaactcagctcgagccacagctggccagaggtcaccctgactgatgggtgctcctgcctttctagttttctgatttgggattgtttttgtttttgtttgcaagtatagttaatgtcacctctgtagtccctgagattgatcaccactgaaagtggctccatttcaatttgtgctacgtgccatgataacaatgaaggaaggaaaggcgggcccagaaagggtgagtttctccgcgtgccctctccaagtgcttgggcaggcctggccttctgaggatacacttgggtctgacacagagcacttggttctcttgacgttatctgtcatgctccagataggccaagtcaagcgacaggagacttttgatttggaaaaggttgcagtgaagtgagcaagctccccccttccctcctatcagtggctgatttgaatatggtgattaatgcatgaggtgtgtgttttgcagctttttagccaggaacactgactgtggcctgagaagcggccaagaggtcaaaagtaaaccaaagccaattagggtcagggacttggaaacaacaagaagtaacagtcagccaccagacttgggttccttgctggtaaaataagttatctttcaaagtgagggaggtgatcttaaaagcacctgcagcccacaggatcctccccaagcagcccctcaggatggctaaggatagcaccacggggtggcctccttcctgccatggtgccaggtgcctgagtgtctttgccaaggctgtcacactccaaatttatgacagcacatctcagtttcccaggatgtatacaacctactttctacatagtttttttttttttattttaattttactttttgtaaatgggtgcaggtttgggaacatattggcaggatgatagcaccgactctgccaagaaaatagaaatggaaatcagatctatttatctgcttacaattaataaactgtcacttgagcagaccttcagctgaatgctccatgagtctcctccttcagtctttccaatagtatgcatggcccatagagaggagcatctcagctcttgcctcctccttgcccagcctcagagcaaggatctggggtctgttttgctcaatttaatgcaagggcaaacatggcactgccccatgggacagagtgatgtgtttctttccctcccaaacctgtcatattttgagtctgaaaggggaaatcaaaagcaggctctctctcaaaagaaaaaaggggggaaaatgtgcttatttacccagctcctgagttatttatcaaagcgcactctgtgcagcagcctgccggagcacctgatctccttgcctgtgccgcctcaatttacattttgtttattacatccagcacactggagcgagcactagaccccagccagccagaacgaatgtgcttggagcaagatctttatccaccgcgttgggtttgggatatttttcatgcagggattcccttcatgggtgttttttggcgactgggcaaattgtgtgcttttcattaaaacccgtatacattgtggcctaatgggtgtggccaggtggtggaagcttttgctctgcctgctcttgtgtatacagagatttttctgggataagtctatgtttaatgtcccagatttttgaacaccagtgattgcaaagagataatttaaacacccacagggaggcttctgactagggaggccttggcttcgtgagaaaacaagatgttgttcccaggggaaagagctccacgttctgtaactaaaatagactctagatgggctatgagaccggcaaggactggaagtaaaatattctcctcgtcaccttcctttggctcaaaagtgtgtcctctttttctttaagtctacactgcaggagtcaccttggtcctcattggttccaaacctgagttcatcattaaatttgagcaagatatgctccaggggaaatctataatgcaaatgtcaaaaaaaaaaaaggtggctaccagagaacattccccacccactcctgctcaccttggggaccactggtttacgaagagtcagtgcccagggctgtcactatccatagaacccagtaccagctccaggccagtgtgtcttctgtactaataaggagggtgataataaaaggttaagctactgtcgttttggtagcttctttttccaatccctgcttctacaaccacttgtgactgctttctatgtttttcccagcttggaacaataaaacctgttggtgacagacagaactttatgacgctgaaattgtggttgatgaacaactcgctgtcaccatcatctgttttctgaaacattggctctgacattttttaggcataatacaaggaaagtgtcacctgagagatggaatataatagcattttcaagagaatgctttgcagcagttacaggcctttcagaaacattaagcatttgggaaagtggtgagaatcacacaatgatagccttagtcaaaatattaattatttagtaaaagttgaaaataagatgttaattacattttgtgtgtatgtccacccaataaaaagtaattcagtctaattatgaggattacgtattctcttaagtatcgttatagtagccacatttctttaatgattctctttacagaaatgtatattcactgagttgcaaagaaaactaaagaatttggtttcctgattgtgtagaaatattaataagattggttaattcgggatacattgctggtgttaaaatactgcacatattttattcaaacatttaatttctcaggcattcttctgttatatgttggaaatgaaatggttttagttgcagtggggtgaaatgaaaacaaaatcaagatttctgaaagacaagagggtcagcttttaaaagatcacctttttgataggacctgcctctgagtttcattatgtcaccttaactaaggttcgcagccccatttttagaaaggagtcttccaggagcttcattccagaggtgcagtgtccaggcagtgaaagaagcttggcagttgctgtggtttcctccctctcccatctctctgaacttgcctggttcacttcaagctctttaggagctcaccctgatcctcaggagtaccgcagccacgcacccacaggatatggggtccccggctggggtgagcacaatggcggccaacccacaactagcaggagggggaggggctggccaccacatcaggcccagctgccagctgctctgcccagtcgccagatttcctgatggtgatcctgcgctagcatctttctaagtcagcgacagagacccaggaaggtatgataccaagatttccaacaaaaaccattgaaattaaaaacataaattgagtgcttgtgagaagccagtctctaccttctgggggcttatttagcattgtgatgtctcaacagtgagggataaaacgatggaaaatgacagatcactgacctctctgttcattttgcaattaggggggacaaataagggagtggacagctcaaacgatttctctttcagagagtcgggtagggtccgagtgccatgcaaagatcctgagacaagcaaacagggaaggaatttgtaaaatgagggtcacagctaagccttcataatctcagacccaggttcaaatcctgcttctccacttctctgaacagctcacagaacagctttgggtacagcccactttcctcgtctgtttaacaggttaagaaggtaaccatctcgtaaggttaccgtgaaaattcagtgagatgatgctttatcttgagcttgtcatgtaaattgtaaatgctaactaatatgatcatattcagtattattcacatttgaaaaacttttgagaaacatttttctgagttctttaaaaatcatatctggaacaagataggtgaaatgagattaataaagtagttctttttttttttttttttttttttttgagacagagtcttgctctgtcgcccaggctggagtgcactggcgtgatcttggctcactgcgacctcttcctcccaggttcacgccattctcctgcctcagcctcccaggtagctgggactacaggcgcccgctaccacgcccagctgatttttttgtatttttagtagagacggtgtctcaccgtgttagccaggatggtctcgatctcctgacctcgtgatctgcccgccttggcctcccaaagtgctgggattacaggcgtgagccaccacacccggcctaaagtagttatttaaataagcattttcctatcaaacaatagctcaaaaaggtagaatcactgctgtttttagggtttcagcctcagattccggcgccttgatttactttgattggagtcgtttggcatgttgcagaaatcaccctgcattatttacagaggtgtcagatggcaaactcatcttcataagatgtgggaaataaagaggacccaagagactatctgctctctctcatttgtcggctcctgttcctgtcgctgtgcacagagttagaggctgagacccccgactcgcagcccctgctctattcagaattgggaattagctgcatgtgttctgaatctgtgtgatggaactggctacttataaaacagtgttcatcttctctgacagagaagtcatgattacaggcttataccgcgcggatctttgaagagcttcacttataacatgtggaatacaggccacttcttatactaatggctgggaaagttcaaaatcatcatctgcagacgcgaaatggatgcacattttcgggatcctgctgctcaaagtcacagtgatctgtgttgtgttgttttatccatttaagcccattttagaattctatttttctttatttctgaatattgtacctcttttttccaaggtcaacacaagataaagttcattccagaaatggtgggcccaatattagaaatgacattaattcccgagacggagctgcgcaaagccaccatccccatcttctttgatatgatgcagtgtgaattccattcgacccgaagcttccaaatggtaaggacgtagatgtgcagcgagtggccgggggacatgagggaggcaaacctgaaaaccttcaaagaaacctgtagacagttctagagttaaaggtgccaacgtggaaaacacattttcctacagcttgagagagaaaaagcctatgattttccttattgaagaagcttatcatcccttgcactcaatttttgggaggattattctcaatttttagctcttacttacttcttttaatctgggtttacttacacattgcaccctggataaaagtctcttgctcccacttcttggtacgtgctcttgtagagcgtttaatcaaatgttatgtgttacattctctcagaccggctgcttattgcagaattgtggtattttgaaagctaaagtctttgcttttattctcttaagtgtgtgtcttgttcttttgcctgtgcaatggaactgatgaaaattctctaagaaagtgtatataaagtgctcaaaacatactgtgacaaacagcatgagggacaaactctgctgcataacttatgctcaagaagtaacaaaatctccttctggatcccaagaaaataagtatactgtttatgtattcttgggttggcacccacacccacacatacacatgcacgtccccacacacacacatacacatacacatccccccacacacacatacacatgtacatctccacacacacacatacacatccccacacacacatacacatgcacgtccccccacacacatacacatgcacatccccacacacacacacacacacgcgcatccccacacacacacacatacacatacacatcccccacacacacacgcacatcccgacacacacgtacacatgcacatccccacacacacatgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacacatacacatccccacacacacacacatgtacatctccacacacacatatacacatgcacatccccccacacacatacacatgtgcatccccacatacacatacacatacacatccccccccacacacacacgcacatccccacacacacacatacacatgcacctccccccacacacacacacgtacatccccacatatacacatatgtgcacacatacacacacatgcacatgctatgactttctccttagtgtactaatggtttggccatgatgctttgcaggagacctgggagaagcccaagtactagggagtcctctgaattgaaagataccttttaaaaatcattatactggaccggatgtggttgcccacgcctgtaatcctagcactttgagaggccaaggcaggcagatcacttgagctcaggagttcgagaccagcctgggaaacatggtgagactccgtctctacaaaaaatacaaaaattagtgaggcatggtggtgcacacctgtggtcagggaagtcaaggctgcagtgagctgtgatcacgccactgcactcccgcctaggtgacagagccagaccctgtctctaaataaataaataaataaatattaaaaattattatagcaattcaagtaagtcaacatactaagcattttacatagattttagaggaatttggagaaaaattcctataatgaaaggaaatcaaaacttcatcaatcaagatagcttaatgttggtgagatctaatattaaagggtatattatccttacccacctctacagtttatcatttaagggagctttgagtagtttatagattttcattggtcatcttcatcatatcacatgaaggcggtatccacgaagaatgattttgctgtttcctagaacagaaaagagagatacgaaaccaaaacagtctccacactgtgagttgagtttagatactgagggcagggagactgagattcacaggcttagccaggtattatctgggtcctcagcaaatcactcaacatcttttaagtctccaattcaagcttgtaacattggcatgaaatagaatctaccagaaaggcgtgttgtgagaatgaaataaaatcagacctgtacaatccctagcacggtgcctggcactataaaaggtggctgtggatgcttctcttctctcaaggccggaacctcccttggtctgggtgtttgtggagtgcagggggcagcctgcagggtgagcccccagtgtctgcaggaccatggggcccaacgctgcatacaaacctgggcatggccatttcgtcagggttgttccggaagccggggaggagcacacaggagatgaacagagtctgactgctggagccgtttcctttaacctctacacacccacagctgtgcttgaaaacccattgcagaggagcctaacacctggctcggagatcattatttgttttttgcactttgctccactaggcagttttttaattttttttttatttttttgagacggagtctcgctctgttgccaggcaggaatgcagtgacgcgatctcagctcactacagcctccacatcccgggttcaagtgattctcctgcctcagcctctgagtagctgggattacaggtgcgtgccaccacgcctggctaatttttgtatttttagtagagacggtgtttcaccacgttggccaggatgatcttgatctcttgacctcatgatccactcgcctcagcctcccaaagtgctgtgattacaggcgtgagccaccgtgcccagccctaggcagttttttataaggtgactggtgactgttattttcacattattccaaccgtggacagtagagagggctttagtttaacttccccagtgtaatgtcagttggactggaatgagtggtgttagtacctcctcccttcttccttcctccctccctccctttcttccttctttcctcccttccttctttcctcccgttctctctctttttttccatgatagcagaaggtctccctgtatttatttttaataatattaaagataattcatttttgaaagaacagctgtttttgtttctctggctcactgtcagtctgtgtatatacaaagtctttgtataaagactgtactaatacaacattgtaaatattatacctagattttttttattaatgttctttctgtttgataatatatcaaggagctttcccttaattacaacatagcaaccatgatattaatgatggcataaaattaactatcactttcttatccatcgcctataaatgggcatgtaagttgtttgcagattttcactgctgtgaataactgtgcagtgaacacattcatgcatatagcttgaatttattttgaaaattttcccagtatacattcttataaatgtaattacggatttcaaatatttttgtaacttttgaaattattgccaaatggtttgatgttaatacgataagatttgccccatctccattgctgctggcactatatcatggccccagtttcactgccaactcattggaactacaaattataatttaaatgctttttcctaggcagaaaattcatttgactttttgaattttatataaatctagcccaaagaaggactttgtgaaaaattgctattaaagaatcaggttaagggggaaagtgtatttatatagataaatgtcactggcacagaaaactaaggtcaaaagtgtttaaaacatcattctatttgtcattttttaatcagtctttgggtcaaaataaggtcaagggcagttagaataaagaagaatgagagtttggtttctgaattgttccccttttccctcacattcttttgtctcatggctgccttgtggtagtttaaaaaatcttacaacaatcttctgaggaagtgcttcattttctccagtttgcaggggccccaggtttgctaggaaatggtccgaagttaacgagagccacagaatttgtgccaccattttaaacaccgccttcccattggggcttcaacattgacccagcgtcaggagacatctttccagaaaaccaaattgtttttgagtaatatcatgaagtaattggcacatttagttccatctcataaacaacaaactatttcactagcatgaaacatgccgtgcttggatgtatgtaaatccaagcataagcctgaagacacagattcacccacaagaaggacccactgtcaggctgagcgtggtcagctacctgaactgttggttcagagtcacctgtttctctgtgttgtcatctgcttgaacctctgcagacgagggatagcgtacattaaagatctttaaaatgagggcagaaaaactaacccttgttttaaaaaaatccctcttgtatgttaatctgcttctgtaattgggaaaagatcagttttcttctgtttgatgtgcccacctcagcttcccagctggaatctcccaagcctgcagcatcatccccttttctgccagtctccttgtcactgggttttccggctgcgggtcatgctggactggcctttgcttgctcccctggcctccgtggcagtcggttgtgaagcttcatcagtcctccctctgtctcatctgcagcctccgtcctctgcgcaatcaccattgcactagtccaggattattcctgggccacagtatttgtctcttgacttgctctatctatgttttctaagtcctttctgactccagttccacctgtccctctcagctggtcttcctaaagcacaagggatggcccctattgtcggtgatgtgggcgaatgtgtagagtggacatgtgtgtggcacattggtgcagggttggccccacctgcttctccatccacgagcttctgggatggggatggtcggctgctgcctaactcctctgccataagcccagttacctcaccttattagtcacgtcagcaggggcttaagttttttttatagcttttatagcagatgtgcaaaccctactggagtagggggaagatattagggggatttgtttttacaacactttagtgttttgaacccgtgatagagcttatgttttaaaggttgctgtgtcttttggagtagagctgtcaatatgctactgtttatggaatatgaaataatatatatgtccaggtgtattttactcttacaattggagtagagaggagacctgctggattcagaagaaaaacctgctattttactcaggattaaactgcaccaaaccattactggaattttaaaagcatgtgttacaaattggcttttctaacgttgcccggagtttctgctcttgtgctcgtgctcttcagccgcagtggcgggcatttcattagaacgttctttcccttacacctccccaagagcctactcctttcctgtctccacttgtgcaagaaagagcacaaatgttccttcggaataggctcagccttgcccttatcctgcttctccagggtccatgtgttgaatgggctctcttggtggcgggatggggtggcatggagttatcctttcatgggccatgtcctccttgtggcctgggactctctgtccagcgctgcagtgagtgccttaggtcagcttgacagcactcgctctggggaggtggcgatgaagctccacaaaaggctccaggctgaaggtccctgatgctagtggaagcctgctgtgaagtgtcgtgttctgcaggagctgggccagacagaagcctgtgagatgggaggccccagatgtgcacagcggccttgaattctttttagaagtccctcctaccttcaaagtcatatgcttcactgtgggctgggtccatagccatagagctccggtccgttgacaggaaggcgttcccagcgactggacgctgcatgacgctcttgcaatctcacacctctctgccatcccatccctgtttgtgtacggccaggaggctgctgcctgtggggtttcttttcctcctagtgcttgcagtgtggatactccaagccaggggaggtggggatacatgtgggaagccccagtggatgcccactgcagccatgcccctggggtggcccccagccctgtggccactgtcagccaccccctccatcactgggcactcttgtgccacttccctgccctgtccatactcaaggccactgtggacatctggggcctcctatctcataggcatctgtctggccaagctcctgccagaacatggcccttcacaggggaagttccattagcatcagagaccttccgtctggaggccttggcagagcttcatcaccacctccccagagccagctctgtcaagctgacctaaggcactcactgcagctcctcaacaaaaacccatttcttatttcttctgcctcttttgtctctgggtgctccagctgtctgtggtcatcctggctcttccagcactttctatgaatcttttatgatccggatgccccagccattctcctaaatcatcctcccctgctgcttcttcctgtcctggtgcctaagggcacattctctgccccctttccttacagctggccaactcctcgagacaccaccacagctgcgttcatcccaccccctcgccctgtgcccaccccaatccagagagtagcatgcttacccctaaactcaggactctaggaatctccatttgtttgaaaggagaggtcctacttgggaagatttcaggactgataagctggcaggggaaatgtggagaggcattggggtcttcgcgccccttatcccatccacctggatgagcctgcccttggtcacaggagatgagccctctcctggccttaagctgactctccctgcctcaccaagaaccctgccctcccgtggaccgcactccaagtctcaccctcatactggattttgcttcataataaaaagcatacttttaaattccctcctggcatctttttaaagaattccatttgttacgcctttggaaaatacagaactaacagctgagaattgcagcaaatgaccatatgggccatagaccattaataaaaatggaatggaaaaagctgcccagcaaaaataatattttcaatcatggagctattttctgtcatctttgtgaggctcagtaaaatgctgcacaacttccagaaattcccatttagttgtaacagtattagaacatgaataatctttgtgtcatcagtgttgccgagctcctgtttgaataatctcttcacactgcccatgccagtaaccggaagccagtaattgaatagccgggtgaatgtcagcggctctgccacttggtggaaaggccaatgtattttccactgtaatatgaatgtgaatgagtttggtagcaattctatcttgtgtattctttaattcattaggattttatttgttggtttgtttatttttgctttcaatgtcaaaataattcttgcctaaagaggaaatatggcacaagaggcttctgtttcattgaatccagacccaaagatggtctgagaggccatggaaaccaagatccttgactccaggagctgcgattatattgaatttcattcttaaaagccctccagcaaagagattcttccataatcccctttaaccagattaaacaggactaattttgaggccatgttcccagagtcctctggaattgcatgcagccctaaagtcactctttaatctgtgtcatgtagacataaggagccgctgcacctgtctcaggcatcagcaaggtgtcatggcctgcgatgcagccatgcatccccagccaggcagctccaagtgagtggctctgggtcctccaggctcatgagtgtttcacaggagctccaaggtcagcaagccccttgcttgacggacgtaggaggatgtggaggtttttgaatgtgggatgaagtgccaccgattaattagtgtgtaattaagtttccagagcagttaggcaagaggaatgctctatacataaagatatgaatgtgtctgagcacaggtactcaaggctgagtgatggatcgggagggaccagtcacttgtaggatgtcagcatgggcgcctagagccccaagggttgtgcggtgtcacacttctctctgctgaaccttgcctgtttcatcttcttaaccatgttttccacccagatacagtccagcaactttctcccacccacctccccctgcacatgctcagggggtaaggtgtggttgcgcagtttcatcagattggccccgacccagggagagaaggcagagagagtctgattccttggtgccctctgcctgcagtatcttctgagcatttcttctttaaatacaggagaaactagagcactctgggcaaagagcagcattgtactaaggtttatttttaaagggtcaaataagcccttctgctaatgtacttagcagatcatgtccatagatttcagatctcacccggctcttgataacctcggagccctccatcaaggcggtgagtggtctgtgcaaacctttccaccctggcccagcctcctgctgcgctcccacagaaccctagagctcttctggtatataaagcatggtcctggatgtctggcaagtgcaggctgattttatacattacagatgtataaaattatagatgcattagagtaagaatagtaaatctcacccaaaacaaaaattatgcgttccaaaccaaatataattggcttttggattagctactactgggatccttctctccatgatctttcaaataggtgccaatagcctatggttagctgtggcagtgagtggtaaaagcagtgtttcctttttaagttaattgaattaacaagacgtcaatatcgcttcgagcacagccccctgactccgtcacgtcaatttaacagcaactttccgaaaggccttctattcataagtgttctcttgtttcatgttctcagagggctgctggtatcagacactgagagactctctgttcagtattttcagttggacaccctgtgaatatttttggagcaatattagtgattcagaaaagagaagaaaatataatggttttgcttattacgtgagtgagcctctgccaccttttgagcaacacagtaaacccttgctaattttatcccagccatagagaaccttgttgcaaatcaccagacaatgtgcatttatgaggaagataataagcatgattttgataaaaccagctctgctctatcagcaaatgtactatctccaatttagtgggacaggatcatttaattctgattatagtaacagttcatagcacactagcgaatcaattcgagtgtattctataaaaatgaacgaggatcctggaattagaggctagctgtggatctctggtactgaatccttgctaataaacagatcagggtggccaggtgtttgtgtaaattacttagtttggactagggttagtaaaattagaatcagctgtgttgtgatttacttaccactcatccacctttgttggaaatcattaagttcatcagtcagaatttgatcagcagcatacctaggtagctgtagcttcctcattgcctgtgtttgtgacagctagatttacatggaagcagagaaaacatgccgttttcataacctacactctgtgttcagatccctttggcttgaccattgatgggcattttaaatgcctgtatgtttgcccatgtcaggagaaggcacatttctctgcattctctgtacctttcttgttgtctgtactcattaaacatacatgaaattgaatcatgttttgattaaatttaatttaattttgtgtctctattatttgtcctgaagcatcagccctcatcaaacatttaatctttgaagtctgtctggatcatggcaccatctgggagatggcactgccttgaaatgccaacttttgggctactaccaagcgatctcccttgtatgtgattccaaaaagaactaccttttgcagaattcttttctgtaaagggcaggatagcagtggttagtatcaaaaggttgttattttacagtaaaaatcgttaatgtgagatttcaggagaaaaaaaatctaaagcaattcattcctccttcttcaatagaaccatctgtctgtgctgctaaaatccttgaacttcttaggccagacagaatcaaaaagaagtgtttatttgggggaggagaccatggagaagatcaagaagaaaattggagagattcactaaggtccgggttctggggatgttgctgagtccttgatgtcaggcaagaatcagtacttctctccagccctgaaagcctttgtttcatctgtagctgtggctttgggcagtgtgtactgatcgaggacaggcagggcgtctgtgtccatttggaggcccctccttgggtttcaccgttccttgctaattgcttctcaggggtccacagtcagctgctcctgcaggggcatccccaagtctctggtgcccacagtgtctgtcacaggcactctggatgagcagttttcacgactgggcttggcctggccaagaatgcaggttgtgatttatcaaccctctagaccgctcctttgctgacatattaagccctctccagctttatccagtctaagcactttaatccaatctaagttggtctaagaccaactgtattcagtagtttatgtgcacacagcacattcattccattagagcatcaaaggcactgtttgaggttttggggctggctagagcaatgaccaaagaaaaattcttcctctcactcagcttaaattccactgggatcctaataacagcaggcggcttgagaattgttgcctgagaaagtaggtgattgaacatggctttagagagatcctggagacccttgcatacatgcccatggcgtacttgctttctgaaccctggattcagctttcttcaattcttcctttgtccatcttccttcagtttagagtgtgcatgtctcatctttatgggaatgaacaatctcacagcccctccttgctactggcacaagttgatggtaacctcagggccccctgcagcatggctagtcaccaggccggagtcccagtactcagatggctatgaactctgccagagatggggaactgggcagtgaggatggggaaaacatgtccattgttatcgaggtttttttcagcctgatcagacacttgaagacattttagagatttccaccccccagaatttagagtttttctaaaagcatggatctgagacataattagctggtactggcgacccttctgcaccctgattcccaggaaatttaatcagaagctttggggatggaggataggctggagatggaccttcttgaggtgcctgctggtctgtctttagggacattgctcctcttgctctttagaacattttttcagccagagtgaggtatttcactaggatctatcaaggaatggcagctaagtggcccctaggatgttttcagattgccgagaactcttcactggcaggggaaacaccatctgttcatttcaggaaccaacaagctattttagatgttacgtgtttgtagagatgaagtttgagactttttttcatgctgcgctttgatttttttttccccctatggtttccttgtctttcttcccctggttcttgctcctgctatcaggacgtgcaggttcaggctccattaaccagaaaaggaaatgagaggtccccctatggcaagggatcatcagaaacctccaggggttctgtgttggcaactcttaaatgaggcttcaaaggcagagggtagccatctatgatgatctctcttgccgatttatgttctattgacactcaagtcataaaatgaaatactcgccatgctgattatttacgcttcctctgtttaattatagtttgaaaatgagatcatcaccaagctggatcatgaagtcgaaggaggcagaggagacgaacagtacaaagtgttatttgataaaatgtaagtgttgattagcagtgggatttatgtctgagagatacagagacagagagaccgtaattagactacaatgaactttgtaacccagaaataattaaaatgtgttaataatggaaaatagttaaaattgcacctctgttgagtttctttttctgagtgtgattaacaaggtgtgtataattatttttcagccttctggaacactgcaggaagcacaaatacctcgccaaaacaggagaaacttttgtaaaactcgttgtgcgcttaatggaaaggcttttggattatagaaccatcatgcacgacgagaacaaagaaaaccgcatgagctgcaccgtcaatgtgctggtgagtgaaagcttaatcacgttttttcagttttcacagcacaccagaaactgaagcggggattgccccagcccttatctatgacagtcagccacgaagctttccaccgcagaacaatctccttcgcttgtttcctcatctgctgcagggaaggaatcatgaagtcgtccactctgaataagtctgtaaaattgtcccatctctggacgttttaatgtcgctctccttgtcgttgtgaatgatgactcaccgtatcttgcagccagggtagtgcctcatggattacggccttaaggctttgtgattaggagaccataaacgcgtgctatgtagtacataggctgaatggtggcctcaaaggtagagcaataccccagtccttagaacctgtgaatgagaccttatttggaaacaagaggccctgcaaatataattaaaaagaatctcagatgggattatcctggattacctgcaaggggaggggagaggtactaactccaatgacaggtgtcctcataagagacaaaagagaagacacagaaacaggctagaccttgtgaagatggaggcagagattggagggacccagtctcaagccaaggaatgcctggagccaccagaagcctgcggaggccaggaaggatccccccctagagctttctaggggaacgttgtcctactcacaccttgatttcagattctggcctctggaactgtgagaagaaacatatctgttgttttaggtttatggtaatttgttacagcagccacaggaaaccagatctgggcaccatggagaacagacgcctgggcgaccttggctgctgccatctgtctgccttttgcattcctgctgttgccctgatacagctgggttctgtggacacccccttcctgatgtcattgtggtccctaatccaggaaatccattagtaccaatgagcttttgggaagctttaccacaagctcagatcccggccagcctcatggctctcagcagcgttgtgattcccacagcctggctccagagctctctgcttctccctttgctgcttctcttataaagaaacacaagggctgactcgtggccatagtagggctttcctcaagtttccttgcctgtcccatggcaagaatgcaagaaaacactactcctgctttgctctacttacctcccttctctgcccagccactggcctcaggatttcagagtcgccaacaacatgtggatacatagtcctcactgccacatccaccccttgtgtggacttgtgggtgctttatgctcatggaaatggactttcatgccaggaggaacatgacacatcattcactctttaaaaagccagagttgtgtggattaaaaagataaacgaaaaggaatgctttcacttttcatcgactatggtatcagtgctggatctgtgctttgccatgaggaacttcacagctgaaagctcatgagcagtcttcgccccttcattgcatggctggacagcttgtttaggctaatgataaacatttctgtaacaagttttcttttccttaaaaatctaaatataggggaccagtttttggtccagcatgtaaagagcttgcaaattgtcactcctgtcctcacaacaagaaaaaagctgaacaaattgaaaacaatcaacaattattagttccgtcttcttagatctgtagataaacttctgaccccaaagtcaaagaaacaggaggatacagagaaccacagagtggaagcccaaacagaaaccaccactggagccagtactagattccttttacccagtccatcatattcactttcaacgcattagtacaatgcacgctaaagacaaaaacacagtgaaggggcagagcaggcattagaaccagactctgatacggcagaggttttgaaatcatcagacctgcaatttaaaacagctgtgatgaatatcctaagggctctaatgggaaaagtagataaaacataaaagaaggtgggtaaactacgtagaaactcacagaaatcatcaagaagaaattctggaaatctaaaacactgtaacagtgtgaagaatgcctctgatggtctcatcaatcaactggacacagaatctgtggacttgaaaaatctgaatgtttgcagatgcatcatgtgtcttaggctactgtagaaattactggtctctgatgtctggccctgaggtctgggctgtggctgtgtttgtctttatattcacctggagactgaccaagtggtacagcagcaagctctgccccaggtcagttggtctgatcttacagacagaaaagaacctggcgcttacttcactgtcttcttgcattctgaccaacgttcaaagtaatttgttgtcatggtgccaatgtgattgacgtgaaataggaactattatttttctatgggaaagaaatggagaactttacaaaatccttccctactatggacataactttatagtgttccttctaatccttaaggggatctaagaggctgataagtgcccagaaggaagaattatcaataagtttattagtcttccaactttgatgattgagacttttatttgttttaagcaagatctcttatgctcaccaggacatgaaacagtggagaaatggtggtgtgctctgaatatgggctcttactacctgaatctagggtcaggaaacaaactcttgtaataaaacctacaatcacggtttctaatgtgaacctgtgttcctctttaattcagagccagactcagtgcccacgtacttttactgtggtcagcacttgctcagttttaactaagaaacacaccctgggttctcaaggttatctgacattattaactttcttcaaatgggaacgtcctgaatcatttgatgaaaaatcaaatgttctgctcttaaccatttcctggggatgataaaatggatcccaactgtcacagttttttcatttagaaaataaatctgtggaataaagggaaacaagaaaccagagttttaaagataggtagataggtgtcctaaccatagatactcactgcccagctcaatttcctggtcagtttttcccttttctcctggtacttttattacagaaacagagtgtaatagagatgggtatgtataaccatctctaaatgaatatagatgtatacatattggagatgtataaaatatactctgttagtcactaagaagaaatgaagcctaaagttaaaaaattaaattaataaaataaagaacatagaatttaccaatgctctgtaagtctgttgccaagtttcctttagaaccagcttcgtggtttcttacaaaacacagttagtggaacattgtaagttgtgtaggctccttcatgtcctattttcttgcccttaaaaaaacaaaaataggtccgggtgtggtggctcacgcctgttgcactttgggaggccaaggagggaggatcacttgaggtcaggagtttgataccagcctggccaacatggtaaaaccccatctctactaaaaatacaaaaattagctgggcatggtgttgggtgcctgtaatcccaggtactcgggaggctgaggcaacagaatagcttgaactcgggaggcggaggttgcagtgagcctagatcacaccactgcactccagcctgggcaacagaggtagactctgtctcaaaaaaaaaaaaaaaaaagaagaaagaaaatgaaaaagtaagagacgcagcagtcactctgcttggccacctaagtccccaggacatctcctgcaaggatgtctgcatgtatgttggaacttggatgtatatttgtaattctttaactagaatttcactgacagctcataatcgagcatctttaattattggtcactaatgttgctgagtgtcacttagtgcttctgtgcagtcatccacacgtcccatctctgtgactggtaggcgcatcattactttgcacatgccagttacttctcttcatagccccttggcaaggctaattaaatgcagagtggggtccagtatttttaaaatcttggtatctgttttagtccaaaatggaaatataatgcagatgtctgcgttctaaaagatcaatgcctagcggtggattggagttggggggccggtcccaatggggttcctctgggagctgagctgcaagcttggcacagatgtcagtcagcgctggtgtggggggacttgagagacaaggctgcccgcggagcccaggaggagtgggagcaccgcgtgaacctttacgtaagaaacacaaaggttttatatagaaattgggattggagatgagtgtacttcggttgtggagaggttttgaagtcctaggaagggaacaggactcagcacaggcagaaaatagaagacatttcgtatctccgagagaggaatgaaggtcgcatgatattcccgttgtgaaattgtaaagaaaaatgatcaaaaccttagaaaggattaaaaatatgagtacaaaaggggatggtgtgaaaccgtagcttgtaaatactggcaactttgagttggaaatgaagggcttatcctctgcctttgatgcagattctctttgttgcgacagtgagttgtcagctgaaaatatcctcattactgagccgtgtcatatgaactggaggacagtaaagtgtcagaggcaacagaacttgaaaatcttggtgcatttttctaaatgtgcccccgcttattttctagacttagttatcatttcttttcagagacatcaattgtagaagcaatgctgggttttgctcatgaaattaaagagcctatgccatttcttggataattgtatgtctctgtaatggtgatattcactagttacttcaggctccgattctagagggctaacatcatttttaggtgctaaatttcacattgaaagtgactctgatgtttccttaccttaggccttgtgaggtgacttctgtgcctctctggtggctcctgtgtgaaaaagattttaaagtgtttatggagatgttcaccttaagaaatataattttgatagaaatgttattgctcaaccagacgatattttccagtaaatatgtagaaataatccattggttttaatctactaattaagctttctccatcagtgtttatacacagggggctttttcagaggcagccctctttttttaactgtggtttggaaggtttgcctgtctggaacagtgctatctaccagaaagttctgggataatggaaatgtcttgtgtagactgtttgatacagtagactagccgcatgtggctgttaagcgctccaagtgtggcaagtgcagctggggaagtgaattatttattcaatgttagttaaatttactttaccttttaatatatgtggctactggctagtgtattgcataactcaggtctgtattatcatattgtctttgtagctcttgctgaggctgggcccagaaagctttaaatcatgttgatgatgcttatttgcttattcccaaatttgggatatttatttatgtattcatttattctgatgagattactatggctaagatatcatgtcttcatgtctttttgggcaataccttgttttaattgaagacaagtgactttcaagtgacagaagttgattttagtcatcacagtgttcagtgtagaaatgtaattgtgtttgactagcaaaaaaaaaagtgaagaactgtgtaagatggttttgcaatttatgtgaatttatggttctgatccaaagagctgggtccatttggctgtgtttgacacaagatgaagtatcttgaatttttattgtgcatgtgataccttttgtggaacagatttcttaaaacagtattatggtttaacttttcagaatttctacaaagaaattgaaagagaagaaatgtatataaggtatgtatgcatcacgcttgtctgcatgttaattataaataataatatatgttgtatgtttacgtatgctaagaaatgtgttatagccgcaaaggtttattttgtagaaaattgtgaaacgtataaggtagagtttggtggagctcccagatacattctcagctcttgcatagcttgtccacaccagtgcagagttcttggtggtcaccattagccaactcaaaagcaaaactacaaataattgtttcacagcgttttgtacctgttgaccaactcatgtggcccttttgcaaaaagataagcacataaattttaatgtttcacagtaagttatatgatccagtgagaaatccagttataactttaccagacataggggagttataatttttcagtctgctcttagttaactgacgccatagtcccgtgttttttatgtctttcttccatgaagaagagaaacattttgcattgcctgctggattttgcttccctactcgccttgctccctggagtgagggactgtgattgagcccttctctcttggttacttctaaagtctcgtgtcaaataattagcaagattaccactctggagactaggagaaggatgtaacctacacagcatgagtttttagtgatgtgtttattacactgagggtgattgtctaattttctatttctaagattgtttttacttctcctttttaagaacatactatgtgaatttaataactcagttacctttatttctttatggcaaagaaattctttcgatcacattgactgtaatcattggagctctttattctgatggatttgtatttttacggatttttttgtgcatttggactcagtagaaatgcagaaaatcacaatcaagtattgtgtgtctcattaaaaatgtttaagggaaaatgaaaaggaatgaaaaatttgaaggaaaattctacctttgtgtatcatctttatttttttcctgagtttttcttagtgctttctgtaccaaaagtttttaaggcattttgaattatgaacattgtaaaaaggaagtgtagccatgatttactgttgaacatagaatttagctcttgcaatcctcaacacaaattatttagtgacattttaagaacatacctctgttttattgtctcaggtatttgtacaagctctgtgacctgcacaaggagtgtgataactacaccgaagcggcttacaccttgcttctccatgcaaagcttcttaaggtaatgtcaattaccagtcaccttgatgattctattgttataaattctaacaatattcagaattgtatttttccatggcaaattttagtaggcctataacttaaggttttatgaaattgactaaataaatgcaaggatatgaacaaaaatatttaggaagtactttgattagagatttgtccctgctgaatgcagatttaattagatgtcatagcaggtgatcactgagcattataaactcccatcacttggctgtgagctgacagcaagttagagattctacaattccttgttcaggactacaggactccaggatggtggagaacaatatcaagaaggaattttcctggtagaacagctaagagataggatgagacatacccctaattgtcttagtaaagagttagggaccagatcatgacttttcactctatcagttcacgttgagacctcctgctagtgctctctgcctgattcttctaaggagtgttgctcctagcacaagtctggcatgacaactgtctactcttagtggttcttttattactcagatagcttcagacattgactttctttgtttacagtgacgtatggatggatggatggatggatggatggatggatggacaaattgctatacagcctctagttttatatttcacaacctcagtaagttattagatgatcttgctcatgacatccttataaaaatttgaaaaattatgaactggataaataagaacagttacaagaattagaatttagtttggtggcattccacaaagactgctcattcaaggagtcatgtttccaaatccaagccagcctcccaaaaaccaaaaatgtaatgaaagaaaaccagagaaaattacattaaatgggcattcagtagtgtcaattaggtaataggagttaaggaagacattgtgttatggagtaaaactctggtaagactctttccatctttggcccgatcctgaaatttctgatagtttctgtgacacaaatatacacaggctgccctagagacctgcgagtatggaaatttgcctctgcctggaaacagcagtgtctgttacaaataaaacacacaaagctcagctcagtctggagggacctcatcagttgtcctcctgaggctggctgtctgaggacccattttgccccgtgccacgtgggctctcccaaggagcataatttataaggatggaaatttcagttggtacatctgataccagctatcccactatgaattctgatggccttcatttattcaaaactcaaatttcagtagcaaggtgttttttgcaaatgtgaagctatttcttttaccccagggaaattaaaatggggttgacaaactgctcactcaacccttactccgtccctcatagaacgtaaacttttatatgcatgtgtgaatgtaaaacatatatatgtgcataaaggcatcatttgtttaatcattggatttattgagtacagatgggtttgtcacaaactgcatgatggtttgtttcacaactcaaatcgataggcccaattgcattgctgtttcccctgggcttctgaattttccagtttaatggggaatgctacataatctctctccatatcttttgccccgttacattttgcaattttttctaaatatgttttgatattactgtaaatgtgaattcatgctaatcacctcactaaagaacatgatttatgttgttgcgaaaattcttcagtatgacagatatattattgtttattaactgaaaatcctcaaatagaatcttcttttttggttaggcatatctttcgtcaaaaccaagagcaataaaaactttagtttttcgcctagcaatcaaattattacatctccatgtggaagtggaaggtagagaggatttttgcttccctagtccatgttttcatttgcaaaagtgatttaaaaatgcaaggaagtcatttggattctgaacttgcttgttcttaatttattttattgtggttacatttcagaatctagttttgcttttattctccatcctccaataaaagtagaccaattatgttgtacaaacttcaaagttaaagagtttgtccaattgtgatggagatatgcaagttcaattttaaggtgaaaaatcttgcagaccgcttaaaggcttctcactcttgcctgacctttctggaaaggcagagccatacagggcccgtgccctgtgcctgggagccctgatgtccagcgggaggtgctccccagcccgtggtttcaggaaagtggggcgggacctttgctaagacagtaagcagctgacagagccttgccccgttgcccggaccccagcttcccacttagtgcctttgcagcaccctccctggcctggctgaaaacagggtcaagctccctctcctagggccagcaataagcaagcccatgctcaccgtgtcctcccgtgagcctccaggctgcccagtgggagcacatgcctcctgcccgtaggtgcccatggagtctttttcacagtgttctttttcttgttctgtttttttttcttcttcttcctgtagaagggtcttgctctgttgtccaggctagagtgcagtagcccggtcctagctcacgcagtgttgttctgtgtcattattctctaatgtagaatcgcaccatcctgggggtcaggcatcttccgcctcctctttgacctagtttgtggcacacagcaggtcctcatcaaatagctgctgaattttattgaaccttatacttaatgccactgatgtgttgagcccaagttcaggagctgacacgttgtatctgttaagtggccttgccttccctctggcatgtctcctcgtgcatcttcagctcacacgccgactgcaccaatgcttccaggaatactggccaaaccctgactctgtgcccagcaccttgcctatggctgatggtgcaaagacacctccccatctttaaggagcttgacagcctttctagtccctttctgggtgacttgtgtgttccatgtaccatctttgctgttgattaaaatgccaacccacgcagcactgagaccagagccctggggtgccgctcttgggatggccctggatcacctggctcctgatttgtcccggaatgttaggaggtgtcatttgcaagctgccagttccgtgctttgcagaacctgctgggtttttcttttgtctgaaccccactgcagctatgcctcccctgtgtcttttatgcctgtcggtatgtccggacagaggctctgccctggcagtccccagcctgttgacagcagccacacatgtctccagaactgcggcccacacgcgtgtccgatgcgaagctcacaccattctgacgtccctgggtgtgtccgcctcgggtccgctcatgctatgcttctcccttagtggtcggaggatgtgtgtgtggcccacctcacccagcgggacgggtaccaggccaccacgcagggacagctgaaggagcagctctaccaggaaatcatccactacttcgacaaaggcaaggtaaaacacaaaaagcaattgtccttgttttcctctttccatgcacctacctgcagtgttgtaaacacgttttttagcgtgtgatttttgcagaaccagaaatttgttacaagttgtatattgaaatgttttatgcatgttccttcagcttgcacttaaaagtagaaatcttcttttaaaaaaaatcaatagcccttttatagatgctctaaaaaagcaccaagtatttttataacccttaccagagggaactaagtctggaacactgattcggaggtgtttccgtgcccacagagctaatgtattcctttgacatcctgcatttttctgttggcacggaagaattaatcccatggtaggatggatattgctccatcctggtggctcctagtttaattggcttaaacaaaattatagattccacttgacttccactaaaaggaaacctgctgtcattttaatcagccagtattatatctgatcactgtagttcttctgattaaggtatgcagtaactatttaaaaaaaaaagctgtttcagtttcagaagtttttaaaacctgccaccgaagtgacattggaactccttctttggtttcatcaagattcctaactcatttcagaacctgttttatttttctttttttcctttgagaaaactgactagcacactttatgaaggtaccgacgttcacatcctagggctgctgtagcacaaactgggtggctttcaacaacgggaatgtattctcatagcttagtgctgggagctgcaagcctgatgtcacagtgttggcgtggccgccccctctgaaggctgcaggggaaaatctgccccgtgccttttcctttgcgtgtgttgctggtggtctctggcactggtcatctgtaaccacatcgctccaagcccttcctccgtcatcacaggccttctcctcatgcgagtttctgtctcagtctccttctccttaggaggtaccagcggttagacgagggcccactctcctccagcaggtcctcatcttcccttgattacatccaaataccctgtttccaaataaggtcagattcagaaatatcaggggttaggactttaaatatttctggggacacagtcctacccacaattgtactgatgcccgggagtgatgatggctgcccctttttgtggctgttgacgtaaaccaaaccccattgaaaacaatgactcgacagagtccccgtggtcacgagcttgggattctgctcacatttggagtaagcgatgcggcatcctttatttgtccctgccattcttgacacagggagaaagtctgacgttttcagaatggcatgtgggctcccaaaggctggttggaaataaggattggaaatgttctgtgaattacacccagtcctgtagtttaggggtccccaaaccccaggtcctcagcctctggtacaggtcgtggcctgttaggaaccaggctgcacagcagcaggtgagcaacgggtgagcaagcaaagcttcatctgtgtttacagccgttccccatcgcccgcattaccacctgagctccacctcctgccagatcagcagcaccattagattctcacaggagaatgatacctattgtgaactgtgcgtgtgagggatctaggtgccatactcctcatgagaacctaatgcctgatgatctgtcactgtctcccatcttcccctgatgggatcatctagttgcaagaaaacaagttcaggctcccactgattctacatgatggtgagttgtataattatttcgttatgtattacaatgtaataataatagaaataaagtacacgatcaatgtaatgcccgtgaatcatcctgaaaccatcccccaccccggtccatggaaaaattttcctccctgaaaccagtccctggtgccaaaaaggttggggaccgctgctgtagtggaacaggatatatttttgttctctggaatgagaagctttgaggattagggccaattactataattgtactaggttagccaggagaatcctgtttctcagcaaactggtaaagaaatggagcaaatgcagccatcccttcccggcagtggcttcttggctccagggtgagcagtgctacagaatgggcagggcagggcagggcaggaggcagggaccctggggtggccgggaggcccgagggccagaggtcacgggactgaaggaatgtgcgcatttgttgatggctgttgccgggctctctttgtggcagcacatcctctgaccagcgttggctcccgcgacctctccaccctcattccctcccttgccctctgcattccagccacactggcccttctgcgtcctgaaatgcaccagccctctctgccactgcccagcgggtttctgctgcactgccttgaggacgttgcttgagtcagttttccttttgctgcctgtaccattttgtcacttgaattagctttttctaagccaggctttctcaatctgggcatgattggcattctgggctacctgttactttgtggtagaggaccacgcgtgcatggtggactcaaggaatgtctccctgcagtgccctgggcatactccttcctgtctcagcttaaatgtcacctgttctccagccacggaaacatcctcttttctcctttatggcacccactatcatttgcaatgatagatttgcttgtgtgtttctttaatgagttccccagtaggctctgagctctgtgaagatagaacctcacgcgtcaattccccaccatgcatctaatgctcggaacagtgcctggcacacagcacatgctcattacattatggacgtgtgtggaaagaatgaacaaatgaatgaaaagtcagcatttaacagtgcttcctgacagatgagaaatgctcatgtatggcaggacaggtggccttcaataaatgataaatcaaaaaacagagtctttttttttttttagcaaaggtagccaaatatcttttcctacattgtgatagttcatcaaaaaaatcatatggaggggcaaaacgaatgtgttcggttcagtacagtggttctcaactgagatctgcaggaggcattgtgggttctcctgactgggggaagagaaggtgctgttaaccctccagcagtgcacacatggcccccacaccacaaagaaatagcccagaatccctgtcgtgtccaggttgagaaagccctccttagaaaaaatgaattcaagtgatgaaatggaatgggcagctaaagcaaaacagactcaaggaatgtcctcagatgtccctgtgttttggtggagacagaacaaaggctatggcaaagtgatcattggctggccttgaatcagaatgagttttaggaggattttcttcgtagtagctgcattgataaaaccgatggaaaagccacttctgaatatccataatatttccacgagaatgttaaaaaggaacaaagcctccttatccctctaaaactaaagtaagatgaagaacaggtgctggaaagaatttgataaaatgaaatttgaagtatctgagtgatcagctgcaaggcaaaaaattcattttaacatcaacaagcattacattttctgggagaaagagcagtaggaaataattcatcttccgtaacaatctggatggcctgcactagagtttgaacctctccgaatctccatggctccaaacagcacaggtgtgtttctcacacatgctccgaatcctccttttggctcggaacccaggtgaacagaggttccgccacagaggaacacagccggagaggacagcaaagagtcccccgccctggggcttctgccccaaaatgacagtgttcatgtcattggctgaaggagatcacatgatcaccccagacttcaaggggtggagaagtgcacttaggggcaggtgagtgtgagcggcacccacgtgcaccacacagcttgttagacaggtgagtctaacaatcaagggcaccatccaatctagattaacaaaagttcatctagaaatcccctaagtatgcatgtattctgagaaagacgacgtccacactagtctcccaaataactcggcttccccacaactagagatgtgagaataacatctcataaaacttgttgggcctcaatcctcgtttctctgtcgtggagtttccttcttccgttaaagagggggcttaggtaggcagaaccctgcaggagaagcagcctgagagaatgggctcctgacccccgtgactgcgatgtggggaatcccaccaggtggccagtgcaggaggaagggggcacacagtagaagctcgaagtgtgatgttttgtgccggacttagaatcacttttgtttaagaaacaaggctgaggcctgagtatccccggctgctttggggatgtgccatcatttgagaaataacgtcctcctgcctttcctaaatgcagtggaatgacaaaggccacggctgaaggttgagaagcttgaagttgggagggcccagggcacacctttccacactccattcccagactgtaattatcttgggggaaaaatactttttaaatggtccacaggtcatcacaggccttagtgggcaggtgacacagcccaaggaaacttgaaggagggccttgattggtgtggagccctgatatggtttcgatctgggtccctgcccaaatctgaagtcgttgtaatctccaatgttggaggtggggcctggtgggaggtgattgggtcataagggtggatttcctccttggtgctgtgtcgtgagagtgagtgagttcttgtgagatctgggttgttcaaaagtgtgtgggaccggccgggcgtggtggctcatgcctgtaatcccagcacttcgggctgaggcggggcagatcacctgaggtcaggagtttgagaccagcctggccaatatgacaaaaccccgtttctactgaaaatacaaaaattagcccatcgtggtggcaggcacctgtaatcccagctacttgggaggctgaggcatgagaatcgcttgaacctgggaggcggagattgcagtgagccgagattgagccactgcactccagcctgggcgacaggaactctgtctcaaacaaaaaaaaaaaagaggggctgtgagacctccctgccttctgctctcggtcctgtgcctgctttgccttccgccgtgagtataagctccctgacgcctccccagaagtggctgctgccatgcttcctgtacagcctatggaactgtgagctgattaaacctcttttctttatacattactcagtctcagatatttctttaagccctctgagcagctgagcaccagagaaaccaactctcaattaattggtaggactctaaccctcactgttgtccagtactgagtcctgagccacatgcggccattgggcccacgtgaaccatctttctaagaccaagtacaaaaaaacaaatgttcttatgggctgagttgcatccccccaaaattcctatgttgaaatcctaaccttcagtatttcaaaatatggctatatttggagatagggtctttaaagaggtaattaaggtaaaatgaggtcattagggtgggccctaatcgaatctgactggtgtccttataagaagggggattaggatacagacacacacagggaagaccatattgaggatacagcaagaaggcagccatctacaagccaacgagagaggactcagaggaaaccagccctgcagacactttgatcgcagaatcctggcctccagaacagtgaggaagtgaatgaatgtgacttgacgcccccagcacctactcagtgcttcattatggcagccctggcaaactaataccaataccaggtgtctcattcatttgtttgtatagatttcatgttgaaatagtaatattttagatagagtcaatattactacaattaattttactctttaaaaggtagcagctaggaaatgcaacattcacggatgtggctcctattggacggtggttcctgttggacggtgctgctctgagtcaaagactttgctcttgttgagcgccaagaacatcgtcagaccagcactgccgcccacatgcggctgggaagcggaagctgcccactgtcctgtggggcctcacaggcagtagaattgcctgcctgcctgttggtatctactccttagactacaggaatatttaaacagcgaaaatatttctgaaagagttacaaaatggggactcaagtctggaaagaataaaatgtatgtcgaaatggcaaggaaaaaagcatgatcacaagcaccaagatatgatgtttttttcctgtgactcaatttcatttctgtagtggtgaaacagctgtcaagactacggcagttaccagcgggaacctggagggaagggtgacttgggagttctcacatggcccttaaggaaatacagatgaggcaaataggagagaggtagaaacaggcagctgccaagataaggtgtaagaaatcaagaaaaagcagcatcttcttgttggagcaagacagagttttccgatacctattttattattaaaatttagaattatgcgcctcggtgatgttgttttcatttgtgctttggataaatcccattataatctcatttttcatttcccgggcttagcaaggataagtcacgtttgctcctcaggatctgtctatgcacgtgccttagggaatagcgagccttccccgctgacagactggctctaagatctgcaccatcttgacccacttctacctgggccacttctgaacaactcgggcctctgggcagaagccctgctgctagatccagttcactttgtgtctccttgtaagctctcggtccctctcacctgggtctgtctgagatccctacccactctcctccccaaggccccatgcctgtctccacccttccgctcctgcagatagatagcagtctggtttctaataaagtggcctctggatcacagcgtgaactgcttcaaagatgcccaaacctcagggattctcccatctcctctgcaggcgatccaggcctctcacctggcatgaggccccttagagtaggaatcgagcctccagatgtaccctctcatcacccacagcatctggccttctgaacatgccctctgttccccaagcccttgcaccttcccatggtctgccccggcgtggaccggctgcttcttgctgctgtctcgtgtgacggctgccatgacagctgccttcctgccttctgggcatatttcactgctctcaaactttcgtggcttttggagttcaccggggaatcttgttaaaatccagattttgattcagctggtctggggtgggcctcgaggctctgcatttctgagaagctcccaggtgatgtcccagctgctccagggaccatccctgagtccccagggcctgtgctgacttaagctcctgagagcagaggcagtggctgtggctgccacctctggatctccctctgagggagctgtaccgtggcctgggctccactccatttttttaaatagctttttaagagtggttttaggctcacagcaacatggaacagtgagtacagccaggtcccagacaccccctgcccacacacatacacaggcacggggctttcagggtggtcatttgttagtgagttgagcacattctggccagcacttgagcaaacagcacacaatcaagaaggtggccgtcacccagactttccacaaagttccttatttggggcatattttgtttgttaacggatcttgcatcctgactcagactgagcccctgggagagcgaaaggccatgcctcccacctccccacccccagcgccgggtcgggggcagatcccaccccactctgccacgtgccgcatcacagttgggttttgtcagtgtgctcctttcccaaggctaacactaacttgactttagcacgacattcactgcaaaggttatggatcagacggagacaaattcttgcaagagcagggctggattttcctgtctagaatcttgtatgttaaaaataacaatcttccgtccaaatgactacagcagtttattaagtgaccgaacgggcagacaagcatgcagggagggccgtcagcatccacagaacttaccgacctgactgagagcgccacgtgcaccaggctcacgtcctgagcgtgtgcccacagcccttggagtgtttacaagaatttccttggttcgatcttacatgtatttcattttaggggaaacaacgcaattccagttttacaaatgtattggggtaaggagacttaagacctcagttaagcttggagaccagtgattaccggggcttgcaagatgataaaatggaagccaggtgggacgtcagtctggcaaaaccatgacccggctacagctccactgatccagcctgtctcctcgtggcccatttccatatgcaattaaggaaatcttcattacgtacttactctgtgggaaggatatacaccctagagctcattcactgtttgaaatgtctacagcttcctacgggaaataggggcttccagaatccaggacaagcttgcctctggacaaggctgagcaggctgttaagggagcaggggtccccatcccaggccccctgcgatggcatctctctgtgctccccgggagagcgggcgggggcagggagagacgggaatcgggtgatattaaagtttctctgcctttgtgcttggaaaccagcaaggcaaaatggatttgctgctgttttatattggacacgggcttttgaatgatgttctgttatctttctgtatttcttccccacggaatcattcttctgtttttgcctttccaccgttttttaaagttttgaatgtctttcagcctagctcttggtttcttaatctttttctttctctctgcaaaatgtcatttccatctgtttccattttcattcttttacgtttcttccttcccgagctaataatgactccttgctctttttccattccattcttgccgcccgcctgagtgtgccccaaaagccttctgtttggttttatcatggcagaccagtgttcttttctgaagatgctctgaattgtctgtcttattgtgtttggttgaggcctagtaattttcgataaagcccttaatccaagtacttgactgaaaattaccaggcttctctgtggaggatgagggtcaaaaatagaagtccttctatgaggaagatgcagtcagagtgagacagtcagtattagccaacaccagccacctctgaaatcaagaaacagcctggcaggttgacaaatgcgatacataatttgtagcccaagtgatatatgaagccctgtgactattttcagctggagctctgttgtattttcccttaaaataaccttcccttgacaaagttcacactttgccttgcaccaatgtaaaaaaaaaaaaaaaaaagcgttttacatcattgtgtaaactaaaaataggagtttggagcaaatttccatttttggtcaaatgtttgcatctcttttccaagtatttggggtgaaattttcacatcttctaagtttccctttggaaacacagttgttattaagagggactgcaggtcaacataatgaagccctcatatgggtttcttgttggcatttctagaatttttgaaaatgtgatattagcagaacctattcagccagaatttggcctgaatattcaaagagatcatatgttcattatgatttgctcctatgcagtaattgatcatcaaagcatgagaaagtccattttcgagtcagtaacaacaatgctcccttagcttatgtgggatcactaacaagcttttccacccaaagcccacagtgtgcccagtgccgtcctgcgccgtgaaataccgagatggagccaggcccacctcgaggcgattctagcatcagggctctcatatgagcagataaataacaaaacccaccttccgcccatcacacaggtgggcgctgggtctccctatcccacaggtgcaggagtgatgccttcttttggagagctagagaagacttcacagaggtggttacatttcgtgcttcttgaagagtaaaattaagtttgccagatgatggctgggaggaacaggaatttcagagtgtgagaatagcgccagaaggggaagagctcctgatgacatctcgcttttccggggaagtagagccattctgggagatagcagtgcaggggactgtcttcgtcccttcatgctcctataacaaaatgccacagactgggtggtttataaaccacagattcatttctcaccattctggacctgggaattcctagatcaaggcactcacagatttggtgtctggagagggccctctgcctgctccacataagtagtgccttctctgagtagtcatgtcctggcaggtgtggcggcgctcttccgggcctctgttttgaggccactcatcccattcatgagggctccaccgtcatgacctaatcaccttcgaaggcctcatctcctaatgccaacaccttgaaggtgaggatttcaacccgtgaatttgagggagacacaaatattcagagcatagcaaagacattggagctagtttgtcagtggccctgtattgtctcctgaagatttggcttacaaggacccaatggaaatttcgtgaaagtagaaaataatgatttcattttcctcttttcagggggtaattctggcaacatggtggcagcagacttagaggagggagggtgggagccagagacgagacgaggggtggggcattgggccaggcctgagccccataaagccagtggcagatggaagtgatgtcatgagacttcaagttagcagattccacagtgtcaaagacccttgaacagggttaaagccagaaaagcaagtgccaggggtggctggggcacccactggcctagaagccaagagttcttgccgggaggaagatgtaggaagggaatgcttcacttgctgcagagagcagatggaggtcctttcatcctttcagcattgagcaaggcagcgagggtgcacactgagcagtcctgtgcagggcatttaatggagggtgtcaaggaaagggagaaatgagcagggtcacagctgcagtgatgctgggtgcatagagagccctgggccagttcacagctgcagtgatgctgggtgtatagagagtcctgggctaggtcacagctgcagtgatgctggctgcattcaagaatcccgggccaggttacggctgcagtgatgctggctgcattcaagaatcctgggccagttcacagctgcagtgatgctgggtgcatagagagtcctgggccaggtcacagctgcagtgatgtttgttgactccccagcctgtgccctggatccccctatcccaggacatctcaccagcaagtctgcactctccctttgcagcacccatgtgttgttctctgtcagctcccaccctcccacctgcaaccatgccattattgctctcacctttaagaagagttctttcttgttccaactcccctgtccagccactgcccatttctcctcctctttctacaacactccgtaaaggatggtctgcacttgctgttcctctcctcctgttgtctctggagtccactccctcaccagtggccagtagctgcctgtggaaggcaggagtgagcagcacggtgtctctttctgtccagttaaagcaccgagcaagaggcaactgtatctcttgctgcctgctttagtcttttcaaggtctttctttgcaaaactacaaatgtcctggcctaaagaaaaaatgtcatatctctgttacaaaaaaaaaaaaaaaaaaatcttcatttttttatctagggcattacaagctcagtgagtagttttctgttttgactaataaggacttgccgtggaataaaggagacatgttgatgaacataagtgacccgggcagtgactcctatgtgatctgagcatgagttacacgggcagcgactcctatgtgatctgagcatgagttacacgggcagcgtctcctgtgatctgagcatcagttacacgggcagcgactcctatgtgatctgagcatgagttacacgggcggcgactcctatgtgatctgagcatgagttacacgggcagcgactcctatgtgatctgagcatcagttacacgggcggtgtctcctatgtgatctgagcatcagttacacgggcagcgactcctatgtgatctgagcatgagttacacgggcagcgtctcctgtgatctgagcatcagttacacgggcagcgactcctatgtgatctgagcatgagttacacgggcggcgactcctatgtgatctgagcatgagttacacgggcggcaactcctatgtgatctgagcatgagttacacgggcggtgtctcctatgtgatctgagcatgagttacacgggcagtgtctcctatgtgatctgagcatgagttacatgggcagcgactcctatgtgatctgagcatgagttacaagggcagtgtctcctatgtgatctgagcatgagttacacgggcagcaactcctatgtgatctgagcatgagttacacgggcggtgtctcctatgtgatctgagcatgagttacatgggcagtgtgtcctttgtgatctgagcatgagttacacgggcagcgtctcctatgtgatctgagcatgagttacacgggcagcgactcctatgtgatctcagcagcgtctcctgcatgacacaggtagtagctcctctatgacccgggcagcgactcctgtgtgacccgggcagcgactcctgtatgacacgggcagcgactcctgtatgacacgggcagtgactcctgtatgacacgggcagtgactcctgtatgacccgggcagcgactcctgtgtgacctgtgcatgtcctgggtagtgggtgctgcatgtcctgggcagtgactcctctatgacatgggtcatggctcctggatgacacaaatagtggctcctggatgacacaggaagcgactcctgtattacacaacagtgactccgatttggcaaggcagaggttcccgtgtgatggggctcctgtgtgacatgcagtggctccagtatgacattgaagtggctgatccatcttgtgcacacttggggtgactttggcatcattactgcaagatcagtcagctttgagctgcagaccgtctttgctggtgcagggaatcaggcctgagtctgtgtcagaaaggtctttgcaaaaagtcaatcctgcacccacatcagtcagtgccggttgagcactccaggaggaccaaggatgaggcttggctcaaggaaaaagcgaggggcctggagagagtggtgatgcttgcaaagggtctccattccttgcagcgtagttgcaggcaacaccaagactagctgggcccttggaatcatccaggcccacctcaccagggccgccagccccacacctggaagggatgctgtcactcagcacgcattgagcaaagaacggactgaacgcagcctcctgctagtcctgggcctccctggctcctgtgctgctgagggacctcccccagagttccagattcttccgcaccagtgattttaatccattttgatgtcagagacctgtgtgggactctggaaattcagaaggtaattgagtatgactcttttcccaataactgctgtgaaaaaacagaacagatgaattttagaagaatgtctgaaattcaagcatcctgtgaggtatctccactggtgagttacttacagctagtcagcaaatgaaaccagagtcgcccaccagtatcctggtgagtcatcgccagcctgaattattagaaagggatggctgtcccggctggcatctttcctttcatctgctgctgttcccttgtcctgtgacatccgtgttgtcatcctatcagaattgtcaacatcacctcatgggtaagaaatcaattcctgctgtgttctctacagctgcttctgtctgggaactaaggaaggagctttattataaaagaaaatttttattcaagtttctattcatggaacttgaagaaatggaacttcctgaaaccaagaggttcagaagaatagagagaagattatcatctcaagagaacacgtctcgtatcatctgggggaaagcagggtggggagaccgtgctccgtgctgcaagtcaaccggcaatttcaagaatgccgtaaattggattaaggatttcgcatcagaaaataaagctttctgctgatatggggctttttcatttggggctgtggcaaacctcataagcctgtagcacttctgagaacggagccaaaccagggtgttcaatcgcagaggttaaagtgattctttcactgagataatctaaatctagatcatattgaatctgccttctctctggcacggaaacattttccaaggtattcacgttggaagtatgaattacccacactctctttaaagccccatccaattaaaagtagatgaaaatctccttaatgcagagtcctttagaacatgccaggggtagcagggagggatgagagatatatatttataggaaatctgatagaagataccaccatgcaacctgagggtgagtctgagaagatatttactcatgacttgtatttcttttaaaaacaattacttttgatatgtatctaaagtatcttctctgtcatttaggataaaaacagattaggcttttactcaggaatgaattagaagccctggcattctaggcagctacagagtttgtatccgcttgcagaaaatttaaaaaaaaataagaagaagaatccagtgtaagagacctacaaggaaaggtaatgttctctttgaaatggaaatctgctcagagaggaagtggtcactggagctttaaaaaaacgttaaaagtagggaagttctcccttcctagaaaatgtgagccggggctctggcagaggacatacgaaagacttagagcagcagactgagatattccaggaatgggaggcaactttaaaccttcagcaggatgggggagacagacagatggggactctgggaagggaccaggtagcagagcagggaccgtaggcaggatgtcttgggccacctcctaccctccctggacactggtcccagctctgaaacctttgtcttctttgggcttacttttattttgttattcaaagtattaaaatgcagctctgattgtagaataacttttactctcatcaaaaaaaaaaaaaagcagatggtttctttacgtcgtggctatgacaagagtactttgggagcatttaagtaaaacagtgttcttaagtttattgggtggctctgaagtgagtgaggacttcagtggggtcatcctggaaaggaaaggcaaaggccagtgagcgggtgggggctcagtgccatgggtgacccaggtctggggcttggcagtctgcctcccctgtgggaacctgcagttcaaggccagcctggactcttttcaaatccatcctggcaggaggtggggaagcagcttggaagtgctgctatgtggccatcaggagcaaggactttcaaaaaggccacgctgggtcaagcccaccgcttatctgctgtgtgtccttggcaagctacttaccagtctgatccctagattccttatctgcaaaatgggtataatgcagatgcccacctgacaaggtgattggaggccttaaaccggagagcacaggtggctggacatagagtaagctgggaaaagccaaaatcacctttgcaaaaaaaattaacagtgaggaaatgatggcagtaaaagagatctgatctaaatcctcacccacctcccacccccagtcatgcctctcctgtaatcattcctgggctttggctaagccaactttgggagacctctagtttaaggtttaaatgataataggccttccctaaaactcagctgccttgataaagctaatgaaaggccatcaggctaggaagaggggagaaacctgaattctgctaaggtgtagactgctcacaaaatatacaacttcactatcgtagatgagccttttgagatcttttcaggttttttgcatgtctgacacctggctctacccagaccaccagccccactcctatggcccacctagaagcaactcagctcaagaggacagctctgaccccctgtgatttcatcagcagcaagcatccattacctggccgccaccaccccttctcccaaactgcctttgaaaagcccctcccctaggaacctttggggagattgatttgagtaatgacaccgtctcccacgtggcggtgttactggccgcaaatctgtatagctctgcagcaacctcagttctcaccttgtcagaagaaggaattcgattgaggggcataacgcagaagaagagaccgaggcaagtttcagagcaggagtgaaagtttattaaaaagttttagagcaggaatgaaaagaaagtacacttggaagagggccaagcagacatcttggaggtcaagtgccccatttgaccttggacttagggtttgatatgctggcctacttccagcgtcgtgcaccccttttccggtggaatgcccctggaaggttaccagttaaactccgccattttgcctctcaattcacatgcttgggcccactcacccagctcctgagatcttatcaggaagctgctgatcaccagcttgtgtttctagctcttgggaaactgcctttccctggcactgtctgtgaccaattattattttagagagacagtgtacacctgcctgaccatcatctgacggtcacctgactttcctggtagggtgtcaggacagccctctcctgccccgctcatgcctgactagctacctgctgtaacagcatggctggccttatgtcaattaaactctttctttactgcaatgccttgatctttttttgtgcagcaggcgggtgggggctcagtgccaagggtagtctagattcgcggcctagaaagcctggcctgttgggtggttccaaagctgcgtggttcccctcaggactggcgctaccgtcttgtgggaatgatggaagttgaatgcagcatataggaagctttcctgattgtaactcagcatcctgcagttctgttcactaaaccttgttaagcaggccctggattaaggtccagaggttttacaggttgataaagctgagcccctgtcctcaagggcttatattctctgaggaggaatgacaaagggtcatgctagtttcagtaccttaccaaaagttttgaggcagcaggatcctgggtctttgtgggagcacagaggaggagagtgggcggcagctaggaaggcttcctggaagaggtggttcctcttacttttccatggttttctccagtaatccgctttgtttttcccaagaaaaataagggaaattcaggccaactatctatcaaaaaattattccacatgtgtcaaaagcttatcaacattttaatcacttatttggaaagttacttaccttacaaagttcccccttttcaaaatgataacaggctttatatccatagcatagtcacacacatacatcaaactttctgcaagctttagtttagagtcgaagtctgccctgttatttctgatcattggtgatattcgacatagcattttttaggtggacagcttgggaaaagagccaagtcaggcgcccagtttctacataaatggcaccccacagcctctcttcaccctacggttccttttccctggctccaaggctgctccgacagacgggcttcgggccacagctggcagcaggagagcaaagacaggagcagtgaggactggctgacagactgctgttaccatggccagaggcctgcgtgattgacatgccagtgattgacctctttggccagctgatgccgcaggtcacgagccaaaagacatgagactcaagaaaatatttgtattttttcggtgttattcccataatgtttcattcaaatgtacttctacactgttttattttgaatgattgcattcctgtttgactctttgcacaattcaggcctcggcttctctttcttttctttattttaactcacagatgtgggaggaggccattgccttgggcaaggagctagccgagcagtatgagaacgaaatgtttgattatgagcaactcagcgaattgctggtgagtctttatttctttttatttaaatgaacacaggcaatctcagctggtttttcaggaatctctctttccatgtcaatgttagggttcaccccaggcactctgggaccttggccatgtccctccgttttgcctaggaagatggttttagttaatttgctggttgatatttggcccataaatatttactttttagtcccaagtcagctcttataaccaaactcttaaggcttctatgaacaaattgtacgtaaacaactgctgaccttgtgtatagcggtcttgacagcccaggagtctgtgaacatttgtactagtttaaaactgaccccaggccaggcgcactggctcacgcctgtaatcccagcactttgggaggctaaggcaggcggatcacgaggtcaggagatcaagaccatcctggctaacacggtgaaaccccatctctactaaaaatacaacaaagtagccgggcgtggtagcacacgcctgtagtcctggctacttgggaggctgaggctggagaatcgcttgaacccaggaggtggaagttgcagtgagctgagatcgcgccaatgcactccagcctgggcaacagagtgagagtccgtctcaaaaaacaaaaaaacctgaccccttctatgagagagggatggatagataatgaccagacctttcttctgccatgggaatgctgttagtttctaattgctacctcctccaccttgtcatttttgtattcagcagatcaccttaatgatgtgggaatgtctgtcatgaatttagaacagaacgattctgttcctttaaattctctttgaacgtatcccactatctgacctataccttttaaaaaatactaagggccagccatttctatggcacttctttggttattgaaaacacccataagtcacaactttttgctgaatttgggctagttggttcagattcccttgcggaatgatggagaatgagtgaaaaataatgtcaaaacgatggagtgagatgaaattcaggtgcaagcctcagtaccctctcccaccatctccctctcccaccatctccccctcccaccctatagaagttgccagagcttttaaagagcccgcaagaagaatccagaggcacacatgcttgaatactcaaacctgaaatgcattttcttttttccttccagaaaaaacaggctcagttttatgaaaacatcgtcaaagtgatcaggcccaagcctgactattttgctgttggctactacggacaagggttccccacattcctgcgggtaaagtttggttctgcctaatctgagccatgattgttcccccagcagaaaatccccttcccgttctgaggaagggtggggagtttgcatccgcgtgggatcgtgcaactctctacactgccatagctcggtggttagcccggggggcagagaggggttgacaggattttatttggttgcatataacctttctatctgatttttccgtaaaaggaccctccttcagagatttacacgtattattttaattgaggtgtgatatatgatatgtgatactatttgccatcttagccatttttaggtgtgtagttcggtggcattaatacagtcacgttgttgtgcggccagcaccaccatctaccttcagaactttttcatcttgcaaaactgagattctgcatccattaaacacgaactccccattctccctcctgccagccccagcagccaccgttctactttgtgtctctatgaatctgactgttgtagggaccttgtattagtggaattgtacagtgttcgcccttctgtgtttggcttgtttcactcggccgaatgtcttccagtttcatccaggttgtagcatgtgtcagaactttatcctttttgaggctgaatggtatttcattgcatggagaggccacattttatttattcattgatccactgatgaacatttgggttgtccccgcccaatgtgctgctatgaagatgtatgtttttaattatatgggaaattggaaatggatctgtatggccacggtgctagaaactccaaaccaggctccatccctgagacaggcatgtgctttcagacatgtaattgaagcagtaaccgtgatcacctgccaggtgcccatttcccagtattcacatgaggccaaaggagaagttacataaatattaatagtgctgcctggcctaccatagaattgtttatacattttctcaagaacacattctttggatgccattgaccagtgggtcatgatttcctgatatttcttatgactttttttttttttttttggacacttggttttctcttatcctaggagactatgtgtgattgctctggctttaggaagcagaagctctgtgtcttgagcacagccgtctggggcagttgaaaccagttgggagattcccctggttccagacgttgttcatttggggtcctgtgtttccgactccacgggagtcactaatagtgtgacatctcttcatcacggcacccagaggatacagacctccccttaggaagggcatgtcactgttgacaggggagcaccacagttctggcctgctctaggaggtgaggctggctgcccactcagtgtcctgcctggtgacggaggcgtctggccctgtcctggtcactcctggtcactgctggtcagcttctcctcttgccttcatcgtgcagcaaagacagcggttgatcagaagcacagattctgaacaaagtcttcccttccaaagaatgaataaaggaggcttagttacaagctctaaattagagacaaatttgaaattagcttcattctcaataaaaaacaaagctgaagggtggaatgagcttggagttaaagccacttactgttgctaaaggctttaattcgagtgtgtgtgtgctccggaacatacatctttaggaaagggaggcaggtggaccctaagccatgcagccttgtgcagtgcttggtgttagatggtgcgtgtggcccctgtggatggagatctacctctggtatgtaggcaccaactctggatccgtgcaggatggttatcccagaatccagagcaagggagcagcctgcgtggaatattatgtgagggcagtgccgggtgcggaggacacgttgcagctcccgagccaatagatgccaggttgtgccaggagctcacacacagcaggctccaggggcggtgctgggtcatctccaccaccaaaaggacaaaatgaaaagtccgaatggaggttaacaggctcgattaatattgaactgactttcccgccacacctggatcattctgtgggtctgcagcaatatatttatcacacttcacagatgagctggcaggggtcaatctgccaatgacactggcagttaccaaaacgtgggcagaatgtttgcgtgcttcatgccctgctggagaggagcctccaagaactgactagctgtcccttttgctttgtttttctctaaaaattggtctcactgttttttgtgctcatgttgatatttatagaccttacaaggaataaatatctttgactatatgtacatttcccccttgttttcatgttcaaaaggatcacttcagaatgcaaagtaactgacattttcagaaaatgttattcgtgtttttacctataactcactagcttttttctattaaagtctttatatacatttttattattatgttttctcatgtaaagcataagaaaaatgcttgctagtttgatagtagtctgttatccattaaatcttactgaattttggaagtgcgtggctttatatagaagccttagaagttgctcagactgtatttaagatgacatattatctggtttctgcttgacttttttttttcgggggggcggtggggagaaatagagcatttttcttccataatggtacttctaagacatatctaagcacaaagtgaaaaagaattcaattcttaaactggttctttttttagcgatttaggagaactcagaataagctggggcaagggaaggggactgtcttagtccactggggctgctgtaacaaaataccttagactgggtactttataaacaacaggaatgtattgttcacagttccggaggctgggaagtccaagatcaaggtgccagcagatttggagtctggggagggccattcctcatagatggcgccttccacctgttctcatggggtggaaagggcaggcagctctctggggcctcttttctgaggcactgatgactttcctaagggtggagcctttccagaggccccaccttctaatactatcaccttggtgattaggtttcaacatctgaattttggggactacaaacgttctgaccacagcagggatcaattgattcagtgtcatagaatctctcttaatccttttgaaaatcctttagttagacaaattttaatttgacttcaatcttagtctttagggggtaagtgtaaaaatatgcagcaaaatgctgtcctctctgtctgtctctgtctctgttcgtctccctctctggcacctgtccaggaatgactgcagatggggcagggctgcagctgacttgggagcagccaacctggaggttcttcccccgtgtcccctgatcaaagaacagaagcacctcagcaaccacgccccgtcctggaaagtgttacccccccaaccccagacttctgtttcttgtacccctgtggcttctgctcgctgtcttctccttgtggcagttttcatttcggttgagacagccccagatgggacaggatgggtggggggaggcagaaggcttccaaaaccagcagcagcattacactaggtactcattggcccctttctgtgaccgagttcacactcagaacacacgtgttgaaatcgggaaaaaaacggagacctgttgtatcttgcaaggaaaacgttccttacaggtatatttacagaggactgtgtcacactcaggcagaaatgacctcaacaagacagcctcgtggaaggaagaacacttacctacttaactcccctccccgccccggactgcctagtctagcctagccgtctataacaaccccagtggactgacattccatcttggaatttatggaggtgacaaaagtgtcatttgagatggaccaaacccagcccttccaagaagagctctgtatgttttatcttgacatgtgttgatgaataatgacctgcacacacattctgaatgcaggaagggaagtcctgctctccgtccatcgccagtcactcactcgggggaggccaggaacttagtagctctcggctctggtctgcatcccttcccctcgggttctgctcgcctcggctgtgtctcacaggagtcagcgcccggcggccgtgtgcaggtgctggggccccaccttagctcaagctctcttaaattccttatggcagaatgaaaacaacttcattagggcctacctgagaagaaaacaaaaacaagaaaaagtgtggacatcattatccacttgtcctggctgccttgcccccttctaaccatttcatgcccattctagtgtgggcttctgagtgctcatttggtttttcatatagtttttaaatcagttgttactgtcaagatgaaaacatatcacagatgttagtagcgcagtgctgagtgcttcttaaacagtattaacttacatgcttgatgaccatgtgttcttgattaacaaagccaacgcaagtacaaaaaaaaataaaaattacaagttgttcttaaatttaatgacattttgtaagaacccgtaaggcatattttaaggccagcatattgcatgtgaactcttcctggccctttctctgtggtgttatgaaatgaatgtcacccttttcagggaaaagttttcatttaccgagggaaagagtatgagcgccgggaagattttgaggctcggctcttaactcagtttccaaacgccgagaaaatgaagacaacatctccaccaggcgacgatattaaaaactctcctggccagtgtatcctttaagacaacctcatcaactctgaaaccatggtgatgccattcatttgggtggttgggtgtggtggggggcctctctcatggttgatgtctatgctgccttagtgatccttaaccccctcacctcagatattcagtgcttcacagtgaagcccaaactcgatctgcctcctaagtttcacaggccagtgtcagagcagattgtaaggtaataatcccatttttcttacccaacgtgagggttgtaagaggctgtgtacagatctcttgctaataattccaccttttaaaggacggactttggccatggattcgctttccaaatgctctttctgtcctctttgaagagcaagggaagctaattattttcagcatccaaaaaaagtgacaggagatgttaatccatgtgctgggagcgtgcaaagcctattcctttcccaaagtcagctgacagcaaaaacctaagagggcagtggaggccgtctggtctcctttatagacctgccctgtggggtacaatcccctagggaacttcacagcagtgcacaagtcctgcctgttcccagcaaagccaagttcatacatgtgagtgtggcctgaatgtttgcattttagaaggcgggaaatgggatttgcacatttgctcctggtgacacacaggagaacccttcagccttacagcacagcaattccataatgtagggttatgagggggcttttaaacctcctgagtcaactgtccatatttgagtgagattttctgcctgtcagttgtatcgcacctgacttagcaatggcatagaaagacctgctttagcagatgtgtttgatattaagacttttctgttctgtttgatccatgttctggtgaaaatattaatctctttgatgacctcatattccttaggatcagcttcattttgcttcctgaagtttggtggtttctttaacctttcatcgtttctttgaccttgcatcagcaataatgggaaataaactgggaccctgtttatttacaaatgattgctctcgcaaggcatacattttaagggttgcaacattttttttcagaggccttaagcaaatagtgacgcttagagccttctcagatgcagtagtttcttttgctgtggaagcctgcctgcatttcagtgcaggggagaaatcagtctcagtctctccacgccctgccctgtgcatgcggaaagcctgcctcgtaccccgaccgcggaggcaggttacttatgtttcctgtgtgtcactcttggggtggttgcaaaatctgtgctttgtagatctgaaactaaggtatgtaatacttttttaaaataataataaacacatacgttgaacacaaaagcttttttctctctccttcgcttcacctttcctctgtttttgctcatttcactcttactcagcttctgttttccctcgagggttggcggggacagggaagaggcaaaaactcaagttaatttttccacctgccaacatttccctggctgggagaggacaccaaggcgatggcttcaggtcaaggttagggacattttacaggaggcagtgacatgttctaaggccagaccccgtgtccaaaagcaaattggctatttgccgggttaaatatctaatgatctgtctgtctctgtacagtttttacagggtgaacgaggtccagcgatttgaatattctcggccaatccggaagggagagaaaaacccagacaatgaatttgcggtaaaaaacaaacaaaccaccaaaccaaacaacaaaaaatatcattccgccaccagtagaactgccactggagaagcgtggcctcagaggcagccacggagccatattaaatgtctttgtgtattatgtgcagaaatcttaatctattaccccctccaaagttagaaaaactaattgccatttcactaacaatatgactaaggtcactgagatatttaataaggagactgtgccgtccaaatgccggagctcccatatgagtagcgcactgccttccctgcgagccccaggtgagagagcaggtgcctgtcatctctagttaaaaatggacccaccgagtgctgaggtgcggggtgctgacgtggctttctgcaggtgacacagcagtcagcacatgaactggatctggacccgggtgctcattcctcattcagtatccagcacctgaacttcagtggagcacaacacacaactgcagggttgaccccagcactactagcaatacggaccgggttattctctgtggtggggaccatccagtgcatccagggatgtttggcagcatccctgaacactgcctactaggtgccagtgccaccaccccagttgggacaaccaatcaaaaagatttccaggccaggcatggtggctcacacctgtaatcccaacactttgggaggctgaggcaggtagatcaaattagttcaggagttcgagaccagcctgaccaacatggtaaaacactgtctctactaaaagtacaacattagccgggcgtggtggtgcacgcctgtaatcccagctatttgggaggctgaggcgggagaatcgcttgaacccaggaggcagaggttgcagtgagccaagatcgctccattgcactccagcctggggaacgagagtgaaactccatcaaaaaaataaagtttccagacattgcaaaataaaacatctgccccttgttgcaaaccacggcattcgagttgtagaaataacagcaaacatctttagagccttttttctttatttttttatttttatttgtttattttttttgagacagagcctcgctctgtcgcccaagctggaatgcagtgccatgatctcggctcactgcaagctccgcctcccaggttcacgccattctcctgcctcaccctcccaagtagctgggactacaggtgcccgccaccacgcccggctaattttttgtatttttagtagagacggggtttcacggtgttagccagaatggtctcaatctcctgacctcgtgatccccccgcctcagcctcccaaagtgctgggattacaggcgtgagccaccgcgcctggccctagagccttttaaaaattctacatacaaactgctttcatggattcatttgtatttttattttatttatttttttatatagaggtggggtctatgttgctcaggctggtcttgaactcctgggctcaagtgagtggatccatgttgaaaaggcatcaaataagccataatttttttaaaatgttaatgtttatccgtcttgcctgggaaacctccggaaatccttctgtactcctgtattgcaaggaggcattagcccggggacccccaaggaggaccggctctgctgagaatggcttctcttgtgtgccgtccgaaggcatctaggctgcaaaggtcaaaggtgaattaacaccctactcctgaccagagcaaagctcggaacccttccagcagggttgcctcaagtaaagagtggtggctacccagtctccctcccaatccctcaggggtctgccagtcatgggatcctcagggcagtacctgtgagtctcctagctcagctcttaagagccatggggaagttccttccagccccgaggccagattccttgtgtgtcaccaaggagcacaaaggagcttggagttggtgaaatctgcagtattgtgcagtcccagcaggctggttgtttgaagattatgttcaccctatttgttggtgaacccagcaccctggacctcctccaggactggtcactacagtgtccattgtctgcaacagtgcgggcagaacctaggcacgtccaacctggacaccctcgctaagggcagtggctttcagagcagactgcacctgttactgtcatcataagcactaacgctagtgtttatatggagtccctcaactgtgggatttataggcagttcttgaatttccctcacacctctcccatctggcaagtagatatattcttagactataaagaaatagacacaaggaggtcaagtgagccactggagggtgcgcggccagttgggtgcagagctaagaataacgaaggctcttgacattttgagctatgctgagcctcagaggctatgcttcttctaaatggccctgaaatcccctaatggccctgttgaggtccgggcacttggacaaagtgttcggaagctgcaggatttggtccttcacatgccccacaaagccttagataagtgcaacgtcttttgctctactgggaagccagcctcggcccctccagcggggagcctggctccaagtgcagggggctggggaagctgcccaccaggccgagagcagtgcgaggtggctcatccctgcagacctggcaaggggtgactgatgtgctggggagtgagggcactgacgaggaggaagatgagacagggcctgcgtgaggaggagctggccgtaaagcccaggatggaacccagaggtccgtctcagggcatgttgacatgagagaaagcactggaatctggtctagaggtggatgtgagagggccagacctgtttccattgccaggacaaaaacctgagggagccgtccccatggggcaaagaggactggtgtgggacacggaggccttgcctgtgtccttatggcttcagccagctccttccctttcctcctatggaacgtaagaagtttgggataaatgctttccaagatccaagtcagttttctgaaaattttttttttttgagagagagtcttgctctgttgcctaggctgaagtgcagtggtgtaatgtcagctccctgcaacctccgcctcccgagttcaagcgattctcatgcctcagcctcctgagtagctgagactataggcacatgccaccacatctggctaatttttgtatttttagtagagacgggattttgccacgttgcccggcctggtctcgaagtcctgagctcaggcaatctgcccgccctggcctcccaaagtgctgggattacagacgtgagccccccacgcttgtcccagttttctggaatgactggcattccattatcccatctgcttaagtctagattcctgttgacactcagactgctcagtgaccctgcagtgcagggaggttggaatggcagaagattgttgcaagctagacagtacgaacgaggcagtaggataaaggatttccagttgacccctgcattggagtttttgtgcaatccttaaagagtagtagaattgtatttattgggttagaacagtttcctgcaataggtaatatactgttttacaaagaacacattgtcaaatgatgtttttatttaaaatatgcatagacacactttttaatacttagtaagaagtcttgaacaatagatactaaagcatataggttatcagcttcaggtaggggatggtttttcctcctgctctttccatatctttatgttctcatataaacatatattagttacgtcaaaacattttaaagtttaaaataccgactggttttatcagaacatcagaggtcactttgattaaatccagtctcccaaagatgtatttgccccttttagtttcttatgaacactgtagctaatgtaagacttctttggagccttcctcaaaatctgtttgctcaagaggggctccccatacctcattttggagtatacacatctttctcactcacctagtatactttcattgtcaaataccagagtggtgggcaatgttggctaggggacaggggatactttgatgtatcctgagcgaccgttaggtagagcgtggcttgtgaggtgctacctgaaggcacacatgccctgtgctgagcaccacagaccctgtcctgctgaaggacctgactcctttggagttattctataaatcccccttagggcagagctgtccacctgctgacatccttctaacccgtgttgtgtgtgtgtgtttcctttgcagaatatgtggatcgagagaaccatatatacaactgcatataaattacctggaattttaaggtggtttgaggtcaagtctgttttcatggtaaggatggccccaccccagaaggaattgtccgttcccttcctcaatacagtctgccacgccttcttcacctgctcatgccccgtggtcactgtggcagcgtgcacacagcagactctacagttcccataaccaccccacctgttcttgagagcatcgatatctcctcgcctagccatattttagtggaaatgctgtgtaatcacgaccaactctagcttatcaaaaaaccagaatgaagatttcatttcttcttacaatgtatttaaattcagtcatagctgtgctgttttgacaatgctttgtgttaaccaagtgaaaagttgaagacaaattccagtctacataaacttttttaaagatttttttcctgatggttttattgccatttacatgacaaacaactattaattaatagtccttgcccatttcaagtaaaaatagcctgagaacatacccctccctgaccctttttaaagaaataacgatttccagctctcaacaaagctaaactttgctttgagatggggcagtttcatttacgtgaaactcacatttgcagtgagctattggacagtttcatttacatgaaccagagttgggctgcagatttattgacagtattgaaatgtcagggccaaggcaactggcaatataaaaacatctgattgaaatctgtacgtttttgttcatgtgtctcagtgccttttgttttcacctggcaagaactcactgagggggtggcacttgccatttagttttcaatgagtccccccgaaacacctgattatttgtctctaggggccggcatctctctgcccagctgcgtgtccagcgccgagccttctcctttgcccacaccagcatgagctatgggcagctatgggccactctctgagaggttgcccgcagtcagagccactgctttatactcaaagcacccagggctcttcacctacccctcctggggtcactttctgctctggagttccctttctgtgcccctagcagccaggcagtgcctgacagatagaaggctgtgggagttatgtgtcaggtggtaaaaatgcactccctttgctgggtccctttgtagctagtgaggcattgtacatgtgagagacaacagaagagcaggccctccacctaaacaggccgtgatcctcttaatcaccctctgcccatgagccctttgtaatcggggcctgccagccaacagctgccggatgcaggagcttagggaggtggagaggggagccctgacctttcgtgaggatgcagcttctcctcgggctgctttggccattttgaacagactaagagggcaggaaggcaaataatcccagaatggcaggactcacgtcctgctaccaaaccctgatgccctcctcgtgccacctgggaccaacccccgtgggatatctgtgggagcagcagctaaccttcttcaataaaaataggaagggattctttctcagtgcaaatgagattagtaacagggaggtaacagtcagtcctggtggaatactgccctggagtgtgcatttgttgaagctgtgtgcccgggatgaaatgtcgtagggcctggcaaagtaagttgtggggtcaggacagcatggctatgcctgctgtccaggacaccggacaaggggccctctcagcagggtgcacgtggctggccacaccagtgcatcacaatctccccaaggctgtccctccatcagtgcaaggacagtgacatcagtgggcagacaacctctgttatgtccacagccacctaggagtgccagtctagggttgctgacggacagaatcgcccattcgctgttcatctctgccctgccccacccccagctcccaggcagtccgctagaggctgtagcaggaagaaagccggacatgaagataccaagggctcttgggcatgggtgggggcccatcacgcttcctttggaaggagcaaagttattgctgaggtcaccctgggacatggtccccgtggcccagtgtgaggaggaggtttggtctgctcaagcaagacctcagggcagctgtggtccctgccttagacccagccacgttgccctggcaccttagggctgagctggagggcactgggctgggactcggccaggccaggccctgtggggccctcagagaaagagggtggaggtccctgagagacacgcactggagccaggaggacagtggtcagtcccctacctcctgcactgaaggtgtcattaaccatggcaagtgtgcaaatgaagcctgtgagggtggcctggagtgctccaagcagccttttcctcccgaccccaggggccatgagctctctttgttgttgtttgtttgttttttggagtctcactctgttgcccagcctgaatacagtggctcaatctcggctcactgcaacccctgcctcctgggttcaagtaattatcctgccttagcctcccgagtagctgggattacaggcatgcaccaccacacctggctaatttttgtgtttttagtagagacaaggttttgctatgttggccaggctggtcttgaactcctgacctcaggtgacccgcccacctcagcctcccaaagtgctaggattgcaggcaggagccaccacgcctgcccatcactcttccttcacatgatggtgtgtggtgccatggcggagccctgccttgacctcctttgccctccctaaccggacaggtagtgcaggctgcccgggcttagattcctcaaaattcccgaacatcttctccctcagcacaacaagcagagaacaagaacaggattggaagtgtctgttctgaagcaggtgtattcaagcactcaaggctgcgtgttttcctgggatgaccacatatgtgcatagccacatgcacacacacagccccgcccccagagctgagcagcagctttgctttgttcctttggaattttcatctctgggaacaaacaataataataaaatgcccagccacccaaaaattctgtttggaagaaaggttcacggaggagcaggaagcctgccccagagcacgtggctcctctggtgagaccctgggagtggaggcagctgtggggctgacatcgggctctcctctctctttgcaggtggaaatcagccccctggagaatgccattgagaccatgcagctgacgaacgacaagatcaacagcatggtgcagcagcacctggatgaccccagcctgcccatcaacccgctctccatgctcctgaacggcatcgtggacccagctgtcatggggggcttcgcaaactacgaaaaggtacgggacccaccagcttgctctgggcaagcagtcctgcccggggacagactgaaaattcccgagagtccccaaagcccagaaacgcccctggtctcattgagcaatctcagcagtggcccagccaaggccaggcagcagcagccagtggcggcccctgaagcctgcagcaaggtcaaggccggagtcccggcaaggctcccctgggcatccccagacagccaggaagcccccactgacccacccaggctgggcttatctgcacccaggcctccagtggcttttacaaggtctgggatcttacaggccaaaagataaagttagacaaaaacaccagaatatcaggactagggaggtagcgctttgacggtggagggggcccggccagctggtctccctggatcctagctctgtaggaatgggcagaagttgaaggacacagggtgtatcctagaccacccctgcctgtgtttgtaactgcagttcttttggaagaaggccacgcctgtgcacttacttacgcctgaggctgttttcctgatactgtaactggcgagttgagtagtggcagcattgagtagttgtgatagagacctgtatggtccacaacacctaaaatgtttaccatctggcctttcacaaaaaaagcttgttgacccctgatctagacagagcaaaaactgagacaaaaaggatactgcctgagagaaggctgcgaggagatgattacccacccttgcacaaagaagtttgttgccttcaggtgtaggtcaggcctgggcaggtgcaggggctaggcaggaggcatgggcgtgtgagtagctgggagggctgtattcactgccacccagcaggaccaagccaccaggtcagctgtggccttcctggaccccaagaactggggttgctgctgtagacagccctgttagctccacttacagtgtttgaccttgtgggacattttgtcctgggtgctgcgaagggtgtgaccctgagtctgcagtgagcttcgtgtggatctgttttatgcacagctctattctcagggcctggcacacagtaagtgtgcaaaaacctgtgtttgctgagcaggtgcactgagcaactctccttgtctccaccaggccttctttacagaccggtacctgcaggagcaccctgaggcccatgaaaagatcgagaagctcaaggacctgattgcttggcaggtaaagtgtccagcaagagtcctgcatggctggagggaaggaaagctaggagggtctaggctcagcacacacaccagccagcatggaggtccctgggctgcagtcctgatgcacgtggctgtgattgtccctgggtgaacccacccactgctgtcgtgatcaactcagctcctgggctgcagtcaggaatttgaacacccagaaaattatctcttgcaaatgaacaaggtctctttcctccccttggtcaattctgccggctgctggaaaactttttctctgtctgtattgatagaacattgaggtgagctcagagccatgaagccttgagctctagcctgtgccaggaaaggcgctcgggccagtgcagtccctgtgaaacgcatgtacgtcagaagctgcagtgcaccctctccctgttctccgtgcacctctggcggtggtgtgcgtcctcatctgtgttttcccagctgaagttgtgcaagttatttcactgttctacttatgctcctggggcctcgggagcctttcccagagggccagcatcttgaaagggcagaccctgggtgccttgggtttaagtgtcagaaccggacggatgcatctgtgcttctcagagccttcctgagcctggaagtgtaggggtcaagagccagtcctcacaagagcttggccggcaccagcctgctctgctgctttaggccactgcctctttaggcttccttttcacatgtgggaggcaaggagggtgctgtccccgagatcttgccacactgtgtaaagagagttgagggaggtgggggcaaaggcctgcatgggtttggaccaggtgtcgtagcccaggccactttgctaagctggggtcccaggctcccagtcaaggcccagagatgctgtgcagttgatctgcacccagtccagaacagggcaagatacaaaattagctgggcggggtggtgcacgcctataatcccagctactcaggaggctgaggcaggagaatcgcttgaacccgggaggcggaggttgcagtgagctgagatcacgccactgcactccagcctgggtaacgagcaaaactgtctaaaaaacaaaaaaaaaaggaacagggcaaggctgttcctcttatgagacatcaccgtgagcagtttatttgtttgtttgtttgtttgtttgtttgttttggaggtgaagtctcgctctgttgcccagactggagtgcagtagcgtgacctcagcttactgcaacctcctcctccggggttcaagtgattctcctgccttagccttccaagtagctgggactgcaagtgtgcaccaccatgcccggctaatttttttgtacttgtaatggagatggggttttgccatgttggccaggctggtcttgaactcctgacctcaggtgatccgcccaccttggcctaagtgctgggattacaggcatgagccactgcaccaggccactgtgagcatttttattctgacatcccagcagggcctcttcttagtggcctctctgtcatcagcacattggccaatgagacgtcttagagtggagcaaggctgagctttggttgtgagccaaggtacgagtcctcttaaatttgtgtttagatatataggatgggttggatttttataattctaagtgcttatactgatatgtaaacataatatacattatgtatatattataaataattgtgataaaatatacataacataaaatttcccatcttaaacatttttaagtgtccagttcagaggcaataagtacattcacactgttgtacaaccagcaccgccaccatccatctccagagccttgtcatcttgcaaagctccaactctctacccattgaacgacttccccattcctccctccacccacctcctggtcaccaccattctactttgtgtctctatgaatttgcctactctagatagcttatatgagtggaatcatgtaatacttgtccttctgtgtctggcttgtttctcttagcagaatgtcttccagattcatccatgttgtagcgtgtgtcagaacttcattcctttttaaggctgagtaatactccattatagggctagaccgcaatgtgtttctccacggatctgtcaaggaacaacatgtgggttgtttctaccttttggctggtgtgaacaatgctgctgtgaatgtgggtgtataaatacctgctcaagtccctgctttcaatactcccatagtttggggtatatacccaaatttagaattgctggctcatgtggtattctgtgttttctttttcacgaaactgccaaactcttctacggtcacagcaccatttgacattcccaccagcagtaatgcatgattccaacttctctgcacccccaacaagacttgttattttgtttgtctttttttttttttttttttttttttttgagatggagtctcgctctgtcaccagcctggagtgcagtggcgtgatcttggctcactgcaacctccacctcccgggttcaagcgattctcctgcctcggcctcccgagtagctgggactacagatgtgtgccaccacacctggctaatttttgtatttttggtagagatggggtttcaccatgttggccaggatggtctcgatttcttgacctcgtgatccgcccacctcagcctcccaaagtgctgggattacaggtgtgagccaccgtgcctggcctgtttatcttttaagtaatagccattttaatgagtgagaagttttatttatatgtatatataaacaaaaattatattaaaagggaagaaatcagactttgtcacaaatctgcatttgaaatctgtttgctttggaattatggttttgaacgtcctcagagtttgactgaaagggacattgttggccaactttggcttctttgtatggattgtaagcctcatgtagacagtctccctctgtaactaaaaaagtgggagagagtttaaaattgtgaatgattccattttagatgttgtagattttttactaaagggtacgaaattcaaaattcctctgcaggctataaaactattgctatacaaaaactagtttggtctgcaaaagttctattgattttttttttcctataagcttttacagcaaattggattttaagagtttcaagtcctacagaggaaaataatttgttccccagagagcagctttatgtcagcactatgtcatcattcctaataactatattaaaggatgaattttaaagcaggtcacaggaaaggtaaaagaatcagttttctagtaacttcattaaatcaaagagtgatgaaaaatgcatattccaaacattacctgtgattttgctttcatttgcaaatgtttggaaaacccgtatcttggtattggcaactgagtcatatgttcattaaaaataagaagtttgaatttatcagaatgctttgttctctttttgtttattagttcatctggtttggttttttcctgaaactatcagggcagagtgaggtttttctcctgggagtcccaggactcatgtgcagagttttcatcaccgatatataataagctcagctctgatgcataaaatggtttgtgaaggttggttaataagtcccaggcagctcctcctcagccctgcttgctgcctcagaaacagaggatgggctgacctgctcctcgctgggtgggaggtggcagtcagggtgcacactgtgtggtgcctcttgtaggtttgcggctggcaccaggtcatgagtcactttctcaaaggcacaattccatctttctccatacacagctgtcattgtggagcatccctgccgagtatccaaagacaaatccatacagtctcatattaaactgctgtgatgtatacatatttctcttttgaaatgtacgaagatgaaaggctgaactcagccatcatccccagctgatgacaagcatgactgttgtgtccaggggtggtgctcctggagcattaagcaaggcttccagatgttctgtgctgctttcagggcatgaatctgtgcaggggacagacaggagcaaacttcaaatacggcccatcaggagggcgtctttgtagagcaggctgcaggctcgctttgattaattagaggtgtgacttagggaaagtcctctcccatctctgggctctgagaaactctttaggaatgcagattcctgggatctgcctacagcaaatcagggctctggaggtggggttcaggaatccacctgagattctgatgcttagccagagtggaacccactcaactacagggtctccagagaccatttcagaccctcggtctatgttaagtgctttttgtgcattggaatgtgtttactcagggcatcctcttatcttctttcatttagaatcacacctgcagttcagccccaagtagacatataacagggaaccagttcctgtcctatcagaaggttatttcccatcaacgtcaggaactgctgagagtggtgaattctcacacctggtaaatttcacctatcagattgcagttcgagcagcacaagcgtcctaaaccaaaaggtcttaactctcatctgacaagtaccttctttgacagaaagaatctgaccattaagagttttatcacaccaccatcaacaccaacaacagcaaaactcaggaactagattacattttgtagtttgagaaaggcccgccctaaatcagaaatgcttttagtatctagggtggctgtgctttcaccttgcaacagcacctccacacatccctgcctttgcatccagagagagacccaacacattcgacatcccaccaaaagttgtcccggtctgtctgcgtcatcccccaaggcggaactcaggaggcagaaggctgacagtgagcattttctactgctggccctgagtaaaccgcggctagccccggggaagctgccatctgcacgagtaattcatagggaatattaaaacatcccaagtattttgaaatctctctgtatgctgtcctttcggtgataactggccagaaaggcctgacatgtgcctagggtttggggccaactgtcagcaaaacaaacttttgtgtcggtgcagcctccaagcaggctaggagggctatgagcgaggagagcgctgctactccctcctttcctggagcaccaagagaggcaacagctgtgtgctataaatggtaaccaaatacatttgatgcgttgattcatcttgataagatttcttgaatttgctcacatgaaattcaattgtgtacttattatcgttcatactaataaatctgctcatttagattggtgttctgtcctattaggaaaatctgtttttaatcagtattttgatttaattataaattattgagaggaagcctcttagcttgattacatggaagaatgtctaactgagtccaagccctggggggaagcagagaccagggacagaaagggagacttttccttctcccaccccacaacagcagcaactctggtgggtctctgcagctgggagaatgaaaatgtctctcttagaacgtttttaaaggtcagcttcatctccactctcggaagtgaagtgttggcatggatattttgtgacagcagtgtcgcagagaagcgattatttttagttttaaagaagaataaatttggttttcacttccaaaaaaggaagatttttcaggactatagatcacatgtaattaccttttggaatagggttctcgtaaaggcaatattcttagctaaaaaatgttcgcactctgacatgaccctttgctaatagaacaagttacatctaaacaaattcaaggtgtagctcttcccaaactcaagtgaaaagcacagataagtctattctgggaaattaactgagtagccgtggtgtagggcgcaccacactggacatagtcaattcagaacacaaatggttttcatgtaaacattttggtctttggtggtaatatgcctgctggtaaattgaatcagctggtttgatttggaaaccaaagcagatcgttttgccagttcccctttccccaagtgtgcattgctcgtcctagaccattatccaagaaataaggaatgtcaacctctctgttttccagattccttttctggccgaagggatcagaatccatggagacaaagtcacggaggcactgaggccgttccacgagaggatggaggcctgtttcaaacagctgaaggaaaaggtggagaaagagtacggcgtccgaatcatggtaagagggtagtatgcgtagtgttgcagaagagtgggtgtctgggcatcccactgttgaacagggacaagcttccagagcagaggaactcacatgtacacatggtgcccgcttaggaagtgggatgtgagggagctcagcccccttgggcagtcttgtctaccggcaactcagcaacctcctttcaataactggaaatgtcagggcgaataaacattcatgaatttccttgattaccaaatgccccctcacctgctgtgaacacagtccaaccttattgttgcagagcaatggagaaatctcacagcgcccaggcaactcagctggttgacagtgcacacctacagtcatacaatacacacagagggttcggtcatccacagggcaacagcactcacgacggcccatggcagaggtagcccagcccaaggttgacatcagaggatcatggccatcgaggaagaagtgaccaacatctggagtgtgaaattattagtgaagatttacctattgtaggaaggggtaattgatctagaccaaggaagataagccagatgtggtcaggggaggagatcaagaagacactgcctggggaaaggactccctcaacagaggctgagaggcaggagtttgaatggcaggccaggggccagtgcagacacaggcatgctttgggcagaagagaaaattcagagcggagatggaaaggcacccaacctccaagaacaagggatgctaggctggggcaggaggctctgctcgggatgaagggcagaactgagcttttgcaatgagtttatggaaggtttctgagcaaaggctggcatcaggagcagggtggagagcagcttgagttttaatgatgcaaaaaccttgcagttcaaatcttacagcccacttgagactgtccccaggagccatgccttagcagatgtgggagcaaagccaggcaccgtgagtcacagtgctgccctgctttgcagctcagagtggtgctcccatctttactcagtctctgggagctttgctgggcctaccctgcctgctcgggaactgtggagacaccagacacggcaaagggtccccactccccattgttcagggatgaggggcaatgtggcacagagaagcagggagctctcttctgtctactggaattccatgcctgccggcactgagggggtgtgcacagggcttcaactccccggcaaaaggaaggcgagctgtgggaagtcgcgctgcttctcccaggtaacatacggcactttcctctgctccttgaagaccaggtgtcgagtggggtgtgccattttggtttttttctgggcccagggccgcctgtccaccagtccctgaagttctcagctattctctattgaaccctgttttctttgacacattgatctcaataagcaaacagtaatttagtgctccccacgtgccagggaccttcctaagtgctgtatagatactcagttgcttaatctgcctcacactctgtgaagcaggcactgcagtcacctgcattttacagtcaaggaaacagggacatgggaaggtaagtaggtcacaccctagcacgtggcagacccatggttcaagccctatccatgtacctccagggtctgtgcttttagcccctactccaggggctgacatttggcaccacagagcttctccgcctctttcccacatggtaggaaatgcatatgagacctgggcaacccctgagagaaggtaatttggttatgatcacactgcatgctctcccagtctccccgcctctgccgggcatgaccgaaccttggtgcctccaagcctaggacctggtgtccctcagatgagagggtcccaggcccagcagggcttgaacccaacaaagccaacataacacaactgctgctctgaggttgaaaactcagcaggtgggagtctggaactgccagcccagcgggagctgctgcaggtgaacaggcctggaaatcagggctctgtccttcaaggctgggctggaggatcctttgtgcaagtcagaatgctagagtagcgcttgatagcttcagagcctgcaactcattacagtcagagctgagtggcaagaagcgtttcggagtgcgtcacatcgcatctctttcaaagttgatgcctgtattaattcattctaagaaacaaacacttgtgaaatcttgacattttcttcctaagtgaaaagcttcctcttttctcagtcatttaatgtatatttcaaaatcacagaaagctgtctggctcaccagacatcctgcatattcccttctctgccacattcatgagttctgagtgtgcttgctttgggcacaggtggagaaagcaagggcaggaaggtagggtgctgtggattggtgtgctgtgtggattggggtgccgtgtgaattggggtgccgtgtgaattggagtgccttgtggattggggtgccgtgtggattggggtgtcatgtggattggggtgtcgtgtggattggggtgccatgtcgattgtgccatgtggattgtggtgttgtgtggattggggtgccatgtggattgtggtgttgtgtggattgggctgccatgtggattgtgccatgtggattggggtgtcatgtggattggagtgccgtgtggattggggtgccgtgtggattggggtaccgtgtggattgtggtgctgtgtggactgtgtcatgtggattgtggtgtcctgtggattggggtgctgtgtggattggggtaccgtgtggactgtggtgctgtgtggactgtgtcatgtggattggggtgccgtgtggattggggtaccgtgtggattgtgccgtgtggattggggtgtcgtgtggattggggtgccatgtggattggggtaccgtgtggattgagccgtgtggattggggtaccgtgtggattgtgccgtgtggattggggtgctgtgtggattcgggtaccatgtggattggggtgccgtgtggattgggatgccgtgtggattggggtgccgtgtggattggggtgtcatgtggattggggtgctgtgtggattggggtaccatgtggattggggtgccgtgtggattgggatgctgtgtgtccttggttggagcttatttccagcacattgtgaggcagcaccgtctccatcaacctccccacccttctctgtagcaccagctgggtcaccccgtctagggggtgggaggcttttacagaatgaaggttgcattttccaccctgagatactttgttccccggacccaccttgcagagtcctgctccatcctttgaccgcaacagcaggctctgcaagcatcctttgagagtcaaggggactggcaggtccccttgtccttccctgagaaatgtggcaataaaacgcagtctgggatgtgcctttcctgtcttacctactttggaaacttgcaatcatctcagagcactttgaaaagcaatctagtatcaccctgtttgcaaaaaagatggattttaaaatttaaaaataaacccatagaaaggacataaaccattttgtcagtgtttctgagccagcttaagccatagaaagagaagatgtggacgccctctgacttctcgatacccaggcccctctgccactctgccttggctttcatcgtgttcccagtcctggggctccaaggagctgccattccctggatgggagctctgcagcccagcttctcctgacctttagggagcgaggtgtgcagggccccagggatgagcccatgagcacctgccacgttcggcattggcccccgtgccctcaccggcccacagcgccacgttcggcattggcccccgtgccctcaccggcccacagcgtgcaggaggcatgtgtgttggccttcaggcttgtgaaaaagagctttaggtttctcaccaaaacttcatctacctcttcaagtccgattaggagcagggaaattgatcctggttctgcattctctctactcccatccacctcatcactccaaacaccatggagagccataaccccaagatgccatcgtccccctctcccctccccacctacagtcacaacacccgctggccacccagacccgggagagaaccaggagtcacccttcctccctcaagttagttctagctgtggtatcccctggtggtgctggggttcaccccaccatctttgccatcacagttggcccctgacctggcccccagcttccaggatttctcctctctcgccctccctccacagctgccggggggacccatcccagtagttctcttaactgggatccatgagaccctggggttcctcagaggctgttgggaggggtgttgactgggaggtggagctgatagcccctgcctcagcaggaacatttagcttcacctattccttgtgctggagttccatggtgaggagaagcagtgtggcatggcctacaagaacagccagggaccagggttctgtttcagatgcagagctgatggtgcagttgtgtccttcagtcttgtggcctctgagggccggccaaggttctaacatcacactcgcaccctccctgctgggcctgcccatcttctgccccaccccccagcccctcctcccccacctgctctctccaaaggaaaatgtgtcaccctctgtggatttccaggctgtagctggcatttgtatagcatctggaaagggacattccagatcacgatgaagtgtgcctgcttcttacccttccttgtacagcactggtccctgtgattaagttcagccaaccccttcaacccagcccattcccatccaagactctgggcagtaaacacctgtggctggctcaaggtgggacgttacagctcagccgggagacagcgacgtaaaactcagggtcattaggcagggccagaggatcgctcctggtcagaaaactggaatgagtgtttgctcaggcggtgaagacagcagcagccatcagggtaaggagccctgtgggcttccccggcatcatttcatttagttctaatgctggccctctgggcagggaagactgctccctgtgtgctcaggaggaagctggggctccgagtggctcggggttttatggagggtcacaccatcagtgccagggccacaattccagcctagttccaatgtccccaactcctacccaccagccctactttcagtcacagtgtctggccgtggagtcccacctcccaggactggttgagaccctaattgcatcagatgaaacaaaagtaaagccctgatgtcttgatttctagaggctcaatcaagaaggaattatgcggcagaccgcccagtaaacccatggtcgcacccagggagtgccctctgtctctccttgacgggagtcatcctcctgccaacccccttcctttattccttgaaatccatactcacacatctcaaccaagacctgaggtcaccttctgagattatgtatggggtaaggttttcacagttggggataatccccaagcaaccatttcccttttagtttcttctaaaggcagagtaattacagtgaacatctccatgaagctatcccctggcaccatcattggtgcaggtccaagactgaccagcccctctctgctggcaaatcccagctgcacgtcactcagagccagtggtcagcaaactgtggcccctggcgtggttgtgtaaataaagttttgttgacaggcaggccatgctcattcatttctgtattatctgtggctgcttttgtgctgtcgtggcagcgcgtgctagtttccacagagaccatatgtcctgcaagcctaaaatacttacctggtcctttgcagcagaggtcccagccctcaggcagtggactggtatcagtctgtggcccgttaggaactgggcccacagctggaggtgagcggcgggtgagggagcattactgtctgagctctgcctcctatcagatcagtggcagcattagattctcatgggagcatgaactcgattgtaaactgtgcatgtgagggatctgggttgtgcactccttatgagaatctaatgcctgatgatctgaggtgcaacagtttcatcctgaaaccatctcctgctggtctgtggaaaaattgtattccacgataccggttcctggtgccaaaaaggttggggacaactgctttacagaaaatgtgggccaattcctgcccttttacaattttgagcttcttattatgaaagagatagtttacacatcaaatgctgttttatttgggatcacatatttaagaaaaaggcccacttttcagaaggggaagtggcgttatattaatcttacctgtaatctaccgcttctggccttggagggctggaaccatggtccacagcaggtcttctgtagttgattggctgaatgagatgggcggggtggggttgcagggtggggaagtcaacgccacacagagaggaagtgccctacaggaacttagtttccacatcctcaggttaaaggaaggtccttgtgcagcagctgcagtcccagatgtgccaacatctggctcggggtgcaggtaccctggaattttctagctaatgagatgtggacacatgctgtatttcaaggacacttgcttctgtaatatgtcaagaagaagatggaaaagtccatctagagatcttttttttgtttgtttttggcacaatgcatcactagttcactacctagcaagtgggagaagctttagcaacttcagcagcggtttcacctactcagtggcttcagtcacttgcagaaaggaaacgtactcttcattaagcagcaggagcatgttatttttgtctagaggaggtcagtcattatggattcatgcattttgatggcccgtgtagtctgtcaacctgcagagatacacaaaatgcatctaaagatcgaaagactctttaatcactctctaggtgttactctacattaaactttctggtcggcacattctcctgtggctttggaatgtgttgacgcatcgcggtctttgaagaaaacttgcactgtgtattaaaaggctaagaaggttccttctgatactttcacagtattgggttaggttttaaaagactcaaaaataatcattgtttttgtcttccactcagaacaagaacatgtactgtttacagaagtctgaacgatgatggtctcgattccacacagctaaggccactttatctcaggagtctgaccatggcaggcacaggcatcaaacaagtctccttctctctctttctcgctctcagccctcaagtctggatgatagaagaggcagccgcccccggtccatggtgcggtccttcacgatgccttcctcatcccgccctctgtctgtggcctctgtctcttccctctcatcggacagcaccccttccagaccaggctccgacgggtgagtcaagctcacagcagggctgagctgagcagtgagggcttgggggatctggaaggagccacccagggctctgggtttattttcttacaactgaggattttgtgttcatcaaaattatctttgaaactgagaccctccgagactttctgaccgtagtgcccaatattactttgaggtcgtgtgagttgttgagaaaaacatcctctctttgggtaccactttgggtgaggttttcatccaatttagaacctccagtgagtgttcagtcctcttcagcatggcttagaacaagcttgtccacccgcggcccacgggccacatgcagcccaggatggctttgaatgtggcccaacaccaatccataaactccttaaaacagtatgagattgtttttgtgatttcttctttttttttttttaatagctcatcagctattgttagtgttagtgtatttcatgtgtggcccaagacaattcttcttcttctaatgtggctcagggaagccaaaagattgggcacccctgggaaaaagcaaggtgcagtccgggctggccaagcactttgtacttttcatctcctgttcacctccagggtgttgtgcccggacaggagctggtgtggtctgaccatgacacaacctccactgtccccctgtgacaccattctgccaagccaactgtcacagagtcaggctttcatgatggatggccgggccttcttttttttttttcttttcctcccttcctcatttttttggagagcaaatgttttgtttatttttgtttctgctgaggtttattgccttttaaagggaaatggtgtttaagtgaatgcttctgagaatgaccatctgtccctactttttaggacaactctggaaaataaaaggcatattatcctttttaaaaaattttgtttttgaggcagactctcactctgccacccaggctggaatgcagtggtgtgatcacagctcactgcagcctccacttcccaagctcaagcgatcataaccatttgtaagtgaacagttcggtggcattgcgtacgttcacatcgctgtgcagccatgaccaccatccacctccagaactctttaatattgccaaactgaaactctgtacccatttaacaacaattccccactctttacctcccatattgattaaacactaactttgcattctttccccccacccctgacaccctgacaatgtctactttctttttttttttttttgagacggagtctccctctgtcgcccaggctgagtgcagtggcacgatctcggctcactgcaacctccgcctcccaggttcaaacaattcttttgcctcagcctcccaagtagctgggcctacaggcacatgccaccatgcctggccaattctttgtatatttagtagagacggggtttcaccatattagccaggatggtctcgatctcctgacctcatgatccgcccgcctcggcctcccaaaatgctgggattacaggtgtgagccaccgcgcctggccaacgtccactttctatcactatgattttgactattctaaatactcatgggccaccttctttgtacaaggccactttggagatgcatttttgctcttgagtacccaatagttaacatttattgagcacacactgtggctctggcattagctcaggttattgcaaagagaactgcaacattggtatttttttgtatttttgagcggcaagcatgtaaagtttgttcttctacaaaaagaaaaaaatgttgcatgcaatttaaacaacacagaagaacctctaattgttttactgctgatttgtacagttgtttgtgtgtccaatcccattttgtttacaatccatcaccctatcaaacccacaggcatctggccccctcaacacacagaaacaaacttccagagagccccaagggacggctcaactcggattgccctttgttgccaacgactgatgtgcccgatggagaattgcaaactatccccatattttttcttaacagtaatttttatcagcgtctgatatttataaggccaagtccatatggaaattctcaatttagaggtatttaaatcatgtgtgcttgtcacttacagcaagattgctaaagaaatttaattcaacttctccccgagaaaatccccggactggttatggaaaggtttttatatttctaggaacataggggttagggtggaaattaatggagaggttttagacagaagagtggtgaattgcacatgtgagctcgggctgctggctcttccccagaaggcatttgtttaacctttaactggaaggcgtctttattacagtccagatttgtgttcattcttggggttaccaccctttgctagctaactaatgtggagaaaatgaggctttggtctcaaatggcacaggttacatgcagaataaagttcatcctgtaggcagttgcttctcgtaatatgaaaatttaaaactccacctgcctttctctgggttctttgtatacgcatcaggatttcacaacccgggtcttctccctgagctaaacagcatctactaatccttttcttacctacattatctcaagttctgctaaacctagaataaaatcatgaaatgtttggttgttgcttataatagataaaatatttctcacctaatggatatggatgtattgtatatccagtgcgaaaagtccagatgtcccaaaatgccttaatgatctaagtcaatattggtatattttatcaatcagtttaaattttttaagcattttagtatagaaaaatgtcaaagctgagtacagtggctcatgccgaaaatcccagcactttgggaggctgaggcaggtggattgcttgagctctggagttcaagaccagcctaggcaacataacgaaaccccatctctacaaaaaaatataaaaattagctgggtgtggtggtgcatgcctgtagtctcagctacctgggaggctgaggtgggaggatcacctgaacctggagaggttgtggctgtagtgagccatgattgaaccactgcactccagcctgggcaacagagtgagactctgtttcagaaaaaaagaaacatttcagatatgtacaaagtgggccaaacagtgtaatgaggcccccatgccccatcatgcagtcttgacaattatcagcttttaactaatctttttttttcaatctgtatcaatcatattttccagcaaatctcaaatatcatattttatctatagctatttcactatgaatttctaatttaaactcttttttaaaaccataactcggttatattatataaactatagtaatatagtttatttcacaccaaaaatattgacaggaattccatattataataatacatgagtgttaatttcccattgtcatgtctttttttttagttggaggcaaaatccaaataaggttcccaccttgtaccttgcacttggttgatattatctctttaagtctcttttagtccccttttctcccttgtaatttatttgtgggaaatcctaggttgtgtatcctgtcatggtccccaccatcaggactctgctgatagcgtgccctatcgcattgtttaattcgcgtctcgattctccatattccctgcatattggtggttgaatctagcgatttgatcagattcagatttgatttagggacaagatgacttcataggtacttgtgtgttcttccattcagaggcacatcataacctgttctctctcttatggagatgttaacagctattgataatcagtgcttagattcaataccattattgtttacatagtgacctgcagcagatcctactgcacagccatattagatgagagaagcaaagaataggtggtggtccttgctctgggtagtctgcatcttcagcagatttaagcgcagttttgcaaatgatccttcccttcctggttcatcttactccccattatgggacacgcaacatggaaataatcaacagtgagcaaatcaatggggagcaagattgctgcaatgaccatctttttttttttgagacaggatctggctctgtcacccaggctgtgcaatggcacagtcttggctcactgcaatttctacctcccaggctcaagccatcctgccacctcagcctcctgagtagctgggactataggtgcacaccaccatgcccagctaatttttgtacgttttatcgagactggatcttgccatgttggccaggctggtctcgaactcctgagctcaaatgatccacctgccttagcctccccaagtgctaggattataggcatgagccaccatgcccggccctgcaatggccttcttaatgagaacagtggctttcttccaagtgtcccattcagaaatacatgtaagagaaactagagctaggatgaaaatatgactggctggctaaattatcttctcttgaaatcatgctccccttgaagaagccaattgcttctccaggcggtcaaggaagtcaggtttggaagttgctgtgaggctcagagctccaaagagcaggctgtattttgaaaatgtaagatcctagtaacagcactgccttccacgtgagttatgctatatggtttttcaggcgggcccatgccttcatccattcaaccatctctcctgactcctcctcacagcaggagctgctagggatgagactccagtcttagagttggatccatttcttccacctcctgataggacttctaggaccagaaacaggatggacatgccaatcttgtgttggagtgacaaatcacaatcatgtgtggatatgcttgcacactaaccttttggtacatgccttagacactagcctaagattcatttactccatggtataaccacgaatgtgtctttacagcaactgtggggtaggcagaagggtggtggtgtctttatacccttttataagtgagacagctgccagaggttacgaggacatcaagagtcacccacagtggcagacctagaatgcaggtcttctgtctccagcttagttgctggctggaaacctcagggcatctccaagcacctgtgagctggccctggcttgcttctgactgagccatgcaaagtgctttcacctgaaaacaaccgtctatctgtaatcatagagccttggtcaggatcaaggtagcagacatttctttgcattgacgtctatttttccccattaaaaaatagacaaaatatttctatataaatctctaaaagacgagggttccccttttgaaatatgccctaaataccatcctcccatcgtaaatgaacaattccttaatatcatcatcaaatatccggtcagacttcacatttgccctatcgtgctaagtgttctatctttttccagtttatctgtgttgggattgaaacacagtccttgcatctggtgactgtgtatctgaagtcacccttggcctcccttttaaatcactgctttcattgtaaatgtcttcgatggattgtgagtgactttacacgtgtctgtgggctggaaagcaattgctctcctattaagacgtcattgacctttcctttaggtttgccctggagcctctcctgccaaagaaaatgcactccaggtcccaggacaagctggacaaggatgacctggagaaggagaagaaggacaagaagaaggaaaaaaggaacagcaaacatcaagagatatttgagaaagaatttaaacccaccgacatttccctgcagcagtctgaggctgtgatcctttcggaaacggtaacccgacagggtatctttcctcgctctgcggtagcttcagggacctacctttgccccacctgtagccaacagggctgacagtgggctcttattgaacttgttataaattagcaactcagaaacctggggtcctcctcccctaacctcaaatgtcccaaggcagtaggacagccagagccacagagagacctggaggaaggtgggcttagcatttgtcccccttccgcagggcctggggcgaggccgctctgctgctaggctctgccgctctgttggacttgtttcctacacatgtcctaatatcccagaagatgagcaggagtccttttgttgtcaggaaacagtccttggtgtccgctaatgccttccccttgccccttgctgactggaactcttctaagctagttacggcccaagtgttaaaatcagcggaactagaatccaaagacctcttcccaccgggccccagaagctggacccagtcctggggtatcctgctctgtctcatctgctccacctttaaatctcctggccgtctttcacaaggacttaacagggacttcacatgacccgtactgctgagctgaccttgaagacgggtcccagtgagtctcgttcattccacagtcgtgggcgtgtgagggcggtgaaacccaggagccggctctcatcctggggctgggcctgagggctgatcctcccagaagtgcaccacattgggaatctgtgttcgtctgttttgtgttactgcaaaggaataactgagcctgcgtcatttatgaagaggttgatttggctcatggttctgcaggctgtacgagcacagcactagcatctgcttggcttctggtgaggcctcaggaggcttttattcttggctgaaggcaggggaggggagcaggcgtgtcacatggtgagaaagagagtatgggtggggggtggggggtgtgttccaggctcttttaaataactaggtctcacatgaactgatagaatgaggacccactcattacccccattactgcaaggacagcaccaagcccttcacgagagatctgctcccaggacccagatgcctcccactggccgcacccccaacatttcaacatgagagttggagaggacagatatccgagctgtatcagagtctgagtgcgaagatgaggcacagcccacttccagggcgaacttgattccaaaagtgctagctgtagttggaaacaaaaataaagaaggagttctcatgggctgtcagcatcaaaggtgaagtcaggattggagccgccctccctggaaatgggtgggtgtctgcttgtctcagccctgggcgtcggtgggctgtgattagagggttagacatactgcactgcttgtttataacttaaaacccagaaggtacgttttatctatacttcatgccactcagaaagcagtcacatgctacctggctatctagaggtggaaggcaaacgccccagccatgacttgacgtccaacaggccagcgctgctctgcggcctgtgggtaggtgctgtggctgcagctgggctggagaattcccatgagggtggccgaggatgtcagaccaggggggcactggctggaggctggcctgaagtacccagacgctcagcgtccagcagattgaggggttcctgaccacacagcatgctctgtctgctattctggaaagttgagatgcccaccaccccagaggctggctgaagtctccatctcttaagccccaggtagatttctcaagtctcaaaacattgtagctgggtaggggaatgaacagaagcatttttgaatattacttagtgccagacactgtgcaagtctttcatacattttaatttaagctccgttttaagatgctaaattggagggcctcggagcagttgtgccaagtggcagaattgatcacagctgacttgtgtgaaaagaagtccaaggacacaagcacacacgtgacaggcacagagccagcacagtgcatcttctgtccctgcccttggtggcccaagcatccttctagggtccttgcaagcagcagggctaggggcagccccacgagggctgcctccccacggctggccctagcaccctcagcaaatccacaggaactcaccaaggtcagagcacagaaccttggcggtgcttctcagcatctggcccagtgtcagcttgaaccttccagcaccaggaggcggagaatccgaacctcccactgggggacaggcttactattcttggtccagcccagcaacctgtctgtctacgcagagggcacctcctccaggggacgggtgccggcaaggtctgtgaggacagtcagacacctgaagtttcctagcaggcggctgcgtgccagtgaccagccatgcgcaggaggggaggtgcgggggaggaggttcacaggaacagaagcagcaacccattccctggggacaacaccagccacccccccaccacccccactgtagtgtcctccttgcccttcccccctgcgggcctcccctgcaccccagcttctgcaaaggttttccctcctcacccctgtggctgggttcggtttcctacttgatttgcatcatcaacaatttcctgacctttagctgagcctctccagccagagcctccaggctgtgatttgcatctcagcagtccagcctcctcagctctctgagtcagaatgtgccctccctgggatgcagggaggccaggagaagcaccttaggagaccccaaatctctcttgccagcacattcaccttcagagagcccagcgcttcacccggcctttcctgacttcccacagcagttttgctgcctggaacaaggccatttcttcagaggaggtgcagctcctgggcgcttggctcccccgacagcacaggacagttctggaaatagacctgttggcctggctctgtcactcatttaccagagggcctgaatcttcctcccaagcctagttcccatttcctccttccagcctcagtaacctccagactggccctggcacagctgactcctcctggggcagacattgaagcctatgtgctctgttgctcacccaaaccagcacagcgcatccaccaggcccccagacccagccgcagccccaagcccagagctgcccactcacctgcctgcccttccttgggggagaacgttgacccctcctttttggctgggttaatacgttttctaattactcctgcgtcagagtattttgtaactgctcctgttccccaaagcctgatgatctgagaccaacctgtaagaaatatgtaaatacaacttactgatggaacaaacagggaaagggcttaggtgggggaaagtcaagtgcctccaaaagccagagatgagcaggaaaaaatgcattgaaaaggagagaaaaagaatccctgcccagtaatgacctaggatgagagaagaagcaaaggaaaggaatagcaaaaatccttcagccaattcctagactttcaggtacacgccaaggagaccaaagcatgctgagcacagctgggaataattctgccatggaacaggccattgattttgttcttgaccgcacggatgttgccccgtgtgtccttgctggctatctgcatgtcttgcaataatactcagccacttttgcatctatattcaggtcacctgcgatgtgctgtccagcccaggctgtgtgaggacagcagtgccagcccctcgtgtgggggaggtctgctgtaaccacatgctgggcggctccaaccccagaaactcattgtctcccagttctagaggcgtcggcagggctgattccttcagaggctgtgagggagagtctacacatgcctctctcctcctgtctgggggtttgctgccatctctggtgtttcttggctgatagaagcatcaccctgacctctgctttcatcttcacgttgtgccctcccaaatttggacacgtccatgtccagatttccctttttcataaggtcacctgtcctgttggaattggacctgttactgggaagtgtgcaggtccttggttcttagtcttcttagaggaaagaattcagccaagagaccaattagtaaagtaggtaaagtaggcttattaaggaaataaaagtagcatggactctgggagaggagcaggctgaccctgtggagagcagcccccaggagttctgtgttgtggtttttatattggactgttttaagctcccacctctgtcttaagcctctccctttgtctttgtctgttttccctgctctgtcttaagtctccaccttttccctgcctagttcctgcccaggtttgtggggctctcccttgctgctagttgatgtgcacacgtggggctcagtgatcagtaggaacctacctaatggcggcattgctcattaccgccaccccaagaaggtcatacagtggtcaaatctgtacatactgtgtgtgtgtatctcttaggcattcatcccttgccctgtttccctcctgatcagcatgtagctagttacattgtcacacgttagctacagagggagcaattactgggtgtcttatggggtgtttcaggatgctgcctcctgcctaggtattctcctcccctctgctcacacctagcatgtgtgttttggggggtctctggggcataaggttttccagagtttcctcccccggtcccccattccttttcatgtcttactatctgcccactctaacaggcccaccctaagagccacaccttagcttgatcatttgcaaagaccctatttccagttaaggtcatattctaaggtaatgggggtcaggacttcaacataggaatttaggtggaaacgcaactcagcccataacagaccgtaactgtgctctttctgtccttttgatgtagataagtcccctgcggccccagagaccgaagagccaggtgatgaacgtcattggaagcgaaaggcgcttctcggtgtccccctcgtcaccgtcctcccagcaaacaccccctccagttacaccaagggccaagctcagcttcagcatgcagtcgagtaagtggaacgctccccacatacgaatcgtgctatagctccgtgacttcccctcactgaaggctctgaggttagaagcgcttcctccctccccttgcagcagagggtgggagtttagataaacacctggctccctgggagtgtcccctgggacaggctgtagagtctggacttccgcaaatcaggccaaaatccagagcccaggtctccagcactggaggggcagaaagtgcagggtctgtcccagggtccatgtggaggggacctgtgaagcacgtggaaccaccacactttctatcccaggacgcagagctgcaggaggccgtgggcctgcttgtgtctaggactgtgcgctggagaagcaccttcaggcagttggcaacagctaaggggcacagcttatttttctagttttgaccaatgtttaaattaccctagaagttcccacaaaactggtggctccaaacagcagaaatttgttctctgaaggttttggaggccaaaactctgaaatcaaggaggtagcaagttggttccctctggtggctccaagggagagcctgtcccgggcctccctccagcttctggtggctcccagcagtccctagccctccttggcttgtggccacatcactcccctctctgcccctgtctccacgtggcctccttctcggtgtcctctcttcttacaaggacatcagtcattggatatagggtccactgcaaatccaggatgatctcaccttgagatccttcactaattacatctgcaaagaccctacatccaaataaggtacattctgaggttctgggtggccctaagaggtctacattttggagagactctactcaacttactctaagtggcagacagcttttcaccactagattcagagccagcagagaggagaaatcttggcagggagaaggtgctgaggatggggacggcagcagaaccggggagcccactctccttcctgtggcacagagaggggtcccaggcaggaaagctctgtgccctgtggcgagggctgtgcaaggcagtgagtgattgtcctctgctcctgattttcctcttgctgaaaggggagcagtcatgattctggagactgtcagtgggtggggaggctggctgcaggagtggatgcgtgagtctaattgagtaggcaaagagctttctgggcactggatatgtctttggagggtgcatcttcacatccttgcactattactacatgatctttctaaaaatgtgtttaaaatctattttaatattgaaaacagacaccatcactgctgctgcggaaaacaatttagtggttcctccaaagttcaatgtagaataaacctataatatcaactggcagtcctgcttctaggcctgtactccaaagaattgaagacagggactcaaacagatacttaatattcatagcagtatttttcaagagccagtaagcaaacacaggccaaatgtccatcaactgatggccagattaacaaaatgtacgtccaaagaaatgtccgtgcaatggaatattacccagccgtagaaaggagtgaagttctgacacgtgctacagcacggacgaacctcagaaccatgatgctgagtgaaatagatcagtcacaaagggacaaatattatatgactccacctaaatcaaatatctaaggcaagttcatagagacagaaaggcatggctcacgcctgtcatcccagcactttgggagttcgaggtgggtggatcagctgaggtcaggagttcgagaccagccagtcaacatggtaaaaccccgtctctactaaaaatacaataattagctgggtgtggtggtgcgtgcctataatctcagctactcagaaggctgaggcaggagaatcacttgaacctgggaggcggaggttgcagtgagctgagatcgcaccactgcactccagcctgggcgacacagcgagactccatcccaaacaaaaagaaaagaaaaaaaaaaagaaagtagaatagaggatactaggggcgggagagaggagtggagagttactgtttaatgggtacagaattccgtttggggtgatggaaatgtttcagaaatacatcatggtgatggttatcccccacggtcgatgtgattaatgccaccaaattgtcccctaaaggatggctaaaatggcaaattttatgtcgtgtatatcttaccacaataatagcaaagaagtaggcagcaatcatgaggacagtcactcaccgaagccttcgtatttccctcagccccatggcagagcttccttataagcttacagtgtggccttcctagcatgcattttcctaataaaggatttttcatcagatgaatcctaggggaaaactccaaaagagactcatcagtaaaaatgtccatttttctctctttaatataaaagaaaacaaattatctttaagagtctcaacaaggtttgagaaaatatcctgccttaatgattattcctccgtttgaaaacggctattttttccagtttactttaaaaatcaattgtacttccccttggcttatttaaagcaacagccacagtgactgctatggctaatgacttcatgtcatacgactgtggattttcctgtggaaagagatgggaagctgggtggctggtcggcgtgttagactttgcttagtgaatctctccaggtgataactgcaggggtgactgcaggggcctggcttggcttcgaaagcagtagcagcagcagcggagacggtcctgtggcacccagctgtttaacttccaccgaggcagggggcccgagcagggacagaagaggccggggtgaacatcaccctttctacagtggctcgatgccttgcttcacactccagttttagtgttcgtgtgatacttgctattctctttctagaacattgccgttaggagagggtcccaccctttgtgttcgctccctccctgccctcatctgctctgttgacaaacgttttctgccagatgaagtgtttctgctgtgcctgcctctctgggagggaacgtggagcagctccctgagcattcaggctccgtggggaagtcggactgattttaaatagatcccggttttccaggcttggagctgaacggcatgacggggacggacgtggccgatgtcccaccccctctgcctctcaaaggcagcgtggcagattacgggaatttgatggaaaaccaggacttgctgggctcgccaacacctccacctccccctccacaccagagggtaagtcggcaatctgaaacacaggctttcattgcttcgcctccacaaagtaggacgagtccctcattccagatactagcaggtttacttcgggctagtgagcacatgaggaaaaccatgtatgatgggcccgggtttgattttgcaaaaagatatcgaagcagtaaggactccagtgggtaagatctgtggctctgcgtcattatcaataactgcatcaaaaagcacattttgatatcatgcctcagaacgaggaagaggatagacattccaaggttgtcatcggttatcatcaccatggagatcattccactggagatgcaattctaatgacattttgatttttgagaagtagcttttctatcaagaggtctgactttttaaagaggttggccaatatcgccctgtatggcaggcacctgttgtacacctgcttggccctggagaagcttgtctccaaacatccctccaggcagtctcacctggtgctgggagctcctgggtggtgacaggcactcaccttacggagactgcagaggacagccaggtttggctcctgggcacagtcatcctcactgtgcccccacccctgggcaccctccccagtgctagttcgggggtgctgacctggcttcctccagcagcactggcctttgtaagcctaagcaacctgctggaacccctcttcagcgtgagtccctgaagctggtaccccccagcagctgttttagtcattcatgccacctaaagtgccttttgccaaacagcccctgggcctgcctgcccgtacaaatattagtcaaagtcatgaaaagccatttaaacaagcacctcagttaccagttgacagttctagaaacattcttttgagatccaccccgttcctctcctggttctcaaggatgctgtcaggcgtcactcatccctgcgggtcccagccccatcctcatgtcgggcccaggcatgtgtggagggcagcatgagtgggatggaggcgggcgagcgattgactcagccacggcgggaacttctgcttctaggctcaggcctccccaggccatgttattcacagcctttgacaattaaatcagtggtgtctgaagggtaaaatatccctcttcatatgtggacagctggccgtattttttttgctatccagccttagtgaagtaattatatggccgcaaaactcctgtagaacattgaaaacatgagattgttgggtggctctgtttttttcataatggtgagacatggttttttttttttatttttctttaataaacaatataaatcccacgtgccatttctttttctttttttttaatggagactcgttgacggagtgttccacaaggtcattacatcccttatgagaggagtggaagagagagggtgtttgtgtacagcatacgtatttcatcattccctttgtatcagaaaactaaacaagcagtcatctttaatatcaaagaggcagattgctcttctgagacccaagtgccatttaaacaggctccctctccctagagacgcctcgatggggaaccggtcctggaggaggcaccaggttcccctgtgaagagggctttctggcaggctggaatggtttgttgcaccacagaaatggaagccggaccttccccggccatttctaactacttgtgagagcaaaaggagattcgggggggtctaacaagaatattgggttgcttggagtattgtttccctaacagcttcgttaattggtcacattttcatctctctattttattgcaaaggcaggaatgttccccctagtctccctacactagtaaactgaaaattctaaacttagaattacagccaattcctcttgttacaaatcaactccggggtaacattttattgtctcaatttcttggatacaccattgtgggttactgatgccacatacagttgattaagtaagggataacatggattagctctctctcaattgataaagggggtgtgaattcaattagattaatgacccaggtgtctttggtctttgtttcttgtttaatttacttgcagcctgagtgcatgctcaggtgacacgctggtggttagtatgtcatcattaggcagaagcggttgcatttcctggggtgcctccctttgcacaggccctgagagctgttctaggataatgatcatccatctgccatgatgggggtgtgatcaatatcctcctgtcactctcattgatcagcctcaggcttgtaggcaactctgtctttagttgttgccactaagctgtcatttctttccaaatggctcttcctgtcagtaatctgagcttactgagtttatcaccattaatcattttgcttaatggtgataaacttttgacatgctcatacttggcatagaggtcatttgcagcgctgtgttggtatcaggctgtgttagtgtggtccttacctgctcctcattgggctatcagtgagtgtggctttcacatgtaaacaaacagtttcatcagacctcaaaatagatgtctcttttaacggttctaaccaaccttaaaaagacttaattgttgttttaccttccttaatataaggtcatatactcataggacatctttatatcagctttacttttccacatttattctcctctctgtgttaagcattaggtcatttttgtatttactagtctgtgaatcaggaggaaatctgggcgatgagtgagagactactgcgtcactgtctatccttgaaaacctcttttctcacattcagctaaatgcaaacccacactgagaggctgataaaaatccactcttacccttaagttagacaatagtgttctgtgatttcattctggttcttctgcctgtggcatgctcccacttaccctggtctgttcacttcttcattcatttgtttacttacctgttcatttcttcatttatccactgactcgtttattcactcattcatttattcactcattcatccatttttctattcgatcgacccatatttctagagagtctcctgcacatcaggtgtgtgtgatgggcatgagggtcccaaaagcaatagggtgcagctgccctcagtcataacactccagccaggtccatcagcaaggggtttgctattatcttcacattggaaattaatgttcttttttggaatctaaagtaatatatgcccatgagctgaagccagccagccagccacctgtttctgtgaatagttttcttggaacacagccacacccctttctgtacacactgtcaatgaccgcttttcggccacaccagtggcattgagtggctgcaacagagaccgtgtggcctgccaaaaagctggaaatatgtactgtctagccctttccaggagaagcttgctaacctttgcccgaagctcagaaagcaaaagaaggtctctcatctcacccctggagagtgcctctaaggacttatttatcccttagacaatagatggataacttggtcgatagcatctagatttaaaaaggccacgcaaagggcaatggtacctctcaggggctgtgcagacggtgggagagtgctcagaggcgtcagaaaggcccaggcccatagcagcccagtcttgagcctagtagacctgccagccccaagtcggacaggatggagcccaactcatgtggggaggatggttccggctgagtggctgtgccaggtcagaccccacctggagacggtgtcttttctgtcaggacatcagttatgtgacatcttccccatcctcatgttttttagcatctgccacctccactgcccagcaaaactccgcctcctccccctccaaagacaactcgcaagcagacatcggtggactccgggatcgtgcagtgacatcgcaaggctctctggaaagagtgtgctgcccctccccatctccatgccctctccttctgtgtcccctgagtctgctgtttacctcattgggcctgtgatgttaacatttcgtgcgactgctttttcttcaaaggagttcagttctcaccatggagtgagtggcctttagcgtcatggagcaaggtgggtctgggaggtagatatgggtccgggatgtgctatcgtagttatcagagttgggggcctctgagtgtgtctggctctgagagagtctgagtcttgcccaaacattctttctttttgtgccaaatgacttgcatttgcaaagagctcaattgctctgagctcagccaagtaggagaggctaggccatcactcttaggaagctgtgtagtgatgatgtataagaatcctcctcactgtcatgggatgttgtatccagcccctccttgttccagccggtggtgtgacttcgttggttgaggtgtgtctccaacctacatcagaccatgaagttcaacccctccagggaagctcctgatttcccctgcataattgaaaataggatatttctcagctattgaacagttactaatttatggggtggaaacagcattaagaatactgaatcaaatggaaaaacaaatgaatacaggaagataagtgttcgttcttttctgaaaaagagtatgtgtaccacaagagctggttttaattgggtgaattgtttttgtcctcattctgtacagaaatttgtatatatgatggttcttagaacttgttttaatttttgtggtccttctgtttattataataggcgtccaccaatgattatccatatgtgttcttaatttttaactgctggaagtgttaaaacacacacacacacacacacacacattttttttttcagaactccaaagtcctgaaaattttggtggacaatgatttttaaaaaactaactttgtataacctaatatttgtattctctcatctatatttttttattcactataatcatgatactcttctaatagacttaaaagttaatcattgacaacgaaaaataaaatgttattttaaaagactcacagtgtctgaccaattatgttttcatccttgattgtaaaatacagacgctgctgtttctattctgctatgttaaagtgcttggtgacacacatttatatatgcacctcttcctccaacattgtttttaatcctctctgttaattatgtctgatctggagcccagatgggaagtgcccgtgtcccgtgcatggctgcacgtcctgatagacaggagctaagcagagaccagctgagtgcttccccatcaccaaagccagagggctgtggggctgcagatcatgtgggcctcttttcagctgctaatttaagaaagggctttggttaatgggtgtgtgatttagctgtagaggtctggacatggagagctttctccagggcctatctggctggatctggggtggcaagaaacaaggaaggcagggggttctcttctcaatggacggggctctcacctctgctcctgccagacgtgtggaagccataaggatgtgccctctgcccatctaacccggcctagaaggaggctgctgtggagcccaggaagctgggaggctcttcctcctactcaggtgctgtccccagcgtattcatgcttgtaaatatccagtccacccctgagaaactgtaggcctgtgtgaatgtgggatttttttcttcaagaatctttactgtttcaactgttgcaccaagataaatattcatcttctgtcgagtgtgtgagaaactgaatattatccacaaccctagaaatcgtcgaatgggcacacccatgtaggcgaccacggagagcccagcctggggacaggttgtttttgggcagtctgtgcctcacattgtataagcggccaccagaaacggaaagaataggccgggcgcagtggctcacacctgtaatcccagcactttgggaggctgaggcgggcggatcagctgaggtcaggagttcaagaccagcctggccaacacggtgaaaccccatctctactaaaaatacaaaaattggccgggcatggtggcaagcgcctgccatccggtaggctgaggcaggagaattgtttgaacctgggaggcagaggttgcagtagctgagattgcaccattgcactccagcctgggcgacaagagcgagaaatctgtctccgtctctatctccatctataaaaataaaataaaagtatttatttttataaatataattgtatttataaaaaataaaaattataaaatttataaaatgatataaaatataattgtatttataaaaaaataaaaacacagaaagaatagtgcctggccctgtgataaatgatggttttcttgtggaatgacgtgtgggctcctgctcttcccccatctaccgggttaatcctcgcgctgcacaaccctggctggaatccccgccccacaaccccccaaggaccttatatccgtcggggatctctagagctgggaggtttgcagagaacacagaacagagttaaagaaaagtgaagacagccaaaaggttgcagacatttcctatttattaatatgaattacaaatatgctaatatattcaccagtgagtaaacttctcaaacgtttcatgcagatgcaacatttcctcagcttgtaaatccgtggatgggctgcaacacaataatcagagacaaaccggcctctgcacacagtgcctgctacatgcattccttctggaatgtggatccaggggaaggtttgcctctgtacatgcggggacatatcccttctacacagaaacactatttcttaacctttttttttttttttttcacaattacctttcaaggagcctttttagacatttttttccctccatcactcttatgatgaaattttaatagtacagccatactgtgtatcacttagactatatactgcatatctattatgtactttatgtatacctatgcttttttacattaaaaaaataagattttttgtttgtttgtttcccaagtaccagttttcagggggtgatactgcctttttgcagactcatgctccaaagcaggaattgtgagcttcttaggctctacttttgctctggtttccaggatgctcaaagccaaattttgccctcacacattcagttaaattttcgttttattctcctgccttccaaaagctttctggactattaaaaatccatctttactttaactacctagtttcatatgcgctttcatcaaatctttattcaaagtagttagtatataaactgtattttataaatggaaaagtctttttcttacttgaaaaccacccttggtgctggaagattgcttcctagtatttaaagaaattattttttaatcaattttaagattattctttcatgcaaagatttgatcgtttaaattccttacagatttcattatcttctgctctggattcttttatgttattggactttgtttcatgtccacagaactctttgttggtttaatggattttcatttttgctttttagttccatctctaattactttttaatattttacttaactttttaaagtctgtttgggaacttctgccaccacactttttggcaatctgccttttcagaattatttaaacatctactgtttcattgatgatggctcaaaaaaatagggaacctgtaggccaataagcctttgtacccaaacaagctagagttgtcctgccctatttgtctcccacacacgaggaaacctctgctcctccaggttgtacagtggcctgagtgcagtgtcactagctggagaggggagtgaggactccctggatgtctgatgtgtgtcaaacctcctgggttagtttcagccccggacaaaagagttctgatgtggtcttaagtgtccacctggctggacggcagtagccagttaatcaaagcaactgtaagtgttgctgtgaacgtattttgtagatgtggttaacatctatcatcagttgaccttacataaaggaggtgacccttgataatgtgggtcagcctcatcccatgcgttgaagaggccttaagaacaaaaactagagtttcctggagaggaaggaattctgcctcaagaccgcagcatcagctcctgcctgacttcctagcctgctggcttgccctacaaattttggacttgccagcccctacaatggctgagccaattccttaaatctctctgtatacacacacacacacacacgctctgacaaaggacagaccatagcaaacctcctctcataaagtggtatttggcagaaacaggtgactttagggatacctggagtagaatccaagaatctagagacccccaagcaagccacttatcctctccagtcatgagtgtctctgtgggtcacgtcataatatctgctgccaccttgtcatggtgtcttgaggctggaacatccaagatggcgtccttcacgcgcctggcacactgcttcactgcagctggctgggcattctctcctctctctctctctctctctctctccctccctctccccctttctccttccatcccccttgggttgtccttcattttccagggctgtttcatctgtaggaagctactttgtatgctcagggtttccctgtttaaattccaaacagaatttcattttcctggtaaaccattgtgaggttgccaccgtgacctacccttcatctcagtttgccttggtcacggctctgtggcttccccgtgttgcagcctctcatgctgagctcttgggtgagcctgtcctcgttcccctggcccttggcaggtggcttgggagctggtcctgaaccagcttctccaggccgcccacgcagctctgctggcctttccttttttgacgtgcttcatctgcaacatgagactccggaatttgccgtgcagactccagtggccatgctgccctcctgccactaggaagggctccatgcctttgtctagccccagagcactatctccttatctccttcctgtcctgtcactttgttcaactgttggcacccgggtttaagctgttgctactaactaatgtttcttttcactttggggaagtgcttaattccatctcttctttggcttctaaataccattctccaatcaaacaaaccaaggcttctttaagaaagatcatcctggctaacacggtgaaaccccgtctctattaaaaatacaaaaaattagctgggcgtggtggtgagcgcctgtagtcccagctacttgggaggccgaggcaggagaatggcgtgaacccggagggaggtggagcttgcagtgagctgagatcgtgccactgcactccagcctgggtgaaagagcgagactccatctcaaaaaaaaaaaaaaaaaaaaaaaaagaaagaaaagaaatatggctgactctggtctgggaatacaagacagcctagaacattttgtaccagaatacaaggaagtgttcaagaaataagggccacacttcaaaaagacattggggcccatatgaagtggcttctatgtgatggcccacatctgggacaatttgagcatcaaaatcaatgatgacagtaacaaattttaaagcagttgaatgaagtaggccttttctgtaagtccatgctgatataaatcaataaatgaataaattgaatgtttaatgaagaacaggatatctacataatttcaaagtgtcttcccacaaaacactaattacaaagggaaaaacaatttcatagtggaaaagactggcagataccaccttaatcaagaaataaaagagaacatcatcagtgttgggacaaattaaaattacatgctccccccaccaccacagtactgatgctctgagaacacatcagctctgcaatattcctaccaaagatgcataatcagaatgaaatcacaagaaaacatcagccagacttaaatttggaggcattctatgaaactgacccttcatatatgattccattgacatgaaatgtccagaagaggcaacctcacagagctgggaagtagattagtgttggtcaggtgctgggacgaataactgctaacgggtacaggatttttccttcagatgatcaaaatggtctaaaatcagattatggtgatagtacccaactatatgacaaaactaaacaccattgaattgcaccctttaaaggggtgaagtttatgattattgaattaattatatcttaataaagctgttattttttttttaatggcctataatcttggaaagggtcaaggccatgaatgacctagtcctcactacaggtgactaaagagacacgacaagtaaacgcaacttgtaatttggagctggatgttctctacattggacgtattgggacaactggcaaaccttgaatggagtctgaggattggacgacggagatatctcagtgttcatttctttactgtgttggttgtactctggctatgtagaaggatgttatcatttaaagagaaggaacactgagccattggggatagtgcggtaccaggcagacaacttagttccaacttactctgagcggggtgggggagaatgacccatattgtacttgtgcagaacgccattccttttccacgctagaaatactttttttccgcagggaataatgatatcatttcacttgcttctctgacaaagcctcaggccatgcctacatgctggattttgcaaaaacagtttacaggcacagtgccactgtaacaggaggcggggactctagccagcagccacctctgtgctgctagaacaatcaaggctccacatggagcccaaaggagggaaaagtgagtccctatctcaggagcattgggcaggccacagtaagggaagtgtttacttgtctatactaaatgtttacagagtccctgccaagcccagcccggttcagacttggtaccgaggtgggcaggacaaacgtctccaaagttcctccgggagacgacaggcaatattcaaggaaccaagtaaggccattccacatgaccattagaactagaaggggtgagacagggtagtcatccgaagggcagggctcacctccccttccaggggtcctccctgaggctgggagacttcagcagagacctgtgagctcagtgagaatccagggtacagggtggagaaagagcaggcacacaggccttgcctgggtttggactgacctgggaatatctgcaaaacagaagcaggaggtgaaggagggtcgggggaagagccagtggatggcactgagggcagggagcttggccagggcatgccatggccttgtcctctagaagagcttgagtttcatgacaaaggcaggaggaggaagagatgaccagccttcctcaggtgagggccaggtgggagggagtgctccccctgcagtgggctgcagaaagtagaaggtgcggccataggatctcctcacccccccactgtgtgtccggaattggttccttctggtggcttcttggtcttgctcacttcaggagtgaagccgcagaccttctcagtgagtgttacagctcttaaatgtggtgcatccagagttatttgttcctccccgtgggtttgcggtctcgctgacttcaggagtgaagccacaaaccctcacagtgagtgttacagctcataaaggtagtgcagacccaaagagtgagcagcagcaagatttattgcaaagagctaaacaacaggcttccacagggtggaagctgacccccagctgccactgctggttcgggtggccagcttttattcccttatttggccccacccacatcctgctaattggtctattttacagagtgctgattggtccattttacagagcgctgattgttgcgtttttacagaatgccaattggtgcgtttacaatcctttagctagacatagagcgctgattggtgccacccacatcctgctaattggtctattttacagagtgctgattggtccattttacagagcgctgattgttgcgtttttacagaatgccaattggtgcgtttacaatcctttagctagacgtagagtgctgattggtgcgtttttacagagtgctgattggtgcatttacaaacctttagctaggcacagagtgctgattggtgtgtttttacagagtgctgattggtgcatttacaatcctctagctagacagaaaagttctccaagtccccacttgacccaggaagtccagctggcttcacctctcaactggacaaagcaggggtccacacatcagtggaaacgaaaagcccccaaagcaacatttggtgttgggatttttgtccccaccctgagagttcctgatgttcttgctgtgggtgagaggggagaaaggagcgccctcagtgggagtcagtggtttctcccatggctgccctaccctgagagacaaggaggcccatgtgtcctcggagttggaagccccatggtgctggtgatgtcccccatcctcccaatagtcacgacagatcatatgcatagggtaaaactaaacacacaaatttgttgtccacggggttctgaggcaagctgtgcatgtgcacccgtggacacctcccctgcacacctcccatggaagtgaccaggagcccagaagccacacagaggcttgacacagcaccctgactcatcagccttcaatgaaaaagtgtggcaatttgggaggtaaaaacatgcagtttgggaacgggaatctttttgaattagcataaattagactattttaaaataaatgttaacagttaatttagcattatgtacacttgcgttggagaggagggcacttaatatcaaataaggagcttcctgcaaaatgcagggttatttttaagctcctacatatttttgggttttttgcagggaacacagatgacatcgtggggtttcactgccttgctaaagctttttcacatgaaaagcaaactttggaaggcaaagcaattatcatggaaaagcaacatcagaatcattcctcagaaatgtttcatttttcagaaatgttagtgaaatgagtgttctttgacaggaagaccatattatttcagcactggagcgaggaggtgctgctgcttttggtcctatgcctcccgaggaggctcagttggcagcctggaggtgaaatggacagaaagggcctgtgggtcacagctatttttttaatgctccttggataaatgtcccccctccccaagggaggactgccagggattagaaccaaaaactgacagctaaaaacggtgcacttcccaagtacctcggtcctcctggctgagaaaagagatttgcatggaattgtggggactgtgaagtcatcctaggaagggatgacccagcagagagcaaacgtgacctccagagccctgcttcctggcaaagcaacctggaattttcaaaatctgtcatgcagtgaagactcaaatgcattagccaccttagtccttccagctgaatttgtcatcagaagtaaaaggaaaggagggatccacagctggaacaggctcatattttagaaaagccaaaaatgaattccagtatttgtctcaggaaggaccctgagaactcacagtgctcaatgccctcaatgtttagagtctttattcatcataacactccatgtgagcctgggagggacaagatacagaatggccacacagtacgccaagtcacatagctggtttgctatttgatgacatttttagagctcactttggattagaaatggacagttgagacttcaaactatactacaaggctacagtaaccaaaacagcatggtactggtaccaaaacagagatatagaccaatggaacagaacagagccctcagaaataatgccacatatctacaactatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagtcaaaattgacaaatgggatctaattaaactaaagagcttctgcacaacaaaagaaaccaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcaaaggatatgaacagacacttctcaaaacaagacatttatgcagccaaaaaacacatgaaaaaatgctcatcatcactggccatcagagaaatgcaaatcaaaaccacaatgagataccatctcataccagttagaatggcaatcattaaaaagtcaggaaacaacaggtactggagaggatgtggagaaataggaacacttttacactgttggtggaactgtaaactagttcaaccattgtggaagttggtgtggtgattcctcaaggatctagaactagaaataccatttgacccagccatcccattactgggtatatacccaaatgattataaatcatgctgctataaagacacatgcacacgtatgtttattgcggcactattcacaatagcaaagacttggaaccaacccaaatgtccaacaaagatagactggattaagaaaatgtggcacatatacaccatggaatactatgcagccataaagaatgatgagttcatgtcctttgtagggacatggatgaagctggaaaccatcattctcagcaaactatcgcaaggacaaaaaaccaaacaccgcacgttctcactcataggtgggaattgaacaatgagaacacatggacacaggaaggggaacatcacacaccggggactgttgtggggtggcgggagcggggagggatagcattaggagatatacctaatgctaaatgacgagttaatgggtgcagcacaccatcatggcacatgtatacatatgtaacaaacctgcacattgtgcacatataccctaaaacttaaagtataataataataataataataataaaaagaaatggacagttgaaaggtgggtcttttatttttcttaaggctccaagcctccttcactggtgtgaagcacaactcataattaaaaatcagcagcagattggactactaggctgccacgttgtttttctctctacaagtgtaacaaagtagctggccaggctgcagttccttttctaacaatggtgtaattatgagccaaagccacagttaccaaaggtgattgttcatgctacagtgccttaccaaattgtgtacatattaattactcaaagctatcatcctgccagtgattggagtagccatcctttcacatcaccctccacggataaccatgttgaaagagagagagaaccagttctttccttcctcacctttgtgagggaaaggggaacgcccagttggccaaggtccaggggaagacaaatacagttcttaacccaaacaggctgcttccgagtaatctaaatgtaacccagggccccagaggacccagtctttgagaaaagcggactcaaatgaacaacatttgaatagaaaaaaataattaaaaccaagggtcttgcagaaatccactgaacttaagggccgggaaggagtagcaggtacagttcttaaaagccctactagtcaacttaaaaacaggctttctcctttgtggtcactattcatcaatgcacgtagcagctgggcctctcacactctgccccactcccagttccctccaaagccctctgggaacactcacccttcctattccagacatttcatttgtttctacctgccattctccctgcttttgaaggtagctctcctcctccttccaggactcagctctttgttcccagggtcctcccagcctgcctgaagcccatagagggatcaggcgaccacagccccttcctaggtgagtatggacaccccagagggctgtgcctccagcaccgtggttccggccacatagatcatgccacgtgtggcgacagggaagaagagacgatgctgttggaggaaggactccatgtccttttctcccttcctgcatcaggggtccctgctgtccctgtgccctcccttcagctaagcgcccccttctccccctgagcatccgtctccttcactggagcagcactcacaggaccctccgcaaatcctcacattcttactggagctggggaagctgagtggccacccagcccgatttcattgtgtgcctttgcccctagtaccatatcctcagaagctgtctggtccttccccaggtgaaggggaagatgggatgcagggagcctccacccatatacactggagcttgggtcactcaatggatgacgccaatggatggagagcgtcaccagatggatgaccaggaaaccctccttgtccttgtcctaccctgggtgagaccagcagccaccagtgctcctcccctcctgttaccagcaatttgccttattcttatcctccagccctagcaacaccctcagttggagagtgagtttgcagggcatacgggctccggttcccattggttgagagttgcctgtggggctgttaagtgccccaaccctccaggctgagagaaagcctgagaagcttcagagaagccttgaggcagaaagctgagagcaaaggggcagtcggcatgggtcctgtcacttcttcaactgtgctgaggtcatagctgagccagggagcatggcacggcatcctgagagtgtccactgtacttgacaaagacacaggaggcaacgtcatcagccgtaagcatggaaggtgaagagggggagggtcagcaggggttgtaaagcacctgaaaagaagaacaggcattgaggtggcgagaaagaccagaccccagggtctggagttgctagcaactgagggagaagatcaggaggtcagcagaagacgaaaaagtaagggattgcagatgggggaaccggctgggatgaggcatctggtgccagatatagctcagggccaagtactggtagtggtggacatcatttcttcataggagcaggaggaggatgggggaggagtgatcgggaggtggcaaccaggagcaaagaggacaagtacatgtttagcatccctagccctgaccagaagcaaagaggacgagtacctgttcagcaccaccacccctagccctgaggtataggggatgtgagaggaaacggggtttgttaaagacggttgcagggagtcagggtctgcaggagtcaggcggcaaagcaatccaggttcagattaagggagctgcggaggcggtggggaggggcttccagaaggtgggtgcgggtgcagaccccgagagagcacggggcttccaagtccagagcagcagcggcagggcgatgtgtgtctttgagaacgcctgttaccacaggccagcccacagagggagagagtgggattgacaataattgaagaagagaaagaaggaagaagggaggtagaggaaaaaggagagaagaggagaaaggaaaagaagggaggaaagaagacagaagagaagaggagaggagaaaggacaagagaaaaagaacacctggcccagctgtgcaacggcagctctacctaattcacacactctggggacctgtcatcgatttcaccgactcagaggatgcccagccaaagaaagaaaaagaaaggaaatcccagccagtgcccaccgaatgcccaggcttgcctctttctgacaaggctaattcgcacccgtctctgtcacttgttcccttcctgatagatttctttggtggggacaggaaatgccatcttgagtctgaggaaatgaaaaacagaaaaatcttaaaactttaatcactaccatcagcttcctagagccccttagtcatgagccaagaaaattataattataatgttggcgaattattattgtacataaaatacaataatccgcattattgttatagcagtaatcgttctactttttaaaataccttcacctgtattatctcattgaatttttttttttttttttgagacagagtctcactctgtcacctaggctggagtgcagtggcacgatcttggctcagtgcaacttctacctcccgggttcaagcgattcttctgcctcagccttctgagtagctgggactacaggcacgcgccaccacgcccagctaatttttgtattgttagtagggacaggatttcaccatattgcccaggctggtctcaaactcctgaccttgtgatccacccgccttggcctcccaaagtgctgggattacaggcatgagccaccacgcccggctatctaattgaatttttataaatatcttgcaaatagataagaagagtaacatatttccttcccatttcatggaggaggtactaaaacttgaaaagttcgggtccctgtggctgtggcaaaaccaagcccccagactttccagccaggcctcccatgaggcttagaacaggtaatgtctcatttaatcttctcaacaccccatcaggtggctgcagcctgacatattcatttattccacataagtccattttttctaggtgctaggataaggcgatgggaaaatgcccatccaaaaagcccttcaccttagggcttacggagtggtgaggactccacctctggaacctgacagctcagtgtaaatcctagttctgccacttaccacttgtgcaaattattcaccttgagcaagttaatgaacctaagtctcatcgtcattatcaaatcatgatataagtcatttgaataataatatgaatctatgtcctgaagaatgggattgatgtgtcagctggtcattatcccagccaatcaacatgagcatcccctggcaatttttattggtccagagatggacatgaaacctacatggacccagtcagactgaagggagattttttttttttaatccttggggaagaggttctcctgctcttgatggttgtgagaatgacagcttttgttcccagtcatgactatgcatggaccctgttgtatagctctcttgtaatcaggagaaccaaccttagcaccaggctggccctgtatatagtctctcagtcacatgcagttatacactaccctgaaatctaagtggcttaaaacaacacatatcactcgctcttgctacctgatccgctgtattcagccctcctggaggagaaaggggagctactcgctgcagaaactcagtggcccaggcagacagaagcctcctccaacaaggggcttccacaatcatcccagagaggggaaaagaacatcctgtgaacataccctcactcgtaaagcagcctcccagaagtgacccatgccattctgctcacacttcaccggctaactcaagtggcaagcaggagggtggtgaaatgctagcagagagtgtagaaatattgggtgagcatggagtcgcaaagcaaagagagcccgtgtccctgatggcactgctgagctgtggtcctcaatttccagttactgtatgtgaaatggtgattttgcttattctttgagctgggtatttctttctgtgaggtcggcatagccatgccccctctttcctgcccgactttaatactttgagtcctctctcttttgttcttggtctgtctagcaaaaggtttgtcaattttgttgatctcttcaaagaaccaactcttggttttgttgattttctctattgattttctcctctctatttcatttatttctgctctcatcttcatactttccttccttctgcttcctttgagtttagtctgcgcttctttgagccatttgttgtttacagctgtgagcatcctaactggtcacctaccttgtggtggcagtcaagaggcctaagtgatacaacatgcatggagcactcagctctgtgcagggcatggtgaatggcagctgtcatgactgacatccaactcatcatccacaacctatggaggcaggcactgccatttcactgtgtctgagaagactgttccccaagttcccagagctctctgggggaaaagctgagatttaaaccgggattgattccctaagctagaccatccaggcccacagcttgccatagcaccatgtcctctgcctcccttgcctttgtctggggaggcgtgtccctgagcgggaggacagcttcccctgcagatagaagctgatgggaggctgacgggagggcagcatctctaatgggcaatgcccaccgctgtggagttcccgacagtgcttgctaacccatcattatgtgtcttccctgggaacggttgcttgttcttcaggtcacagttacaccaaagacaattttcctcttagaactgccttgccgccactgctcttatttctgcctgacaaagagcattagcgacgggacagcgtaattggaagtgactctcaccatggaatcatgtgggggtggtgcttcttgatgaaggaagacacgtggatacaaagaactctcctgcctttgaggatgttgggggattggctgagatgggacaagacccttatagggccactaccacctgtgcttaacccaggctggtgaacaaagtcctcctcaggggtctgatggagcccagccccattcatcctgaaagttctgagtatgctgctgagtttcccaaattatcctgagaagtaacctccatattatgggtgttttcacactaacaaaatactggggacccagtgggggctttcctagtgctcagtcatctttttcacttagaaagtggcccaggctgcctcatcgacgcaaggtccccatcaacacacccacgtgctgggtagtgttttactcgggacacacgggctccagtgatgcctcagagcgatcacaagtctttctgagcaggagttaacgtttctgagctccagaatgccccttgtccctgcccatcttcctgatgtgcccctgctgccagccaacctggggaacagcaagggatgtccctacccctgcacagaataaggagagtggttctcctcttcttcttttgtaagtgaagatcacaggggagaggcaggtgctctgaacaacagctgacgactcaggagactcacggccctccttgcttagttcccgggaaatgacagggcagcttatctactgtgaccttgggcatctgagtgtgtactttgtacctatgtgtgggcacgtgttgtgtgcacacatgtgtctgtgtctctgtgtgttgtgtgtgtgttcatgcatgcagggtgctttagaaatagctgttaacaaatagctgttccaatggacaggccatttcttgacttcctgctttatgttcctcggtgcactagacattttctccacattattaggcaagattatatccccttgacaggagaagaagtgagcatagagccggcccttcaacccagattagaggggcttcaagttcagccctccattccaccctgccctccagctgtttccaggaggtgatacagtccatgctaaacccagctgggacccagtggcaatttcagcctccctctccatcccgcaaggcctggatcccacacgcaggggcatagcagaagcccttttgcccttagcagctcaaaacagagagaaggcagagtgacagtgcccaggaagggcatgaattggtgatccatctcagcaccacacatgatccagtgggctcatagatgcttgcccacgaggctgggcagacaagagctggttccatcacctccttccacaggtacatagatccttccaaaaacaaccaaccggtcttaagcatccctttattgagaggacctgtgctaaaacagagctgtggccccagtgaattatgggtcagtgtgggcagaggccacaggagtggggtcccccacctacccagtgggggcagctacatgaggatgagcacagtattaggagctaaggccagccatgccagcttagacacaggcgggaccagtgaccaggacagagccacgtgccacttggccacctgcagcgaacacttcagagctcctccacctgaacaaggagcagccagcagtaaggcttcattttttttttttttttttttttttgagatggactctcactctattgcccaggctggagtgcagtggcacgatcttggctcactgcaaactctgccttccgggttcaagtgattttcctgcctcagcctcccgagtagctgggactacaggtgtgtgccaccacgcccagctaatttttgtatgtttagtagagacggggtttcaccatgttgaccaggatgatctcgatctcttgacctcgtgatccacctgtctcggcctccgaaagtgctgggactacaggtgtgcgccaccacgcccagctaatttttgtatttttagtagagacggggtttcaccatgtggaccaggatgatctcgatctcttgacctcgtgatccgcctgcctcggcctcagaaagtgctgggattacaggtgtgagccaccgcccctggccaggcttcagtttttaaggatggaggcagactgcctttggaaactagtcagggctccccttagctcctcgcccctggctctttacacgttaagcactcaacaaataattgctgcatgaccaacccatcacactaaattatgaaggaaaaaaaaagtcagcagaagccaatgtcgtcagcaacaacaataagaaaaagaccctctaaaacatcatctttaatattcggctctctgctgagcatatcaactttggaaacatcccatacctatcttgctgaactccttataataaaactttaggctcctcagtaatgaatttcagaatctaaaatatgtctgtgttgagccctgccctaccttgacagataaagtgagtcttatcaagggatatacattacacaacgtcttttgtttcagatctaacacgaatccatgtgtccagggaaactctctgaaattcatggttcagagccttttgtctcacaaactaagtcatggtccaaactccagttccttccctctgcccatcctagaatttgcttgtgtgaaggactctttcttcaagacctgagaagatgacagcttggtaccaaagagcaggctggaaagacccaagaacagatccatccctggccatggtgagggcagctgttctggtcagcgctagctagggtccacacacaccaccgtcatcctctgactcctgatttcttttgagggtcttctgcagggaccccagtggtccatctctctctggtcacatggcaggccttcaggaggctcttcgggggtggttcagaatcctgcagggaaagctgcccccacataggctcagcacagagaaagaactcaccctgcagttcagatgggctggcactgattcaccagctgagcccctccacaggcagacgggattccctcgtattccccggtctctgatctcaagcaccgttccttccctcgcagcctcctgagacctgcctgatcattaagtgcactctctgcccagcatgaaagcagtgctcttaggaagatggcaagctgtgtcctcagatggtcttaatagtcctaatttccagggaagctatacatggtgctaaggctggatagtatttgtcagtgagaaaactgtttggttactccagagtgtgtatcacttgattacttaaaggatgaagtgtgtgagattttagcctcaggagggaagggtctccctatcagggcaggccaggggctagtctatcctacagccctcagcacctagatctttgttcataggggtgcttggtcaaaatgatgagtagatggacggatggatgataagtggctctgagcagcatcttccaaagtgggctatgttgaaaagggaggaaatctaccttgggaaatagaaataatgaacagaatagaaatgcaagcttgattcaaagaactacacggcagggctgctttgaaagcacttcctgctgctcttttttgtgctaggagttaatccaaccaggacttaaaactttccccaacaggtaaatgacccagggagctacttcctcagggactccattcccaggtgcatggcaaagctgttcttttccagtctcacctgcccaaccacctgaagggatgagatcatcagagcacagaaagtttgatttggggatagtgagtccgcgtgaaccattggctttaaataaaagcatcttttggctacaaatatatttctggaaatccacatgtaaagcaaatctgggtgaatcaaaccaaatcttgtcatgagaaataatggtaaatggagcgttatagggacatccctcaaactcgcagacatgcctgcatgtattttcctggcttatttcaatataatgaataattcattgcagagtaaaccaagaattagaacctagaaaagaggaatgtagacaaatttctacaaaataagaaaagaagatgcacatatgatggcaccacccatttgtacaagtgtgtggggctgtgtcaggagggttgtgaagagtatacaggagggagcagattatggcagaggatgagggaggatagagggagggaaggtggacaaaggagagagatgaggacaggatggtgcaggggagagagaagggagggcaaggtgaaggagttctgatgatctcttcccttcaggtgtgtaggggcaggtgagaccaggtaagtgggggccaccatttgtggtagatggtgacgacattaaacatgatgaagaggttactttatagtattacttcttgttgccttcaaagacttcttcagcttccaaaaaaacaacaaatgtgctgctccctccatgttggttctagaattatggctcacagtgcagtctcagggttgctcaagacatgcctgatggctgcagaatgtttgcagtaaaaaatctaatttcttttttgtagagatctctggaagatagaggtagcttctagagacagcagttctctccatgctgattcttcttttagcctcttttcttggctaatattaccaacttagcctcccaaatatattttcaccaatttatttttccaagtgactttgaggataatttggtcaatgtattggaaaggaaaaggtattcactaatttcctatcattgaactgtaattttatttctacaaatgccttccttggtcatgaagtagtattcgtattcatttaataaagttacagattccacttgctaatattatcactagaatttttaatttcaccttcataaaggagatttgtttgtagttttattctgggtgaaatgtgggctgttggtttcacattttggtattaggaccattgtgtgactttataatatgttaatttggcctggctgaactaaggttaggctgaaccaattcctcaaatttcctattctgtagttttgagctaggctggaccacagacatttttgtatgagatgtaatgaggccacagccatttttatttgtccacgtggatggtcagggcaggtgcttttggagttcacatgctgtcacttgtctgttgattcacctcattggcacagggcagcagctggaccagcaactgctccaccctccctcaaaccttccttgggttctctgactccagggccagttgtgtgcttagtctctccatgcattttaccaagagaaaaggcagtgggactgtcacaggctctcgtctgtcctcatgggtttgatccagcttgtgcccaggaactccagctcatgtttgctttactccatttgatatctgtgctcccttcccaactgcctgccctgtggacttgaagctccaccaccagacacaaccataatacagacacaattcagtcagctctcacagacacccgataaagtcagatccttttagatatgttccagtggctctaatctgcttctttaattgaaccctaatggatacagcatttgataccaagagtagggtgctgtcataactaaagcttaatatatggaagcagctttggaattgggcagtaggcagaagctagaaggactctgaagttagttagtgaagaaaggttgaaaggccttgaagaacccaattttaaaagcatgatggcttttgacataggtgttaaaggaaagtgaggaaaatatttctttttttcaaaagggacgtctcttcatttattgaggccgcttcaacatgtttacacacgcacacaaaacgcctacacacaaagtcaatgtcgtgataatgcacttccatgaagtcacattaacaacaacaaaatgcataaaatgaattggagctttccaaaagtggaaaaatcttattaaaaactggaggaaaggccatctttggttatatgttggcagaaagtttagcaacactgtcacctgtgataatgtgggaggtagaataaaggactagataatctagctgaggatatttccaggcaaagtgatacagatgcagctagtgataaataaggattcttattgctgtttacagtaaaatgtgagaggagagagagaatctaaaggaagggccattaaacattaaaggagctaggactcgtgtttttggaacttagcctctcctgaaggcaaacaatgctaagataaagaaatggcttccaggtaaaaatcacattcagggtgctcatgggcaagtactacctccagataaatttaggagtattactgtaaagtcctctgtttagaccccagaaagatataacgtggtgcctcggagaattgttcaatccaatagtagagcttccaagaagcttaggggaattgtcccttagcagaagctcaaggtagaaaaggatttatcctgaagatatctgtggctatggcttttgtataatggaatgaatgttcaattagatttgcaggagacccccacatttttaaaaagaagtatattagcataaataccaccagtttggactgcaagggagagagaaaatagaaaacaaaaagtaaacattggacccacaaatgctgactggaagcaggctgagaaatttttgcagctgcaaacatggttaccatttatgaaaatgaaagtacgattcagaaggcagaaccagagttcagaggacagagccaagagccaaggcaggaatgggactgagtcctaattttaaaaaaatctacggcttgcctggctggattttaaaattagtatggcaaatcctccatgccttccaatttccctttttgagcaagtatcaatagcaattattttatgcccaccccaccattgtacattggatgtgtgagggtcgggtaacttttctctttggtgcacaggtctccaatcgaaagaatcagaagggagtgcatttgagaagctgtatttcaggaattgcatccaatgagccccattcaatctagacttgacttaggggaaaacattctggacatagctaatgatataagggaatggatctttgagggggtcttggggaggggtgagtatattttgcctgtggaagaaatgtaaatcatttgtggccagaaggcaggctatgctggatttaaaatatatccacaaattctttgacacacttccttcaagatgtgcagcttcattcccctccctttgaatatggactggacttagtggtttcattttaatgaacagaataaggcagaaatgacagtgtgtgacttttaagcctaagtcataaaaaccattgcagcttcactcttgttctctctctcagatcactcattcctggagaagctggctgccatgtcatgagaatgtctaagcaatcctatggagtgccttacatggtgaggaactgaggctgctttctgacagccagaaaagaatgagtcctcctcagccaacagccatgaaaatgaaccatcttggaattgcaaactgcagccccagagaagcctgcagatcagtgcttccccagccaacaccttgactgcagccttgtaagaaactcggaggtcgaactacccacctgtgttgcttctgaatcccagacccacaaaagctgtgagccagtaaatgcttcttgttcaaagccactaagttttggggtaattcatcataaagcaatggataactaatgtagctctgttatatcagaaaaataaattgggacagtttccatattttttatgacatggaatggctaaaatcacatagaaatggtcaatttcttgggagtttgataggactcactcacaaatccatttggaacaggaagttttttaattttattttgaaagtagatccttgatagacataaaattttctctttggcttgtttgagttttcactgtaagagctccttgatatatttaaaatgactttggcttatttgactttcaacctcattttaaattgatcttggtttatttatgctttcctaggaaaggcatgcatttcattcaaactttaaaatgtcttttcagagagttgtttataccctacctttaaaattattatatttgtgtctatatccttttgtcattcataatgatgtgcttttgttggaaataattcttcttgattagattttccagagattatctttttattctctttttaatagaaacattggttggactcatcaatgtttgcatcttctttgtatattccagttccattattttctcttttattttgattaattgtgttatcacagcttcctcaggtttctctctctctttcttaagtctttggttgaaagataagcctatttttaatttttttgatttaataattaaaaagcaaatgagagcgtgacctcatctaaataaggtttttacatttgaagtttccagtatcattattgtataaatactctgcaatggcaatttgttattttttaaattgataaaagctacatccatttatcatgtacaacgtgatgttttgaaatatgtatacattgtggaatggctaaattgagctaattaacatatgcattacctcacatactgtttctcgggggtgagaacacaaaatctactcttttagcaattgtcaagaatatattattaagcatagtcaccattctctacaatagatctgtggaacttatttctcctcactgaaattttgtaccctttgaccaacacctcccaatgcccccacctccagcccctactgatcaccattcagcccgccactctcatgacttcacttttttagattccacttttaagtgagatcatgtggtatttgtctttctgtgcttggctatttcatttaacaaaatgtcctcctggttcatccaggttgtcacaaatgacaggatttccttctttttgaggctgaatagtattccattatgtacatatactccattttctttatatattcctttgttttttttttccttccaacattttttattgcattaaaatacatataacatgaaatttaccgtctttttaaaaaatgttactttaagttctgggatacatgtgctgaatgtgcaggtttgttacacaggtatacatgtgccatggtggtttgctgcacctgtcaacccttcatctaggttttagccccaaatgcattaggtatttgtcctaatgctctccctcccatcgcgccccacccctcaacaggccccagtgtgtggtttccctccctgtgtccatgtgttctcattgtttaactcccacttatgagtgaaaatgtgtggtgcttgcttttctgttcttgtgttagtttgctaaggatgatggtttccagcttcatccatgtccctgtgaaggacattaactcattcttttttatggctgcatagtattccatggtgtacatgtgccatattttctttatccagcctattattgatgggcatttgggttggttccaagtctttgctattgtaaatagtgctacaataaacatacatgtgcatgtgtctttatagtagaatgatttataatcctttcggtatatacccagtaggggattgctgggtcaaatggtatttctggttctagatccttgaagaattgcaacacaatatattcatttgttgatgggcacttagtttaattccatttcttggctattgtgaagcatgctggaattcacatgggagtgcagatatctcttcgacatactgatttaattctctttagatatatacccagtagtaggattgatggaccatatagtgtcctatttttaatttttgaggaatctgcacactgatttctgcatgactgtactaatttactttcccacgtacagtgtatgagttccctttcctccacatcctcaccagcacctgttatcttgcatctgtttgatattagccattcaaatagatgtgagatgctatctgattgtgcttttcatttgcatttctgtaatgatgagtgatactgggcatgttttcatatactggctggccatttgtatgtcttcttttgagaaatgtctatctggccctctgcctttttttgaaatcaagttgtgtgttttcttgctattgagttgtttgagttccttatatattttggatattagccccccattagacataggatttgcaaatattatcttccattccataggttgtctcttcactctgttgattgtttccttgcctgtgtagaaactttctagtttgatgtaatcccactcgtctacaatagtccgtgcttatcgatgaggatacgttttaagaccccaggtggatgcctgaaatctcagagaatacccaaccctataaatactacattttttcctacacatacaatcctatggtgaagtttaatttatgcattgtgcacagtaagagcttaacaacagtaactaataaaatagaacaatcataacaatatgttatcataaaagttatgtgaatgtagtcgctctctctctccctctctatatatctcactcaaaatattgcactgcactgaaactgtaactaaaactgcagaacgcaaaaccatggatgagggaggacgactgcattttcacttttgttgcctgtgcttttggggtcatatccaaaaaagtcattgcacagattaacatcatggagcttccccgttatgttttctagtcgttttgcagtttcaggtcttatgtttaattctttaatccattttcagtggatttttgtatacggtgtgagataaggatctaatttcatttttctgcatgtggctatccagttgccccaacagcattccttgaaaaaactgtcctttccccactgtgtgtttttgtaactgcaattttgattttttcttgtgtcaagtgttatctataagattgaaatgttttacttctcaatggttgaattttcatcatccatttttatgtggtctgagaaagtgatctaaacactcttaacttttaaaaatattttaaatttttgcacatggcccagggatatttcaagataatatgtattatctagagtgcaaagttttatatatttctatatatttgtgtgtgtttagatatacataagcatgtgaataaatataaatatataaagctatagatattatatatatagtcaccctgtcccttctgccccaaacatcccctctctacttggcatacttctagtcttccttcagaaacacaatcaaacatcatctcttctgcaaagctttttctgactctcagccacaggagaccattttctcaaatcatctctgggtcgtcagaatacttagttattttgctgtgattggagtgatcccatcctatgctagtcagtgtccgtctttctccttgagggcaggctatgtctctctccgttctgcattttcagggattagcactgcactgggcatcaagtaggaacttggtaaatgtttgttgagtaatatatttccaaggtcaatgactctagtgtccgttgggcacacattttctttgtgaaatgttatattatattaaaaacatgcagattagctaacttttcatttaaagcataatattacccttgtgttaaaattcagagcttgtagcagattcattgttatcaaccctttttcaactttagtctcggcaagcttcattattccagtctgacaatccagtctgatatttggagattagaaagacatcccctgcctgtccctaattacctggttatgcaggtagcagactaggagaattgctgctgactttgaaggtcctgtggacagtgactttaaaatcctcagaatgttcagaactatttacccaatgcttgcctagtggcattaatgctgttccatatggtatatgcaagttattttcattttttaaaatagcttttatttttaaagcaattttagattcacagcaaaattgggcaaaaggtacagagagtttccatatacccccagttcccataggcaagatattttctaagaaagaatatttaccattttcttcaatgttgtaagaggacaattctttttatacatttatattcaggggcttaggttgtaacattttcttcttgatgctactcaggcattttcaagggcttttaacatgcagagtttctttttgtttgtttcaatttacacatggtccatggatcaaagcaaggctgttgtcatcctgccacttccctgaatgctcattgggtcatctctgtcatggacggaaaggcacaattggaggtaatgtatacagaaagtgtctaattattgcttgaaccctgacctgagagctttctttctgcaaaagagaagtggctaacactttggcggaatgatcatattctcatgttcctatcccaggctcacgtgtgagataatgacatttataggtgaaagaaaatgtttcagtttacttccttgtgcaattaaagtgatgttgagacatataatcctctctctctgacaaagattactgtccaaagaatacaatgtaatcaacaggcggctggacactcatattttttcttctagcagtttataatggacacagctatgccctctacagaatgtcagaggtgagttttgattaaaaaaagtagatcaactaacaataattttggagtgttttgatcaatgatggaaagttaagtgttttaaaaatgtttccctaaaaggaactttatttcctatcttttttttaatgtggttttatcatttctttcactttcataggtcaataggcacgaacaatctcacagtgctctgtcctattatatgaagatgacttctaaatgtcctaaatattatgctcccatccacagacatgagcggctgttcttgataagttcggtggagtgcatcattctcccagaagctctccagggaaaatggaggaacttccccataagaggctactttgaacaatttcttcaaactccttcaccagaaaatgttcccagtgcaacagaaagaggttaaaatggttcataaatttgtaacaaatctgttgacaataaagtaattcttgtcagaccagaacagttaagagataatgaaaaaatagcgtgccctcttcaactgtttcctggtagctaagtatttttttttagcaagtttgttttaattctttcctctgataatttaggtagcttgagcttgaactaattaaaacaaacatggaaacaaggatggaatagcctgacaaaaagatgtattccatttgtattttaaatgccagctgaaaggctgtgtgttaaagcattcttcttttttcgttgtttttgttctacatcattaaagatttctattgtcagaaagattatagattaaactgtccctccaaaagagacatttggttatgtattgtcttagaagaagggtgaactattctcaacctttctctatcttggtgaacaagttatttcttttgggtttacagcttttaaggcttctttgttgatggaagaggcaagacaagtattttcagaagcacacatggagtttggagaagcaatgaacatgtattgtgccactactagacatcagttccttcccggaagttggtaatcatcaccccacctgattgtcaccctcacacttggagctggaggtacgaccttcagttaatgaacggagttagggcaagacctgaaggggctgaggaattttctcaaggtcataacacctataagtggaaggcatctctgggttttctatgtagcctggaaaatcttgtgtgtttacatagtcagtgttctcccattttctgcaaagctgtgcccactacatcctccttcccttccactctctgtaccccatgaagggacattgcttgttacccccagtacccacagcatggaaacaagggattggacagatgagatgttccactctcctttactgaaggttttggtggtttattcagatctaaacccatagagtgtggagctcattagaccagggaagcaagaacttctatggggctacgtctctgctctgctcagccctccagggaagcaggagccttgttcttgactctgtattcaccactggggccacaccctccagcacgcagggagagcccccattgtccctcagttctgccacgtctaccccttcacgaccaaccacacctgatgccttcgcttcagctgagtgcagatgggcttttccctccctcatccagtaagatccctatgctgagctcactgacgacacatctttaattatatccatgggcaatatttggtccttggtttcacctctgcccagcactccatgcggttcaccttccctttgagggacctcatcttccctgcctccgggaagccacactctcctgatttccctcgcacctcaccgatagcttctcctagtaccttcgtggaatttgcctgtgcttgtcccacatctcggctgatggctcctcttactccgtgtctgacccagacatttctcctgagtttaaggcgcgtatattcaaccacccaggtaaggtgacacgaggatgtcccctgggccctcagtgtccccgtgtctgtgctggctgctctctgcctggctctcccccatctccaccctgctccgtgcccgggcagtgacccttgtggactgcaccatgggcccctcacccttgggcttccacaggagacttggagagcccaggcagagttgggggctctctccctccctgtggggctggggattgactttgtgtccccttctgcacagctgctccctctgactcagtaacggatgctcccttcaccttcaggcctggaggatgtgctggcctcctgcccccattttccagcagcttcattgtccctggttgccccttcatccctgcccaggccagtgccattggtgcctttgctaccctcccctgggttccctgacaggtgtgccctctgcttctgtggccagtgtgatgatccccctgtgtctctgcctgctcttgcccaccttcccccttgtccactccctgttcatccctgtttctgagtttagtgactggcccctcaccacccagttgccccagccagggcactgtgacccttccttgacgtttttctctccctcaccaccaggattcaccccattcaagcttccaacctctgttcttgggctctccatcctcacggccacaatccttgtctagaccactgttatcttccagcaggacatcacctggtcttcctccctcccctgcctctgtgcccttcaatgactctccacactgcagtcaggacaagtctttctagaattcaagcctgattgtgtcagtgcccagtaaacctgtgttgaattcccactggagaaacccctcatgtgccttctacagccctgacgtccctgccggcactttctcccctgtgctcactccagccatgctgaaatggcctccaacgcaccatgcctcctcactctgactcctacatgagctatttccatgtaattgtaattgtgtggaactgtaatccacctggctaacactgatccttcagatagtcatcgcagacatcacttcttccaggatgccttccctcctgcccccatagctgctattctcgtgctcctatggcgttccacataccgtccccctcctcatcattaacagctgtgacttcccagacacgatgtggcaagagttgcactaagtactctgcatgaattaccctttaatcatcacaacatctctaagagctggtgtggcagctgtacactagatgcagcccattttctcatctagagcatggattggcaaacttttcctgaatgtattttcagctttttgggtctcagggtttctcttgcaacgattcaactctgccagtgcagcctggaggctgcccgggaccatacgtaaataaatgagcctggctgtgtgccaagaaagttattactcaacgaggtggcaggcccaatttgagctgggggctgtcgctgagccctgctctagactagactacaagactcatgaggttagggatgctgcgtctccagcatggggaccggcacacaatggtgcttcaataccatttctcctcccactgcctccaaggacggatttggggtgggatgaatatgaggaagaatctaggtgttggcaattgctgagcaagttgacttctctgctcaatatgccatcatgtccctaagaaagtctcccttttgctgagcccaagtttgctccacatggctcttagccctggtccttcctctgcttttgggagctgcagacagaaggtatgattcatctcctgcggggattccttctttggggttccggctcctgcaggcccttctcggattaagcctctcccatcagtccccatccccatggtgtccagactgtcctcatcctctctccctcctctgcaggctccctactggcaatttcccctttaaaggacactctcccagagggcaacagagctctccagactcctgggatgccatggtctaaactctgtccaaccttctatgcagtccgggcactcccagcctctaagaagtcactgcctgggctctaatggggtcacttgtgggctctaccaggaccagtgtcttggcaattcccaggcctttcttagcagagctgctgctttgaaagcagggctttccccaccaccccatttttctgagatgtttcttagttccattgatttttttttttaaattctacatgcagaatcatggcaggattttcatcttggggcgatatggtgaaaacactgttaggaaaattcattcagccctggattccaggatggattgtttaggggagaaagggaggcagaggggagatctaaatgcaagatcacactttcttactgagtggtgttgagatgatttctgcttgaaaatatggaaaaccatctcatatttcagaaattcttattgcaacatgagaggggctccatttaaaatcaccctcatcagtcaagggctctgccaaaatgccaaagcttccatgaagcctcggtcaccacgagactccattgtcattccctgtctcccctaataccttttcagcctcctgtcacacacccgccagcacctgatttgggctagagctcattagatgtgtggcttttggacctatgggtcactctgagttcttcaagaatgggacttgtcccagcccagggtctcggccttgcacaaggttgtggacttgcgtgggctccggtgagtgatgggacgctgccacaggtagagagcttgtggctgggaccagcggcagcagcctgccccctctgtgctctgcttccctgggagcagctcagcacacctgctgtcccagccctcctgcctctgtccctgggccccatcctggctcagcctccctgctggagctgcactgctgaccttggtgctgagtctcccgtgcacgtcactgagtagtggcctctgcaggacctcatcatccctgctgctcttgctcacgctgagtcataagacataggtcttaaacctcctggcatgaagctcttagcaaaataattttgcagaggtgactgctctgtgttcccagcattaaataacacaatcacggaagcttctcaaggttctccctgcttttcagtctctcagcatgtggcttgaattttcccaaatcgcctccatggacaggttaactatgcctggaatgtgaagctttgacaaacttgtacacaatcaaacacctgcttggcatgtgggagggctcaatagaggcaggctgagtgagtgagtaaattagtcgatgatcgaatgaatactttctcctggtgacctttctttcgatagtcataaccggacacagagttgagcagcactaagcgcagtgcatcagtgtcgtttcaacaatttccacattctttctaagggctccattcttttccttgaaatccattcactatatttcccatttattttttctactgatatttctgcttctctgatgtctccttgaacaactgagctgccagattaatttttcaggagtgcaacttccatcccagaattatcaaatcactcactcaaaaacttctaatgccccactgcctagatgcttgtcacaaactctggggcaggtctttgaggcacctcagtttctcccaggctgcctctctagcccttctcacactgttccttcctcctctgcgcagctgcttctttccagaaacttctctctgttttgttgcctccagaccactactatccccttcagcaatgaggcactcattccccgagctgctgctgggacagctcacacctgagcccctgcccaggcacacatgctccagtggctgaccgacgcaggggtaaaaaggtcttgtctccttgccctgcaggtacctctgaaaggcccaccagctctcagtatgatgagctgaggcctaaccgcagctactcaattctccttcttccacatccttccaggtgttggtcctgagtgttccccccagtaaacctcccgagcaaatctcagtctctcatccgattcccctgaggcctgaactgctgtgtaatatttcactgcatggctgcaccacatgtcattaaacagtgccctccttaggcgcattcagcttattttcagcctttgactattttaaacgttgttgaaagtaacatcttgaccacacatctttgaacaaacttcagatgacttcctcggaatagcataacaaggtgcgtctgaaagtgtggactctgaaagtccctgagaccctttcaggaggtctgtgaggtcaagattctttccacaataatataagatgccttttctctttcactgtgcagacatttgtacttatggtacaaaagcagtggtgagtaaaacagtgatctttagcaggaatcaaagcagtggtagccaactacactcctggtcattttgtgtactcacaattttttttaaagcaccagccgtacacggtgattcatgcctgtaatcccagcactttgggaggccaaagcgggcagatcacttgaggccaggagatcgagaccaggctggccaacatagtgaaaccccatctctactaaaaatgcaaaaaattagctatgcatggtggcacacacctgtagtcccagctactcaggaggctgaagcctgagaattacttgaacccaggaggcagaggatgcagcgagccaagatcgtgccactgcactttagcctgggtgacagagtgagaatctatctcaaaagaaaaaaaaaagcaccagtttcacttaagaatgtttttgatgaagcagcataaactattaattttattaaaccttgccccttgtgtacatgtcctttatattctccgtgttaaaatgcgaagtgtgcatacccggtgtgcacgttatctcaaggaaaggcacctgtgcaattgtttctgttctgagctgaatgaactgcgtcttccttggaccgtcattttcgcttcaaagaaagactgacagacataccatggctattcagacttgggtatttgctagacattttctttaaaatgaacaaagcaagcctgtcacttcaaggaaagcaactgacattattttttgcccgtgataaaattcaagctttcaagtgaaaattggaattttggaacattccttcagccaccatgagcttaacagtctcccttgacttaaatacttcactgatgacacaggtggtgattttaacaaagatgattttttaatcctgtacaatgaaatgtgtcaacatttggaagatctgcataacagtgacctgccattttccaaagaccaatgcctgctgttatgtggagaaatgatcctttcaaagcacaagatggaccaagagtttaatgtagcagagcaaaaaatattccctggtggggtttctgattctacattgcaatatactttaagaacctataacttgctgagtttttatgtagtctgtaagaggaatatccacaatgattggaaaaggctattaaaatacttttccaacagcatatctgaatgaggcctgaatttcttattatacttcaaccaaaaccacagatcacaacaggttaattctgaagattcagccatcttctactaagccagacattaaagagatatgtggcaacgccactctttgcattatattttgtttgttttgggaaaaatagctattttttaaaataaaatagcgtatgttaatacatcatggctttattagtattattttaaactctatcaagaatttagaagcatttttagttttattttctaatacgataacattaatagatataacccacattaacaaaagttatttgggggtcttcaaacatttttgagagggtaaagtgcttctgagatccaaaggtttaagaattactggcccagttaatccttgtcctaatcccgctctcacctagggaggagaagacagtaggctgataggacagtgactgcatcgcacctgccactaagcctggggatcagcgtgcattgcactaaacacagaagcacaggatgcccccactgcttcctacccagtgtggatggggcacgagcgcctggtgctggctgcctgcctgtcctcttgcctctcttcctggcagcttcgacatcacatgggtccggcatccttgtcgttcccgttcttggatctccgaggtcccaggagtcccagtagttttttcacttctcacttcataccctagactactgtttttcatggagtcccattgttttccaaatatgttgcagtttttccaagtttgttgtttgcttttaaacttttttgctggtgtcttttgacatacaaatcatgtcgatgttttatataatgtaaattttttttttttttggagatggagtctcactttgtcacccaggctggagtgcagtggtgcaatattagctcactgatgcaacctctgtctcctgggttcaagtgattgtcctgcctcagcctcccaccaacatacccagttattttgtatagtaatcatttaatttatagcttttgctttgctctttcatgttgactaaattatttttttaccataaggttataaaaatattcttctaaattttctttggaattttaatgtcttcttttttttagatttatccctttaacacaattggaattttaaaaagttattttttgaagttaatcggcatacgataaaatgaatgcacccatactaagtgtagatttgatgtattttatatttccacttaatatattaaaatctatataccatgcatgtacacactgtcaaatgtaaacatcactgtataccactatttagacattcaactattgaagcataattgagttgcttctgttttggattagaaataatgttttgttatattgttaataaagctgataggaacatttatatacaagtctttttgtgaacacagttttaaagattatatattcaggccgggcgcggtggctccgcctgtaatcccagcactttgggaggccaaggcgggcagatcacgaggtcaggagatcgagaccatcccggctaaaacggtgaaaccccgtctctactaaaaatacaaaaaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcacaaaaaaaaaaaaaaaaaaaaagattatatattcaaattggttgttactgatataaaggaaagttgctttgaaaatgattttaacgttatatgcaggaattttaagaaatgctcttgttaaggagttttaatcatgtttcttagaaatgctcttagatttttctgggtagacattgaggtaatcctctaatgatgattatcttgtcttttcctttgcaataaacattttgcttcgtgtttttgccttattatattagttacagccttcagagcaaagttgaagaatagcaattattcttgttcccaactgtatgagtcatctattgttgtgtgatgttatggttgaattgtgtctcttaaaattcatatgttgacatcccaaccccaacaactcagaatgtgatctaatttggaaataaggtcttcaaaaagataagcaaattaagatgaggtcattaaggtaggctgtaatccaatatgactagtagctctgaaaaggagacatagacacacacgcagggagaacgccatgtgagcctgaagacggccacccacgagctggggagggagccctagaaggatctcttctagccctcaggagaaaccagtcctgccaacaccttgatctcagactctggcatccagaactgtggctccccataatgcctgttgtttaagccaccagtttctggtactttaatactgcagccctagcagactagtacatttaacaaatcaccctaaaacatagtggcatagaacagtctaatgatctgttattaagtctgatgcttgtgggatgtttctaatagatactcttaattttagaaaatttaattctactcttggaatacttagaattcgtatcagaagtggattgtgaccatactaaatgtttttttggcacccatatagatgaccatatggttttctcatttaacctcttaacataatgaattgcagcgatggcttccctgatgttctgattctgcccgtagtacagtttatcttctctccccttaggtgagttcattgagggtgtagccgtccctgtatcctccgtgcctggtgcgggggctggcacacagcagactcacagttaatgcctgctgaaatgcattatatcaattatcatttaaattcaaggccatcttcttcaacttaaatcagatggaccactggaggtgactttttttttttctagttttcagcacagcttattcctagacatcccttgagcagcccacctgtgcagccacaagtttttccttcttccctccccctccccagtcccctttccctaccgagtaccttcctgttctgcaaacacagctatgtcttctcttcttcattattcaacaatgagaggtgtctattaaaaaaagctaagggcaaagtgcattatttgtatttataatggcccctctttctcacctgaagatgaatttgccttttttaaaaaactggttttggggaataaataattctccggagtagtctgaaattcacaaagaagtagcctctgggagactgtaatgggaattttggttccaaagtttttatttgtctcttatgattttactgttttcaaaatttcattggaaaaaaatgggggcaaagtaaggcaatttccaactctctttttttaaaaaaaataattttttagcagtttaatcactgttgtaccttcattaggagaaaagaatacgatttaattaccgtgagtcactgcaagggccaaagcaaagctgtctggaggtttgcaggcatcgggcttcgtgcacttcagctgcctgcacagacacgcccttgaccaggagtaacgatggaggcccaggaaaatgcatgcagattgcgctcgagtggcagagtggggactagaaccccagcatcctgattttacattttcacactgctggattcaatgcagagaacagctgctgagccaggcagtagagagtcagcattgctttggaggaggatcagctgtgagctcatgggcctgggagagaatcaggcaaaggaagaaacggtccaggagagatcccttgggaccaggagccaggacggctcgaggcacccagccatgctctgcgtgacccagcttcttctctttcatgagtctcctaactcagcctagaagagtcagagcctctgacatggtctgtaagccccccttctcctcccctctctctaactgcaaaccctcattggaagcaggtatgctccacaaacccacagtcagcaataacctctctataactcagtttcttcacctctaaaatggggtgaataatggtgctcttctaggattgtcgtaaggatagaatgaggagacacatgaatgcctgatagacagtgagtattcaaaagtatttgttgagtactcactgtctcaactaatatatattccttatatattagttttttattgctgctataacaaattgtcacaaacacagtggcttgaaacaacgcaaagttatctcatacttgtgtaggttagaagcctgatacaggtcttaccgggttaaaatcagggcattggcagggctgccttcccttctggaggctgtagaggagaattcgtttcctcgctttctctacttctccaggcttctcacatttctttgtgtatggccccttcctccatcttcaaagccagcaacagcaggtcaagtttgcataaagaatatctctgatctcctctccagcctccctcttccacatttaaggacccttgtgattacattgggtctacacaaataatctaggataatttctctatcttaaattcagctgattagcaaccgtaattccatcagcaaccttagttccccttgcttataacctaatataccataggatccagggattagcacatggacatttttttttggcggggggcggggggcggtggggggagtaagcattcttcttcctaccacctctcataactatttttataattgctaaaacaaaataataaaattagcacaatagatatggtaagaattacattgtactcactcttgacaagtggctggattcacagtgtgataactgagaatgaagactcgggccagacagcctgggttgcgatggcagctcctgtgtttacccactgtacagtttgagcaagttacttactctctttgtgcccccattgtccaatgtttaaagtggaatgacaatcactgttcctcccttatacagcctacacgaaaaaccctcccaggatgctggagcccagcacttgctaagtactttttaaggactagttgttagttgttaactgaataaagctccctcagctctgccctcttgtgtggggctcaaggccacactcaccctggccgtcagagggcagctccgagcccatgtccctgctgtgcctgcaccaagcactcactgcacagatgtttcttcttggtgtttcactttgctttgcccctatttccaacaccctctgttcccaacgagcatctcaggagggtctcctgattctcccatatttgaatccaaatccttgcagttcccaaagccgactgctatggtttgaatatctgccccctccaaaactcatgctgaaacttaatccccaatgtggcaatattgagtggcagggcctttgagaggtgattgggtcatgggggctctgtcctcatgaatggatgaatccactaatggattaatgaatgaatgagttatcacgggagtgggactgctggctttataagagagtgagggagacctgagctagcacaatgaaccccttcaccatgggatgccctgtgccacctcgggctctgcagagagtcctcgccaacacgaaggccctcaccagatgtggccccttgaccttggacttcttagcctccataactgtaagaaataaattccttttctttataaagtacccaggttcaggtattctgttataagcaacagaaaattgcctaagacatcaacagaagtgaattcgtagacacagacacctgtatccttcctgacaggttgggttctaaagactgttcctaaggccacatatacacatccacatatacaaagactgtgcacacatgcacatatacacatataaatgtactctcttgtcatcctttttcaattaaaaagatcatctttattattatttgcatgaccatacctccctctgtcttcacctgctgctgtattaaaataccataggctgggtggcttataaacaataggtattgacttctcatagttctggaggctgaaagtccaaggtcaggatgccagcatggttgcattctgctgaggtactcttgcgggttgcagactgacttattctcattgtatcctcttgtggctgaaagaggggcaagtgctctcaaagatctcttttataagggcactaatccgattcatggggtctctaccctcatgacctgattacctcccaaaggtcctagctcgtaataccatcacaatgaggggtaggatttcaacataggaatttggggggaaatggggcacaaatattcagaccacagcaccttctcattcatagtctcagcatttgtttacattctgattggcttggtgcttatcagacataatgaagttaaaactattatagccacccccccaaacttgagcatgagtttatccagccagggagcagcccaatggaggtcttgaagacagtgtgaccactaatgccatccattgatagtgggcaagtgggtgcagacaggctcttgctgtagctttgttcattagatgaaagaccctgtgcaaaggcacgtcggtgttcagatgtcacggttgagtgggattgcttcagtaaggctacccagggagcccaggcagctgcagactcatttttagcatctcactgaagggtttcatctcttcaccagctttgagatatgagggggatcttattgtcaaacttctatgatgctccctctgctatagagtggtctcacaggcactgtaaaccccaatagatcagaagggaatgagagaggcaaattgctcggcataatctaagttcaggagcagaaaagtaaaacagggaatttaaacataaccgtgctttagcagaaataaaaccactgtgagatacacactagaagaacattgtcagtgtcatagaaggatgtttgtttaattgttttctgcaatttagggttatgctaggtcttttgtgtgtgcatttgtgagttgaatacagaattgacattgtgaaagttttagaaattttgctaaatttctatttagtctggcttatgattccaaacgaaaagttcaatgataaggtatagttttaacaagctatttggcaggagaaattccatctgagtttggggacaagttctatactcttctggcagatgaaaaatgatggaattattttgcaaaatctcctcctgtttgtgtattatctgtccgacaacaagatgaaaacattaagtaaatgaagtccttcatcaagcagggaaacaaatataaatgtcaaatcttgatgcaagtgttctggaatctggaaaagataaaaccaaattaagtacatttattcaaatatggaattgttttactgtaagattagagcaaaataagccataccatgagctatgtggtgattcaggggtcactaaataaggacagtgtcacttatatttcacatggccttgtcagagttaagagcttgatgcaggctctcagttgagtcctcttcattcccatacagctgcctttaaaaaaattaacagcctttttttcttagagcagctctcaatttacagaaaagttgagcagaaagaacagagttcccgcattcccactccctagttccctctggtattcacctcttgcattggtctggtgcatttgttacagctgatgagctggcattgctatctgattattaactgaaggtgttggcttacatcagcgttattccttgtgtcttctagttctataggttttgacaaatgcataatgtcacatatgcatgattacagtatcaacacaggatcatatcactgccctgaaaatgccctgtgtgggcttccctttgttggagccctgtggcaagcatgcatatttgttttgtcttagtctcctaacgatcgtccgtctcaggatctttgttcctgggagagcctcatgtctgtgctttagtcccagtccctctcctggctcttgcatatcgtgcgaggctatactgctcccaaagtcctcgcagcctgactttccttctctggcactgccttgattacttttgccctccacccgcacttccatgctccctgtcagtcttgggtgggagactgacttgctctagacgctctagacagcgcatcctacagcctattggatggaatttgattcgtattttgcaccttgccagtctttccatcagtggccctggcaaagcgtcagttcggctcctccatggataagtaacatctgttttatgtaacgatccggcactgtctccattctcatgtccctggttgtatccccagggctcatttcctgtgcaggaaactgccgcaaggagctgtctatcagtacctcttctgaagaatcgaaatagctgattctgtatgcaccgtcactggccacacttgaagcccgcctggattcaaggacattagttcagctcccatgctgaccgtggtaccctcgcccgcactttcccgcagagggggtttaattgttttttcatgatgctgggaagtaagtggctgggcctgcatttatactcgaagcgcacgttcaggccaggtcccagatgtggttcccctcttagccagccaatcctgaactgtcagagtttaaatccaccctgcttctgtctctgggcctgagagtcctgaactgagatctgagcccctggcagtggtcccagcacttgttaggatttgcgctccacgagaaaccagctcttcagagactcacagtccccttttcctgcccagtggcctttgcctctcaaaaattaatcttgtctgatcgaagaggcttgttagcctccagaccccagcaacagccgcagattggcgaggtccagcgggccactcagtttccccgtgtggactgcggtaatcacaactgcttaacaagcactcctcgcctctcccgcgggccctggctagtagcacaccatgcagctgggcccaggtagaccccaattccgcccaagcccaggacttcacctctccgtgcttgctgagcccgagcatattgtgaaggtttccagagggggagaccatctgtctgctcgcgaacgcacatggccctcaggcagccgcctcttcctaggatcctgctctcataccctgtggggctggagcagccgctgcacagcatttggcagctggtgcagcagtcaagggcacaggcgcccacagtgaagacccctgacctggctgctgtttgcatcccaagtgcaagaatgcaagtggaaacatctgcagcgatgaaaaggagaacacagagggcaggggcttcgccatctcatcatgcctggggtgaaattttgtgccaaaacttgtcggaaagatttgggctgtctgaaagatttgggaggtgcaggactttgcaggtgaaggaatgaggacagaagtctggacagagatggagacattctgagatctctttttaaaaaccagaaacagttgccacattgtaaagatgaggaagtgattggatgtgtggacatgctctccccagcgacccagtgaaggctgaaatgtgggttcatgttcttcatattccttctgttgcctcgctaaggttgacaaggcaaagagtcatggagccaggctctgggctgcgcaggtgtctgcctgccccgtgtaagagtaaaaagccactggggctgtttgggcagggttggcgtcatctgcattgggtaatcatgtgcaggatacatgggaggtggtgagatggatggcaaaggcctacacaaaggtggtggcagcatccacaggaagaaacaggcagcctggagagctccggagggacaggctgacatttctagcaaactgttagatattataaagagcactgtcagtgacctctgggtgtgacaaggaagacagcaaggccattatcaaagctaagtagctcaggatgggcggtggggtgaggacacaggcaagagagggtaaagcgtgggcgggctcgctaagtgggagctgctgttaggcccctggaaaaagtggccgtggagctcagagccagggagggacacgataggtagacagagcaggagcagagggattcatggtggaaatcgtggggcgggcacatgatttcttcaatggctgcaggtttgcaggaaaacttgatggctaggaacacaaaatcttgaaggccctggtgaaggggacggtggcccaccctgagaaacaatgacagagatgtaggacaagagctagcggaggcttccacggagggagtgaccaaccatgtcctgcgcttcggggaggtctggaaaaccagctcaggggtggctgcagagggctgctccagtacgtgctggaatgtgtccaaatactaatagacggagggctgagggggcgcagtgattcagaggagacacgttgcatggatcctcccataaatgtcaattaagcactgaggggttatgcctcccaagggctttcaattaggaggggagacagacatctgaacaaaatagacgagtgcacagcgtcgatggggccacgggcccaaggcaggccgttcctttttggagcatgaagagaggcttctcagagagagcgtcttctgagctgaattttgaaagctttctagcaaaactggaataaacaaagctgtctaccataacatagatctctgctgtgtaagcttgtgtgcattcccatcctctctaaagactgagtttccttatttaaaaatatgcagggccgggcctgtgttctgtatgagtgttttttcctccagaagtgaagagttaaaaaaaaaaaaaccttgaaatatgcaaaacattatggatgttcctgaaaaaactaaaaatagaattattatatgatccaacaatttcattcgggtatattcccaaaagaattaaacagggactcaaacaggtatctgtacattcgtgttcatagcagcatgattcgtagtagctgaaaggcaaccaacagccaaaaggtggaagtcacctaggtgtccatcaacgagggaatggataagcaaaacatggaatattcatgcaggagaatactaggaagccttaaaaaaaagtatttctgatacatgctgcaccacggatgcactttaatgacattattctaagtgaaataaaatggtcacaaaaacagatagtgtattattccacttctaagaggaacctagcatagtcaaattcacagacatagaaaatagaacggtggtcagcaggggctgggggaggtgaagagaggggacttgttgctaaatgggtacggagttttcgtttggcaggattaaagagttctgggtggatggtggtgacggcttcaccacaatgtaaatgtactcaatgccgctgaaccggacatttaaaaaggattaagatggtaagttttaagttatatgtattttatctcaattttaaaaagtgacacttgggactccaaaaggctggaggatgggctagaaaaattacctgttgagtacaatattcacccttcgtgtggcaagtacactagaagcccgaacctcaccgttctgaaatatatccaggtaacacaccagcgcatgtagctcctgaatctaaaatttttaaaaagtgctgagaatacagatagaactcatgattcctaaatttttgtaaaattgggattttgaatttttatgaaaatgaaaccattgaaaaaggcaaagcaccttagacttggtgtcagagacttgagttttatttagtttatttagtttggtttgatctgagggttgggtgggcagctgtgtcagtggcagatcggcactgtggctccaggctgagggtttggcacctgtcctcttcacctgttgcttctttgacccctgctacctggggcatagctttctcatagcaagagtcaagaatacaaggggccgatccaagtgtactgtgctggtaaggcatccgctcaggtcccattcactaacattccattgagcaaggcaagtcacatggccaaggccaacctaactggagaagaagagtctgctggcagggtaggggctgcagagtaacctggcaggggtggagaggcgcagaatcccatcacagacggcgaaggagcagaatcagtggtccaatctatctccatcacactccaaaatggaagtggttttcctctgacttcagaaacccaatactatttcacagtgaagatggccattttttgttgctccaatttatttgatttcttggacgatcttttccataaccagcccttaattttcatatgacagcgttcgttttgctatttgggtaaacaaatcacggcctcctggagaagccactgcttctctgtttgttctatttctgtctgtgaaagtggctcacagaatctgaactccctgacttacgtgtgctccgcctgcatccttcctgcctactggagtcacacttttaaattcttgccaatagctattttgtgattttcacagtacatcaacttcatcacagtgagtagcctgaccccagtgtctagctctcgttaatttcctaataccatcttggtcattagttggaaacaaatctagacattaagcattcctgaaaatgcctctgacatgtaatcatttaccatattcgtcatttccaccttcattatgctctgtgtcgggaaagttccccaattaacattggggagattgaaatcagacatattctcatcacagctgagctttcctatcagggctctcctgtttcaaagtaactgcatgggcagacatgcagatggcagaatttttattagatggtatggcccaattttcctggctcacagaaagtaaaagaggtagcaactcaggaagaacataaaatgctaattcttctactcaatttctcatcaatggcaaacattggcgaacatccaggtgccactttatgtgtcggcacttagagcttcacctgttaattctgggcttcaaaacaacattttgggacatgttgtcttggtttattgtgaaatgaatagctttccagagagagacctttccctttgccaggatgcaaacattgcttgtcgggggatacacacctgtgtgctcccgaattcagcagcaggagaatgcagtgtagaggccaagacagggcgtggactctgcagatattaagcagtaagctgagctctgtgatatcaagtgaccaagccagaaataccttgcttggagtgatgggttctggtggaacatccttgatcatgtggtgacactgcagagtgtcagttgatgcagtgctgaatgaggacccaagcagacacagtgtctttgcaagatgcttcttgtatgagtgtcagagtagaagaaagacagttggtgatgatcaggtctgcaactcttgatctcaggcagtcgaaacgatagaaacattaagtttgtgccaggaaggcctttacatactgggctcctctgtgagccaggcaagccccctgcttgctcaaagcagagatgcctctctagggcagattgcccagcaataggacaatcgatattcttcagtccccatccaaactcactctcctggcacaacctctgtgctgtagctgggcaaatgcctggcttgaaaacactcattcaaagatgagaagcaccaaaaaggaatctgtatgggtctcagaagtaaaactgcaaaacaaaaggataaaaagaacatttgataaaaatcagatgtaggaccaaatttatcaaattgataaaaatcaaatgtaggaccaaaatacacaaatgaaagagttatgccctgaaacagcacatactagtaaacaggcacttctctgtgatagcaaaaaaataaaagacagtgtggtcacatggaaacaggcacacataagtgagctataaaaactcaaaaggaggaatgaatgtattggaaatatagaatcagaaaactaatcaattaacttttttttttttttttttttttttttttgagatggagtctcgctctgttgccaggctggagtgcggtggtgtgatctcggctcactgcaagctcggcctccctggttcaagctattctctggcctcagcctcccaagtagctgggattacaggcaggcgccaccacgtccagctaatttttgtatttttagtagagacggggtttcaccatgttggccaggatggtctcgatctactgacctcgtgatctgcccgcctcagcctcccaaagtgctggggttacaggtgtgagccactgcacccggtgaaaactaatcaattaactttaagagatgattctttgcagtgggggagagaaagcctagctagcatagttaagaaaaaaggacaaagcataaatataaaaaatcagaaatgggagtgaaaaattaaaagcaagtacaatgtgataaaaataattgttatggaagt

SEQ ID NO: 11941 - DNA, 81433 bp, Human
aggtggtgaagggcagaaagattggaagtcaggcccacagcagctcgaattattccgtatttatctagctaagctttgctgagcaggtgtgagccaattacatactctttcttcccccaccccccagcccatgattacgtagggattctatgtatccttcgacctcaagcagagaagcccgagcgctacgagggctggtccagatgttttagttattgtacctgccagggcaacctcccacgggggttggcctcggtagattcctgaggatcaactggatcagcgtttttctttcccacggaccctgaagttagagcatcccagcatggcttggacaggcaaagctaaggggtcccaggcctgctcaattgctaggaccacgaaggggccttgagtgccgtttgaagtgacaaggctctgcctgggcagtcaggacactcttgattttaactccgattcagtaggttttccccaagactcagtttccctttcctgtgggatataaactcttcctttcttgctcctccacagctcatctcctcctctccgccccacggtgcggtgtgggtcccatccactggcactgtaaaccctcaggaccccggggcgctgggatcgcagcagctgcccccgacagcgctgcaggcaccagcgaaatgcgctgcgcccccacgcacccctcagggagccgaggtgggcgtgactgtaaagcgggcgcacagagcgcagatcgcgccacatcggcctcggcgggctgcggctgctccccattcctccgccctactaagttcctcgcggccggaaggcacaaaaggatgtttcagggcggggtttcccataccccgcagccttccccggatgcctccttcccggctcggagttggaagggtttcctcagggctctcatttcctgcagcccggcgcctccacgcgggccagatcccgtctctgcagcctccccccggcccgcgcccattccccgcccccaggagccgggcccggacgctcccgggaagcagccgccgtctccggggccgggcgtggccgggccctccccgccgggttcccgcccgccgccgttccagtcctcagccgcgccagggcgggggccaggcgagttcagcgccagcaacggcgggggaggagggcccgggagccctcccgggctgcgcggcgccggccggcggtgcagtcgcgcgctcgccgccagcgaagccattggctcggcgcagtcaccccacgcggggctgccgcggcggcctccgcggattggcgcgcaggcgggcagggaccggggcgcgcgcaggcgagtgcgtgcggccccgaagccccgccgtctcggggtgccgcccttccccccggccgcgacgaccacccctccattgtccccgcgtggcccaggccgcgcctggggccgccgccaaacccggtccccaccgccccggcccgaagaaagcgcgcgaaaggcgcgctcccagcgcgggcgctcgcgccgcctgccgcccccggccgttcactgccgcatttcgcgctctcgcgccgcgccccgccccaccggcctaaatttgcatatcccaggatcgcggccaatcgctgctcgtctctctcgaagcggatggcttttgcctgagaggaaagggagtggctggcggcgcatgcgccacggtggccgacttgaaccgaggcttttattgctgtagtttatttccacccccttccctcctgtttctctctctccttctctctctctctctctctctctcttttttttccgccctagctggggctgtgttggaggagaggaagaaagagagacagaggattgcattcatccgttacgttcttgaaatttcctaatagcaagaccagcgaagcggttgcacccttttcaatcttgcaaaggaaaaaaacaaaacaaaacaaaaaaaacccaagtccccttcccggcagtttttgccttaaagctgccctcttgaaattaattttttcccaggagagagatgtcttatcaggggaagaaaaatattccacgcatcacggtgagtttggtacttgggaaatctgcggtcggccagccaccttttgtagcacagaaggtctaaggaatttttaaaaaggaggggaaaggagagggaccgaactttttttttcctttctgttgctaacggaggcgatggtgatggtggtggtggttgtgggagatgcagtgatccaggattagaagtcgcatcgtttgcaaggcattaaacaggagcgcgagtgcacgaaggtagccttaggtaacgcgccagacccggtctatcttttattgtcagtgagagatgctgcagcgtcggcccgcggggtgcaagcaaatggatgccagattgaatatgcatgcctggagctcggatattgttctctgggctgcgtgctgcgaggctggactcctccagcagcgatggggagatggggacttggatcctccccgggtcttccgcccccacccaaaaagggctttctggagccttctccgggtccttggaaaaaggagcgggtttgagccctaaggcgtaatgacagcagagggatgctgaaaagggcagggtgtaccggaatggtgtggaaacgggaaggaaaaacagggacgaggtgatgagcagaggaggaaggcggggggcaaggcgggggcttcttgttggccaggaaccggttttgggtgcccccccccggttttctcgccctgtagttcggggctggggccctggcggggattcgggctctttttcacgtctcttttccgccccttctgccgctcaggaggcgtccgtgttggtgcatacaaagcggactgcagggtgggcgcggggaccgcggcgagcggccgggcgctaatggcgctgcgcgacgcgggagcagatggcccggccccggccagacaatgatcgcggcggccggagggctcggcgcagtgctggggcctggacttgttggtttgcaaaccacggggaaaacgtctgtgccgtgaattagcgatgcctcagagatcagcaccagtcttgctcccacctctcccctgctccctccctctccccatcttttcctggaaaaattcgttcgtcctattctttccatccccagtgaaatcccagggaggggggaacaccagggaaattcattgttatataaggatgtgcaattgcaaccggccagctgattcccgggtagaacctaggactgaggcagagatcgaaagagccttttaaagcagtcaggatgtgtttttagggctggatataaggacgctctttggttctggttttccctttagccatgggcaccccggcttcctctccgtgcacaagggcacacccatccgcaggagagagaaggggagcaaatgcataggggagggggcgtgtgctcggaggattttctaggatgatctgaagaagggcgctagcttcttcttgaaggcaaaagacccaagatcccaaagggccgggcacggggcacccacccttgtgtgttcactgtgctggaggaaggagtggtgactctggggagggaggatggaaagcagatttgcagcaagcctcaaataatttgctgtcttcgtgaatgaacaaggcagcttcattttgacagtgtggggagaaaaaaaaaattaaaagcaaacgatcaacaagacttttttttttttttttttttaaagagcgcccccccccccacaccctttaaaaaatctggttgcattatcataggacctatagcatggtattcctccctccctcaccactggcagcctcttatgtaagagccttctggaaggcactagagtgaacgggggtgtggtgtttcactttttttcatggcatcatgttggctcgggatattcgcggtgatggctggggcaggtaccacagtgactgtggaggcaggaggtgaagggggaggcctctccttgccttccaggtgatatttattccatggaagcttagagatctgggagagaagtggaggtcattgtagacagaggacaagtgcactgatttgagtgacctgggcaagtggcctaacctctctgagcctcagtttccttatgtgtcatgggaatagaacctggcctcatctacctcacagatttctttcgaggctctgatgtcatgatgtgcacggctttgtaaaggtctttacacttaccttatacaggtgcaggaattattgttggctattctcctttgactttccaaagtctacgtgaggatcagggaccctgcagtgtacaaaattaaaatgatcttattggttttcagtatgttagagagacaataaatactttctgaaccaaggtgtgtgtatttatgtgtaaaattatcttttttccttgctctctagtagcttatctcttttttaaagattttctatgatttccttttcttggtagctgctaaagagaggtagcacttgctgagaatattgttttgtaactgaattttgagttaactattgccaaaagaatgtcattctttgaaatgtgttgcatattaaaagggcaatgtatggttcagcttgccaggtttaagcccattctgtataatacaggtgcatatttactgaacactcgatgccagcattccttccatcagcagcatttgcaataacgatgagtcataatgtagcatttctgtcacattctcagactttatctgctgcttgtcctttattttttagcataaatatcaccggttaaaatataagtgcatcagcaatctgtagtgcattgcatcttagaatttgctatctcagatacttattcgtgggagtttacctttttcttaacagcctagttaaaatggcatcaatggcgtattttttgtagtctttttgctatacttgctgtgatttacctcaaagataaatgcaaatataaaggacatattgaatggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtggtaattagtgaatttgaaaactcaaatttagggaattcaaagcaacaattaatgtacacccgttgcattaggtattatgtaatttactatttttaactgaggtgatatgatatctttctgttgccagctcaaatacttggtttgtgatatgttgaatatattaaagttttgcctagaatgtcattgtttgggttggattgcccaaaggacgcaaacgtgaaagacagtctcctctattgagacagcacatctgctttcttcatcaagaatccaagttggaggggccaaagaaagataccaagttaattactaagtaatacagacaaattactgcctaaatcctgagggaattttaggttttattctaagtggcaactagtgcaaataagactgcccttgtgtttattgtgttaatgttacaaaggagaagcaacagggcagttcctgagtttgggtatttttggacgccagagggttaaggaagctgagttcatcccagtatctgcctgccctttctactggggtagctcccggggctctggagaaatagcacatctgtttgaagacaaacactgcagccagtgacagcttttaaataagcagcattcatcaagggatagctgtaaaccggtccagaggagtggaaaactggagtggctgtgactgttgcctgggagctcacacccagatttatgaacctaaaatagattttaacatttccacgtttaatgttttctccatgtgtgtttgctgtgacagtctcagctccaggctctcaaatgccatgactttgatgttccattttcccccaattataagatggcacgatctggtctggtagaatgacactggcccagaagtgtgcaggcctgtgtgctgtttttactcatcactgatttgttctagaactttatcaacttctcctagattaatattccttttaaaaaattggtagaaagatataaaaatattttttaaaagttggaaatgaatcatgtctcccaacataatgaatattcatttttctgccttttaaaattatatttcagctgttagctttttcattatctgaataactaaacacacgcttccaaaattttaaatcattgcaatcatagtgttcactttttttttttttttgctttgatttgttctacctcacccttccacccctattttccttctggtgaaaaggatatgataaaaataaatgtttggaaagtacggccaggtctggagaaaattgctataggataattagctcaattgcaagtgctgtaaagaaagtttaatgacagttcttagaaatatcttggggccttgttatcatttgatcttagggggtttcttgggaacaaaacgtctttgagtggggcctctggtgccttatttaacttttgctttctagtatactctgcattgcctcttgctggggggtaggagtatatagtgttttattatgaatcgtaacaatgatctgaaaagcccacggcacagagcggaggatagtttataggttagtgaaagtagctgtcagatcccatttgagtccacgtttcatttacaacccttatcaccaaccctgtttatttaggcaaataggagaaaatctgattgtgccaggaggagtgaagaccatcgaggcccactcccggatggtgatccccggaggaattgacgtccacactcgtttccagatgcctgatcagggaatgacgtctgctgatgatttcttccaaggaaccaaggcggccctggctgggggaaccactatgatcagtaagaagcttaaaaatcatcattgtagtgcttaggaagtgtgagagtttgcaaataagtctattgtttgattctctccttctaaaacttgctgtcctgagccacagttcaatctaccaaataagggggtgaggatgtgttaaccatttgtcttatttatttatgctcattttctgtcaaattttaagttctcccattgaactagagaatatggttctaaggagtttggtaagatgaatgacttcttgctttctctccatgtggacttttgtcttccttgaccctagaatgtgatttggttttgaaaacacggcatttgaagtcatcttcaatgccaccaactttaagccattgagcataagtatttgattgagattttcagaaaaattcctaagagtgcttctttttagaatgaggatgggctgcaacaaatgaaatgctgaagcaggaactcctgttcctctgatatgaaaatcaaatggaggcgatactctctaggctgagtttaacataaaaggaattgggcagccctgtctggagggggacccacaggtaattgtcttttagatatgaaaattgctgacacccacagctgggtgccccttacgtattgctccaagggctttgtgctttttttttttttttttttttttgagacagagtttctctcttgttgcccaggctggagtgcaatggtgcaatctgggctcactgcaacctctgcctccccggttcaagtgattctcctggctcagccacccgagtagccgggactacaggcatgcacccccacgcttggctaattttgtatttttagtagagacgggggtcttccatgttagtcaggctggtctcgaactccccacctcaggtgatctgcctgcctcggcctcccaaagtgctgggattacaggcatgagccaccgtgcctggccgctttgtgctttttgtttaactaaatctgaactgtattcacagcactgtgacacagcacacataatattaagagtttgcttgtgaactgctagattccagcatgcccactgattgtccttttgaaaaatgtcattttgtttttgaggaggtgggcaagctgcatagtggcccgtcagatacatattttaaaaaacagattgcatccaagagtgacagtcaacgtggagtctgtcatatatgaaaagatagcagttcagttcagaagagggtctaagtagaaagaacttagctgtttctgctatagaaaaacctttcttactggttatttttccgagtggtggtctttttgcttgtggctttggggtctatctggaagcttcttttctatcttgcctgagctagaggaatgttgccctgccatcccctcctagtctgagttcccccgcattttaaatcacaactcatcctctggcgttctctctgtcctggtcctcagggtctgaagcatcaggaacagctctctcctgtttcagctttcttggcaccactgagaaaagcctccaagtgtaagccttgcgacttgtgtcttgctgtacatgttgccctttaacctagtgggtgccattttccagggatgtcggggggagatttcatgcacacctagggagagcagagcctgcaccttgtcatttgctggggaatcactggcacctgtgggcgtttctgcctctcctccagggcggactgtggagaaacacttgaacttggagaagcttagactattcgggtgtcagccgggaaggccaagtcagggtgatcatctgcctcagtttggagttcacagggagaccctgcaggcccctggattggtcacagacagtcaataagccattaaaaacaatatttctctggctgggcaccatggttcatgcctgtaattccagcactttgggagcctgaggtgggtggatcacttgaggtcaggaatttgagactagcctggccaatatggcgaatctactacaaatacaaaaattagctaggcatggtggcatgctcctggagtcccagctacttgggaggctgaggcaggagaatctttgaacctgggaggcggaggttgcagggagctgagattgcaccactgcactctatcctgagcaatagagtgagactccgtctcaaaaaaaaacaaacaaaaaaattctcgagtgaatggtcagtgtcatctatcattggagagggaaatgcccccagccaggagttaggagtctggagtgctggcccccttctgacactgacttgccgtgtgaccttgagtcactaccctactctgtgttctagctgtgtgtctccagtgagggatttgtgctacatgaccctggaagtcctttccagccccctacatttggccattcactgaaactcattcactgaaactcagagagattttgcctctcatcaagtacatgttgctcagcagatacagaaagtccctgttttctctcacacttgctggaaagaatccctcagcccaccatctcctgtcctgcattcctgggtctgcctcttccctccacacgctcgccccgtgcttaggcccccactcttgttcttgtttttgactctttcctgccttcccttccccaccacaggagcatcaccttcttgccaccaccccgaatttctctttcgtcttccccctcagaggctgtggccttttttccattcatccagatgggttccttctgtttagggacgagggacatccccctctgagtgcagcacctggcccagggagctcagaagagtcagcagatggccttatgggcaggtggtccggaaaggggagtgaggagtctgaccgcctgctctgcttccttggccagaatgctatggcatttgcacggaggctgtgtgatgcgatctggctatagagtggggcatccaatgagcgaacctcaaggaataaaagtcatcagagggggcagtgtatggttagcattgtgacccccaaatgccattgcttttatagcctgagaaaagtactaactacttttgcaaataaccacctatgtttactgacctctgtagaatttctactagcctgcctttccccgggggagggaatggtaataatacaggtgaggaactgaggaatttttatcctttttctgtttgctgaccagacgttctgcattgctttaagtgagtgagtggctgggatttgctttacagagaaggaggccttgcaaagagaaatagcttaatgccacttcattggcacctaagacctgctactttctttgacttaatatattgagtccagaaagaaatgcctggggcactttgaaaacttcacaggcccactgctgcttgctgaaataaaaaattgaagtgaattggtacaaaaatctccctcttcctcccaactccccgccaccccgcccctgggcactccaccctcctggctttctggccttctccagaccatgtcaccatgtcacctgccctcacgggtaaatcctcgcctgcctccctgctggctctgcgtttcccaggtcacaggccctggagactcctttctgtctgaaatggcgccgcatgtagaggaaaacacagccaaatattctcggtttaaaaaaggagatggcatgtcagcagcagaagataatattattgccattaaacagagcctgctattgagaatcacacaatgagatctttatgaggcggactcagtgtggagcagggggaacgccctttgccctttccacccagtggtgggtgggcagagactgcagacataccctgcaggcggcatccagaccggctgaggggttgcgggggcggccgcattgctgcttggggaaaaccctacggacttcccagggccttcatggtcatttgagttcaggatctcagagtttctaggaagcagctgggaacagttacctctattttatagaggggaagactgaggccggaaggacagacacgacttgccaacacttaccctgtgcgtcggtgcaggtggccaggtgtggaacatacacctgtagctctggcctcaccgcttgccctggggccacctttgctctcagcctcagtggcctcatctgcaaaatggggcaagttttgacaaaggtggactgtggtggcatcacaacagcatctgcccagtagtgagcactcccatgtggtagctattgtcattccatccttgctgggtactgacaccctcccatctcttgtacactgagctctactctcccccgcatggccggagaaacaggctgagctgccgtagggcttgacctgagtattcactgagagcaggcgctgtctaggcgtggctggcggactgtgtgctttgtgtgttgcttctgggggcggcatcttgaaacattacacttcctgggtcccaccttacctggttaaagtagcaaatctgctggtggggtctgtgactctgtattcgaatctggtgcttggggagctttttgaaagcatgactttcaggggtgcatgccggatctgcacactctggatctccagggcttgggaaccactgctctgaatgtcatttctgctcacctgaactccaggctctctctagaggaggtgcaccctcaggcacaacatacccagcaggcttcctggtccctgggtagcaccgcacagcagagatggggactggactctagcagggaggaggaggggaggtgctgctgccgcagggctggaaggggccctccctcctgagtaccagccttgtcacttctcccctggctgtggctccctggatgtgcatcaggcacctccatccaactgtccccagttggactccctgtctgctccttgctgcttttccggtgcccagtcctggagagggctcgctggaggttgtgctggcggtatctgcagagtcatcctagcatcttcatgtcctcgtgctgccttgagttgctttcatctctgtgttacctcttgcactcattcccttacccacacagatttgacttttgtcacctcttcctggattttggccctgtcctctgaggagtcttactgtctgtcccccacctcctgcctctcgccaggctgtttttctggtgcagctttcattgtgccgccttcttcctctgaagccttcagtgactccctcttgctcagagaatcagcccaagtgtcagaaccctccacgacgcggcctattcctgctgccccagcccagacttgcattgtcatctcagccagggatgccctccctttctttccctgcttctagaagcttcatcacccttggtggcccagcctgggtgcttcccattcactgatctcctgtgatctgtggctgctgtgtggcctcttcgcaaacgttgggcttttatcccacagcccaggtggcattcagccttgcgtgtggttcaatcaaggcccctctgtctcttacattttcctatttcctgccgcctgggcagcctcactcctcagaggcactctgttaatgcccatgggtgaatgaatgagtgagtgaatgaatgaatgactgaatacactgacgatacttgatatcctgcttcctctgagtgatgccaagagacttagtgtcacaaggagggaggagggtttaggtatccgacgtggactgtgttcaccctgatggaagctgtcgcttgctcagcagtggctccctctgcagccccagctccctgagtccctgtggtcagatctggtcatggtgggggagggtggcagaaagaggaagccgagagcccaggcatggcctgtggttgtggatgggacagctccctctgtctgggctgttcttcagaagagggtgggaacagcagctctctcattggtcctcttgcgagaaagcctgctctccaagtacagagggtcacaacatggagaaatcacatggtcccagcaccacagtggacccagcagtcattcccccagtgccttgggcttgtcccggctcttcctactgagcctccccatggaggcaggagggctgggaggaaggtgaggtggcttcctgaagggacgtggctcctgaatgtcactgcggtacatccacggcttgtcatttgttcatccatgtggcatgtgggttgctccctccttatggcgagtacacacgtgtgaacgcatgcacacactgtaatatggatgtgtctgtaattgatactttgattattccctttgcagcactcatttgactcgggttagaaagtgtttacaaaaacgcccgaccacatcagacccaagtttcaaagtccaggaccaaagttgttgccacaaaatctgcctgtggcctggcgattagaaagccacgttatccaatgggccattggtgtgggctggttctctgtgctcctccccttgtcccctcagtctccacatggttgaggtcacacatttctcctaaggacacgggtgccctctgcaagcagatgccgggagcctgggtccactcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccaccctcaggtgtcactgcgtgaatctcggccttgaacggctggactggaagaatccatccacccccttggcatagtttgggccgatctaatgcctggcactgagcagagcggagggatctcctaatgcctggtgcggtacaggggaaggatggcggagcatcctcagagacagcacagctcttcccaaaggtccagcacgcacactttaccgaatgcttttcttgtgaagggagtcattgggttgggctagccaggtaggctgggtaggcctgtgggggttaggaacttctaggcccttccagaagcaagggcatccccaagtgggtgtctagactctgtttcgtggacattgtggcagttatcatactgtcccagggtttcttgcccccacctggccctgggagctggcagttacagtgctggaaatgagcctgactcactggggtggtgatcttccaccccttcaggtgccctcatcccagttcctactctgcctatgggtgttttacatggagagtcacagcactgggggtttcccagagcctagactctgacttgccctaaagctgggtcacacagactattgggaacttcctgtcgatcctgctggcctgattgacagctggaaccgggagtggaggtggggcccatgggaatgctaggctccagcaagttctgcctgacctttggatgtgagggtcaggcattcagtggtcgggtctcagggttccttattgctagatgaaagcttccacgacacacatgtgtctaagtgtgcccttgtcctatgtcctggctgagtgagttgggcagagacttctgaggacagcgatcgtggcctctccattttcctaaggcccctgcatgcctggagctggctgtgggggcagccagagaagctgcccaatgagtctgatgggagccagacccgttactccttctactcatgatagctttagcattgttgtcccggggcaaccctttctcatgtgaaaccttgcgtggaaccccctccacctgagatatgagactgatgaatgcagaactgctctggttggaatggtgggtggcaggtgggctgtgggggagtccagatcctctccgctttctctttgtcatccccccatggcagcccctctgcctctggagaatcccagagcttggggaagcacaggatggaaaccaacccatcctggcactgcctccccctctgcccacctcccctgcaaagcttgcaatgcgattggtcctggtgtagcctccgtgttgagttgtaggggaaagggtgtttagtaagcaggcatatacccacggagtcgcttaagaaaacacctaaccacactgtaagtttttagtagtttcgtttaatatccctctctctgttcaagacaggaaccagggtagagcacctgtttcattttccctgcctaggtttgggttggttttcttagctttttatgacagcccataataggtgagcattctgccctttttaaaaaaattaatggtgcagagagttttatttatttattttttagaaacggtgtctcactctatcacccaggctgtagtgcagtgttgcgatcatagctcactgcggctttgaacttctaggttgaaacaatcctcttgtcccagtagttgggactgtaggtgtgcaccactacacccggctaattttttacttgttagtagagatggggtcttgctatgttgcccaggctggtcatgaactcttggcctccgttgatcctcctgccttggcctcccaaagtgctgggattacaggcgtgagccactgtgcctgtttggtacattagtttttttttttttgttttttttttttattaagacggagttttgctcttgttgcccaggctagagtgcaatggcgcagtcttggctcactgcaacctccacctcccaggtacaagccattctcctgtctcagcctctcaagtagcttggattacaggcatgcaccaacatgcccagctaattttttttgtatttagtagagatggggtttcaccatgttagtcaggctggtcacgaactcctgacctcaggtgatccacccgcctcggcctcccaaagtgctgggattacaggcatgtcccactgtgcccggccggtacattagttttaaagggaagattgactgtgggtggccaagggatttgtgttttctgacttaaccatccatggctctgaccccaagtcacccattaagggctgtttctccctttttttttcctcttcctccccaagctgacctttctctcttcttaagaagtgattactgatttctttaggttttgagggttctgtctttgactctccgtgattgttgggtgaagccatttgcttaaattccttgcttttagagcgtcttaactgccatggtaatgataaaggggagtgacagtgagtagaaattagagttctttctggttaacccatttgggaggtagctttctttgaatatgactaagtgttccccctaatgacagagaggatgttgctgggggttgggtcgcggtggctgaggctgctgtccagttaagagaattttgcaatgaactagggcagtggtttaaaaaccttgactgcacattagaatcccctggggagttgtaacaaaatgcagagaccagaccttctgacttaattgttctaggtgggcctggcattggtcgttttgaaagcctcaaggtgatagctgggattaagaatcatggatcccagtgcttgttctgatagttggacttctgttgaaaccgaatgaatgtctgccaagattttccgaaacccagagctgccctctgctccctgctttgtcctgtcctcttcacgaagggagtgggatcacactgttgctatctggccagggtggagtctacagccagatgctccccagaagcttaaccatggaggggctgagctaattgtcaccagaaagagcctcctccttcagttgctgtccttggtgttcgggaaggttttacttggctaattccctaaaagggcactggttaggacttggagtaagtggtgatgagcaagagcagggctggctggtgggacagggtgggtgccgggggcagaggggaactggaatgtggactgctgtccccagcctgtggccacctgctgtgctggtttccctgagaaaaccctactgtctttaggttgaatctgtagtgtttatgacctaatcactctctaatgataggtcaggactggaatctttccttgtggggagcctgtgagacaaaaatcaaaagggcctgataataacatagaatcatggactcttaaggcagccattcacctccttcccagccccgctcccacagctgggcacggtttattggaccaggcttcagaggatgggattgtaagtaactcaacaggacaggatgggagcgctccaagaatcagatctaagtttaacttccctttctagtgctttctgtctgagcgtgatcatcctaatgtgtttctagatggctatttccacatgtgtaaagtggagacaatcaattcttatgtcttacgactatggaaaaagtgagtttttttgtgccatactatttgaaagtaatcattgtgacacctttggaacaagtgtgaaaagatctccctctctctctctctcacacctgtctgtatccatctttatctttttatcatctatctctatctatctattaatatatatttatctatctagcatgacctgggataggtgaattctatagccaggtggcctccagaagcttacgaaatgatcgtctaccaaatctaccatctatctatttccctacctacctatcatttatctaatctatctatatattgatatatatctatctggtctatatctatcttgatatgacatctgtctgtacctatggtctatcatctctatttaatccatcgtctctatatctattgattatcacttatctgttttacttatcctaatctatcattaatctatcatctttctaatctatctgtatatatctattgtttatctaatctatcaattgaccattcatctgttcatctttcatataccaaagatgcagttgcatgccacctgattccagatgggttatctcacttcactgtcacttagtgagatcaggaagaagtctcaaggattgtttcaacttcaagcctatgtacatgagtttgcgttttgaacatagcaggaaaaacaacgatgtataagaagctttcttattggctgggcatggtgacttatgcctgtaatcccagcactttgggagattgaggtgggaggatcacttgaaggcgccaggagttcaagaccagcctgggcagcaaagtgaagccttgtctctaccaaaatcaatcaatcaatcaatcaatcaataactaaaaataaaaataaaaaattagctgggcgtggtgacacatacctgtagtcctagctgcttgggaggctgaggtaggaggattgcttgagccccagagtttgagggtgcagtgagctatgattgtgccactgcacttcagtctgggagacagtgagaccccatcttaaaaaaaaaggtataatgtagcttatagggcttataatcctgtaagaagacttcttatgcaagaaaataaaaattttacttttcgctattttttttttcctcctccaaataatctctggagaatttggagcctgattttcttgacaacacatctggccctgcagatgtaaagcagtgttcccagaaaacagcccgtcaaatcaataactcttgctatctttgaattttcagccttttttggcattcaaatgaggccaactttataagtggccattgctgtgctgttgaattcaagcccctccgtttttcatggtggattccttgcattgtctgctaggggggttgcattcctcgctgaaccagacctctgccctcttccccgctgccttgcagtttgctgagcttccaggcagggctgcagggtcgtgctgctggaagtattggtgacaaattcttccccagtgggtgtttcggctaaggaagcatttagtcatgtagggcctaccatgcccagcagtgcagcgtgggagaggcctggcagagggcagagctctcttctctccagccgggtgtggctggtggctccttcctcttttgtagtgtcaaaccaagggatagtatggacccagcagaactgaaagcaaagggaggacccattattagccagttctggcagaggcgagcagcttctttgtgtggacaggcatatctcatgcctttttgcttcagctgggagtttgttttttttttaattactgttatttatttatttagtaccttagctcattagctgcagaaatcacaggggatgaaaaagcaggtaggatgggtccatccttaaagcaaggagagagttgaatgaggaaactgtccctgaggccttgacagatattttggagctaactctgagcccagtgagggaggacctaatcttttggaggaagtgcaactttagcttcagagttttaaatggaaactgggcagaaagccacagcttgggcacagcattggtggcgtgttgttgtgtcactttgcacagttagatggggcttcagccctctttgtaggatgaacgtttaggttcttgtccaaacgaatacacttctatatcctactaaaaatgattgcaggacagcagtgcaaaccagggctgtcctaggcaaacccaggcatctgtcactctaaaggacacaaggacacgtgttgagtcctcttgtcctccagtgagctcgggaaggggatgaccctagcagttgctctctggacctctccacagacctgccgggagtcatgggtaggagttgtgtgattctgtccttttcacaagagatggttagaagaaagtgaggagtttggagggagcagataattgatatcatttatcgggaatctgtgggacgcaagccctgcatacaccatttctaatccttccatcaaccccgaagatagataggcttatcctcctgttataaatgaagtaatgagcagtccagagaagtgaaatgacttgcctgaagccacagagcctgcaagtgcgagggctgggattccaatccaagctctgggccaatggcccttgcatatcctagaatgcgagaggaacgtttgttttgtagcagttagacagcctgctcatgaaagctgctttgtgcccagccttgtgacaggtgctttacaacaatcccagacacagcacccaccttgagtttgccctcaggtacagggctcctatccatcctggaagaacagaaagattttggtgttcaagttttatcctgcccttccatccacctgttatttaaaagtactttttctgtaatatataggcagaaaatgatcagatatcatacgtctcctactaagtgggaggctgcacccagcatggaagatgctcaccaagacggtggtatattgggtgtctcttctctcctacagaagccctgggttgatgccctagatctccccttgcatcccagagggggatttggagagcaatcaagaggagtaactgatgccatgcattcatcaactgaacttaatccttcttctgggaggcccgggagccttcttccatgcggggccagattgagctgatttctgtcacgtaggctgctccgaggttgccttgcccttgcctggcactcatcttttgcatttctctgaatcgctttggcgtgggcttttatgaggttcattaggctcagcacctcccatgtctgcttgggaaacaccacgggcagatggcatttttcttttcttttctttttttttggatacagagtctccctccgttgcctaggctggaatgcagtggcttgatctcagctcactgcaagctccgcctcccaggttcacgccattctcctgcctcagcctcccaagtagctgggactacaggcgcccgccaccacgcccaactaatattttgtatttttagtagagatggggtttcactgttttagccaggatggtctcgatctcctgaccttgtgatccacccgcctcggcctcccaaagtgctgggattacaggcaagagccaccgcacctggcctcttttttttttttttttttttgaggggcagagacaaggaggaagatcagacaatttctcagagttggaattgtgttctgggtattgtttttctcctttatggagataatccagggagaaacatgaagtgtaatggaaagaatttgaggcccaaccttcttgatgatgcatcttcatggagctgggagaccttcgtgccagggtcgactctgctgcttattagctcaggctcggtgccccacggcttggtcctggttttctgaatcgtcagatgcacctggatcagcatgtcttgcataatagggttgctttgaggatccagggaggtggtggctatggcagggcttggacaaattacatgtatgggggagtagccccttcaccccagttttgctcctgaccgttgaagctttttatattgacccgtggctactgtggtattcgaagggctaaatttgttttgtgacttttgccttcagcagccatcgcattacatcatctaccttttcttgtgttcttctgtcgtcgagaatcaattaaaatggtcagcattgctatgaaatggtttatttttttgtggatgttttagagctcctcctctccatctcctgaatttcttttcttgctaagcctattcagctctgttttttagagagttcttttccctcctgctctatgaaaacgtattttccatgttaaaaaaggaagatccatgttgctgtacttaatgcttcatgttttagaatgttagtgccagcagaaagcaccaggagacacccgatgtgcccccaccttggtgagcacctttccccccaggcacagtccctgcttacgggagatttgaggcatttgatcattttttcccgttagcttacagcacaaagtactttgaaataaagattggctcgcagggcaggttgaagcttcaacaccaaaatctctctgttccttgtgggtggatgggagcctgacacctgattacaagctccaggtgaagagcaggtttgagacttacaccttgtttattgcaatctttctttcattttgcaggcggtgggggtgggggaatgaaagcccagaaagggatgtggcactcgggcaggacgggggctgcttctgtgccttttccccactgtgcgtattcttagctgcgcaagtgtcgtgcatgtgcgtttggctcacacccagcgggagtgcccttcttgtgaaggaagctcgttctctaccgaaaagctcacttttcagagaagagctggagaaggcctgttgtccatcttagtcctgaaatatgagttttcattccatggcaagtccttttaatgaaagatggactggagaagctgatgcatagaaaagaaataggttcttttatgtagagggggaaagtgtccactctgcggtatttcctgggtcctgtggcttgtaggcatttgaactgttttgtcttggttctgagagagtcagatgattcagaagctgtgttctgctgaacattcctgccttcttgacagaaatcccctatttttgtggtccccctggcaggtaaaggtggcccctactgacttgtaggatttctgtccatgattgtgtctgaaatgtcattttttctggttgttttccctcttcatgtattagcttggctctttcttctcctctttgtctttaaggtaatttgcaaaggtcacactattcttgcttcttcttagaaatgtcataagggattttcaaagaaagaaaatttctgagtaagagtatctccctcccctcccctcccctccctccactcctctcccctcttttccccttcccacttcctcctttcctttctttctctcgctctctctctttctcatttatgttagcttacatgagtatactgactctaaaaatttttgattctactactgcactccagcatgggtaatagagcaagaccctgtctcaaaaaaataaataaataaaaataaaaaatcttaaaaaaatttagatatgatttgtataccctcagattcactctctgaaagtgtataactcagtgctttttagtatattcacagaattgtggaagcatcactaccatctaatatcagaacattcttaccaccccaaaaagaaaccctaccaattatcagctgctccccattccccacctctccccttgcacccctagcccatggcaaccactacatttctatagcgttgcctgttctggacatttcatataaatggaataatacaatatgtggccttttatagctggcttctttcccttagcataatgttttcaaggtttatccaagttgtaatatgtatcaatacttcatgactttttatggtcgaataatattacatttatgagtagaccacattttgtttgcccattcatcgatggatggcatttgggttgtgtccactgttttggctattgtgcatgaataatgtacatttgtgggcaagcatttgcgtgggcgtgtgttttctgttctcttgggtatataccgaggagtggaattgtggggtcatgtggtcattctatgtttaattttttttttggccatgttactggcaaatatatttaactttctgagcaacagtcagactgtttcccaaagtggttgtgctattttacactcccaccagcagtgtgggagggccccggtttcttcgcatccttgccaacacttgctattgtctgtcgttttgattatagccatgcgagtgggtgttaggtgctgtgtcattgtggctttaattttaggctttattttgaggcccgtgtactcattcactgacccctagtcacatttatcttgacctgtgatgtgagaacttggtttgggtgtgttttccctactctgcactggctcatctggtgtggcaagtgcaaagatgtttgcagagatgagaatgagtacctgcaaccaggggtccccagaaaggcagccctcttagctctccccactgaggacccttgagccctccctctagggctcaccatttgtggctggctggaatggctacctccattcccttgagcctggcaccgctcctcgagatttgctctgatctcaccgcatggctgagagtaaatcctgttttgctcccttttgtgagccttcttctttctgcttcctgatggggtgggcagataggtggttccatgctggggagggaacttggcagaggccctgttagcctcttcctccagtgtcacccttctgacagcacacagcctgcggggtccaggcactctcagccatgatatggaccatctccagggccagtccattcctgccgctgatggagattccctcctgatctccagagggcagaggaatcagaatagtttccttctacatttgtagtttgcaggaaccattgctcacagctgctccctccttggatgctataccctcactctgtaagatagggtgggaaatgtcgcctactttacccatgagagcatcgcagaagggagaggctgagggacttacccaactagtatgaggctgaatgaggactcagatgatggtcatctggctccggggccagcacttaatcctgctgggtatgttcctgggccctctctttttttgtttttgtttttgtttttttttgttttgagacagagtctcgctctgtcccccaggctggagtgcggtggcgccatctcagctcactgcaagctccgcctcctgggttcacgccattctcctgcctcagcctcccaagtagctgggactacaggtgcccgccaacatgcccggctaattttttgtatttttagtagagatggggtttcaccgttttagccaggatggtctccatctcctgaccttgtgatccgcccgtcttggcctcccaaagtgctgggattataggcgtgagccacagcgcctgggccctctcttataggaacttcaggtgctaatgttgcaggatttaggaggacgagagagaccttgggttgaaacaggagaatttttactgagtgtactcaggcccagctgacttacgtttaaaagactgggcctggaacaaagacagtacttgacatttatatatattttataaaagggggtgggctagcttgaaataagctcatagtggtgcgaaagcagggatattgaggcaggacaaagacaggattgtatatgactgttgccaagcaacctagatgtttgttatttaggtttgcctgggcaaaggcttattttataacctttattatggtgcccaggcagctgtagtttaggcttatttaggctttttatgacttttgttgtattttttagataaaacagaatacttgaagttactagttatagagaacaggaatttataaattttataaaacaaaggaaatttttttttttttttttttttatgttgagggagtgctgcgagagtttttaggagcgtattagataatattattaagacttttttgggtctgggccatgcctttgctgcctttgggacaagttagcttaatacaggaaaacttatttttttttaattttatataaaaattctcctgtttcaacccgagatctctctcgtcctcctaaatcccgcaacactaagtgtggttcccttaagtgcactggattcaaggtgactttgtccttgcttttggatgttttggatgtaacagcgatgagatggcccctcccagagctgagaatggagagtattatgctagacacctgaggctgcagtgatgtgggctgatggaggggtgtcaaggagaaagcatgtggtcaccttcatggcaccatcacagcctttggtttgtttaaacaaagtgaattagtgttgtggtttctgctgctaagaaaaccctgttcgtttattcattcacctattcattccttcatccgttcatttattcatttattcatccattcatccattcagctgacatttattggccatctggcaggtgctgatctgggcattagaagtacagataaggtcctctttgcaaaaaacttcttgtctattgggaagacctacaaagaaaagatgaaaatgaaatgtgaagattgctgtactaaggttccagtggaacagagaagagaaatctttaaaatctgcctgggagagccaagagaggcttcagccaataggtcctatgtgagctgacccttgaaagccggctcaaattttaccctggggtggatttcacccatggggtgggcaggagaagggagtgtccacccaagagagagatgtgtgcagaagaatttggtagatgagtctggtgtattttagaatttagactccggatttgaccataggatgtttgagttctatcttcatggcttgctagctgggcaagtgacttttcatttctcggagccacagttttctttcttctttatttatttgtttttatttttattattttttttgagacagggtctcgctctatctcccaggctggagtgcagtggcccgatcttggctcactacaacctccacctcccgggttcaagcgattctcctgcctcagccttctgagtagctgagactacaggtgtccaccaccacacccggctaatttttgtatttttagtagagacggggtttcaccatattggccaggctggtctcgaactcctgaccttgtgatctgcctgccttggcctcccagagtgctgggattacaggcgtgagccaccgcgcccggctctttcttctttattttatagtggtagcatacataacacaaattttaccactcgaactattattaagtgggcagttcagtggcattgtgtattcgcattgttgtacagtcatcaccgtggtccacttccagaactttatcatcatccctaactgatcatcatccctaaactgttgccattaaacactaactccccattcccacctttctctagcccctggtggcccgtattctattatagttgtttctatggatttgactgttctaggaacctcatgtaaatatatatgcttatgacattgcagaatggccccaagttcacctatgtgatagcctgtgtcagaatttccttttttttatggataatatttcatcgtatatatagaccatattctgtttatccattcatccattgattgatagatacatgggctgcttccaccttttggctattgtaaataatgctgctatgaacatgagtgtgcaaatatctattcaagtccctgccttcaactcttgggtgtgtgcccgtaaatggaattgccgcatcatacggtaattctgcaccacagttttctgatttgtcatataatttcagggttactgtgcagcttaaatttgattgaaggtacaaagtactgagcattgcctggcacataatcagtattaagtcccatcctgaagggccccttctagcctctcctgaaaagtgaaccctttaaagcaaaaggacttttaactatttggatgaaaaaatacctcttcaaatgtagtttatggttcttaaatggaggtcctttttggcacttttgtggagtttgggtgaggagtcagatggccacatttgcatagtgaggtgtgattgggtcctggaatgtcatgccagggagcaggtgaaagccaatgagtattctgccaggtccaaaggcccagtggccagtttccatctggatgggcctggaaggcttcctggaggagggggtagtggccccagctggggaaagaggaggtaaaggaatgggtgagaacctgcctgcctcatcttgagagaggctgaggaagcacagagctgggaaggtagccactggtctccatggccactatgctttgaacatacctttgctgcagggccgatgaaaagttggacgttagctatcttcatctcaacctactccccgtcaagtcttgctttttttttttttgagacaagagtcttgctctgtcacgtaggctggagtgcattggtgctatctcggctcactgcaacctccacctctcctcctccggggttcaagtgattctcctgcctcagcctcccaagtagctgggattgcaggcacatgccaccacacctggctaatttttgcatttttttttagtagagacggggtttcaccatgttggccaggctggtctcctgacctcaagttattcacccacctcggcctcccaaagtgctgggattacaggcttgagccactgtgcctggccacgtcttgcatttaccatgggaaattgttagcgtggtcatcatttggtctgctttagtagagagtatcttttatgtttctcaaaggcgttatgttctgcattgtaaatgtgcggaaatcagtcacccagtcacctgaacttccatttaacatcaggtccctggccatgggacttgggcaggagcaccagggctggcccatcaagtacctcaatatattgctccctgatgagggaggggccagaatacatgttatcactactgtttaacatggttccggatatgttagccagtgtaataagatacgaaaaataagaagtaataataatggggagaaaatataagattattactatttttttttattgcccaggctggagtgcagtggtgtgaactcggctcactgcaacctccagctcccgggttcaagtgattctcttgcctcagcctctcaagtagagtagccaggattacatgcacccactaccacacccagctaatttttatatttttagtagagatgggatttcaccatgttggccaggctggtcttgaaatcctgacctcaagtgcctgcctcagcctccctaagtgattattactatttttagatggtttactttagccattcaaaggaattaaatgaagaaatatttgatctaagaagaaagtttatgaagatgactgacttaaaaataatgtattaaaaattaatagcttccctgtatgtcataaataaccaatcagaaaacataatttaaaaaatccatacacaatagcaacataaaatataaaattactaggaattataagaatacattcttatatatggaatccaagaagagtcttaaataaattaaaagaaatgctatgttagtgaacagaaaaacccaatactgtaaagaagtgtatactttagattaattttaaaattgaaaacctcaaaaggtggttgagtttttgttttgttttccatttgaccaaatgattcttaagtacaggtgaaagattaaacaggtgataagaaccaaaaaatattcaaaaaggtcataatgaataaggctgggagaccactactggctagatattaaaacaaactgtaaaaatataataattaaagctgtgtggtactagctccagaagagacagctatataagcaggttaaagtagaaaatctgcaaatgtgactaactgtatctaggtatttagtatataaaaaaggctacatttcacactcatggtaaaattgtaaaatattcatagtattatattagaagttaactattttgaaaaccaaagtaaacatcttaccttagttcgtataccaaaatatatcccagatggattaaagaattacatttaaacagtaaagtcagaagagaccagaagaaaatacagatgaaaagccatataatttagatatttcagcaaaggcagaaatcagaaaagatggagatgcttgactacatagtaattaaaaacattactaacagtttaataataaaaggataacgaagtaggacattcgacttgcaatatatgataaagggttgatgcatttaaaatatgaaattttaacattttaataaaaaaagcatgctttaatagaaaaggtaaatggtatgagcaaggtattcacaaaaaggaaataattccaccattgaactataaaaaatattcaactgaatgagtaataaaagaaatacaaattgaagtttcactgagctaagtttttatctactaaactttcaaatattaaaaggggttaagtaagctgaaaaaaatgaaactatgttggaggattcacttttatctgttttatttaatttcttttatataaataatacttcaggcaaatatgataaacttaataaatgtcaattctgaggggggaagaataaaggagttaaataagtagaagttgtaatacccagtgttggctaggttgtggttaaatgaacactcaaactgcggataggtatttacattggcatggccctttctggagggtaataagacagacagtatctaacaagagctgtaaaaatgtgtaaacaaaaaaattcatacgccttgacctagagtaatctatatgtaaacatttagctctaaggatgttcattgtagcattatttataatgaggaaaacaggaaatgagctgaatgatgaaaattggtgactggtatagtaaattaaggccatccctagaaaatagtagtatatagtcattaaaatttattttgggggccgggtggtgcctcacgcctgttatcccagcactttgggaggctgaggtgggtgaattgcctgacatcaggagttcgagaccagcctggccaatatggtgaaaccccatctctactaaaaatacaaaaattaaccgggcatggttgcacgcctgtagttccagctacttgggaggctgaggcaggagaatcacttgaacctgagaggtggaggttacagtgagctgagattgcgccactgcactgtagcctgggcaacagagtgagactctgtctcaaaaaaaaaaaaaaaatcattgtggggctgggcgtgatggctcacacctgttatcccagcactttgggaggctgagatggaaggattgcttgagcccagaaattcaagaccagcctgggaagcgtagggagaccctgtctctacaaaaaatttgaaaattacctggacatggttttgtgtgcctgtagtcccagctacttaggaggctgaggtgggaggattgcttgagcctggcaggttgaggctgcagtgagctatgatcctgccacgaacttcacaaagcaagaccctgtgtcaaaaagaaaaaaaaaaatcggctgggtgtggtggctaatgcctgtaatccccacactttgggaggctgaggtgggcggatcacaaggtcaggagatcgagaccatcctggctaacacggtgaaaccctgtccctactaaaaacaaaaaattagccgggcatagtggcacgcacctgtagtcctagctactcaagaggctgaggcaggagaatcgcttgaacctgggaggcggaggttgcagtgagcctagatcacgccactgcactccaacctgggtgacagagcaagactccatctcaaaaaaaaaaaaaaaaaaattgtggaaaatatttattaatatgaccatgttcacagtatattgatggaaataagcagaccatgatttcattatgtctgatttgatacttttttaaaaaacagctttttgaaacataaaaacattatgatgctacttttgtaaaaagtgtatatgtgtataataagtagataggaaaaagattgtctagacatacatcaacatagtaatagtgactttttttggatgattggatgagtcatggaagattttattttttttctccattctttctggtgttccagggttttggcattgaagtacttttgtacttagaggagttttataaaaaacaaaagttccctttgagggatactttgcatctggactgttatctcttacccacatcattcttgaggacgaagagaaaatacctgtgaggaagtatttacatttgttacggtggtgctgggctgagtttgtgtggaccctggactcccagctgtccacacagttataaagagtaattaaaagctccctgaacaacaggtcccttatcagccttaaaccttattgttcagatacattggcttttattcatagtcttactaatcaactggggacaaaaaagacccattgaaccattagccctcagcccgagatgagaagcgcatgatggtacaatggccgtggttcagactcagatgttatgctatgttttgaattcagtccaggttcctaggaggaaaacacccatcaaattatgttggctttagagcgatctcagtcaacagatgacatcaccgacttttccttccctgctggtctttatttggaggggatgcaagaattgtgcaaccttggaataaacagaatagagacccgactcctcactcattgtgtttctgagtttagtttcaatccaacagcggatctgtttttttactccatgtaatgggactgttgctgcagcttttgtacaagggtggagtgggtgtccatttgctgacgagcaccctgtgtacacgctagtttttatttgaacgaggtgctcttgtctttattatgtattgtctgcccataaatgatgtcttgaaatagaggggtgagcatcacctcatttatttcaacccatatttgtacagaaggatttttgtaatcaaatcatggggtttgtgtgtagaactcagtaagaagtaatcatgaccctgtccgttcatttgctctttgttctttcctgttattaacaatggctttggggcttttggggagcatttagttctgcacgttgtgtatgtaagtagatgttcttctgtgggggctgcaagtccttaagttatagttggattcccttcccagcaaggaaccaacaggaaggaaaacgaagtcaaacccagtctttgcacgtggaagcttgtggcgtgactgttatttttttgtgatgttctgtacagccctgtaatctcttatttttggcaagccaactctgaatctgtggtcccgtagccccaggcaaccaaaagctgagacaaacagaggaagtgtcgttattcacatgtttctctggccacctcatcgggctggacgctgccggctgccacccgtcgctgagctggagctccccagagtgcagcctggccaggcagggactgttgaccctggcccctgtaggaagcacctctggcttgtcccccagcccccagggtccctgccactcattacttctctgcactctttctgtaatttgttcatcgcctggaatttatttctggcagactttgtggtcaaaactgggaagtgtctgtttccttaaaacagcctttcctcaaacccaggaagtgaagtagggagctatccttcctcacctcctccctgtcacatgcacatgggcatacacacacgtacacactcacccatgtgcacacacacaggcacacacatgagaaagggacggggaaagctagggtgtccaccccagcctgggctcctggtatccctaagggttttggaagaagagtttcagtttttcaaagcctgctggagatgtaactgtcgtgatgtttcgtgggatctgcaagagcctgtagcgtcaggtttctttccttttgattgggatgacatgaagtctgttaatgcgggatcgtttgtgttatctgctctgataggtggttttacttgcatttgatttttgatagaatgagagatgaattgatttgttcctgatacattctgttgggatacagtccatttgataggaaggttgtttacatcacagtgtcctgtatttgggggctgccctgggatgtgaaaagtctgtttatgtctgttgacagagggtctctatgcttcttccttttctagcatttactcttatgttacaattagtgcctgcttgctgtgtgaacaggacagatttgtcttgtttgtttgggtcgtatgcagtttcatgcagaagacttagctagatgagtgactcaaagttccatgcctggggccctccaccctccttccctcaatcacgcctttatccagtcccttcccacgccctgttcctcattggaatcctctgtcctagcctatcccccctgctctcccctggcatagaagggtgcatctcgtctccccacaacagcactggaaggtgctagaacacttggagaaaactagttctgtaccagggattatgttcagcaggtttatctcctcaaggcacccctaaagtatgtttttactatttaacacacgattttgtaggccctactgttgttagctgttcgtagatactatttcagaacaatgctgtgagtagatactattattaggtccatttcacagataagaaacctgaggccctgacagggtaaggagtcctaaggttctgtagctagccatggtagagctggggtgtaaactcaggctttctgactccaaagttcatatttttaatccctatacagtgaagtaggcactgttgccatttctattttgcagatggggaaactgaggcactgaggagttaagtactttgcccagggtcctagaactagtcagtggtagagccaggattctacccagacaggtgagctctggagccaaagccctgagcatctgtagtagattccttgtggctttctgtcctgtccttgttccgagaaagttcccaggggacagttacggaatcactgggtgcttgctgttctcacacgcacagtttctactggctctctagcatttctttcattagtgagagaatgtttcagcccagcttttcagatggtggagttgaggcccccttgtctgagctgggtatttgagagccagcaggcttgagggcctgtgaggtctctggaggacacggtggtggtggggccaggagaagtcacttcttgggactttggaaagcctagaggaattccagaaatgaaacaccacacacttactggaagccaagttcgtgtttctcccactggtggaagggatatgaggtgctgtaaacgtggccttttttcagatgcagaatgcctgtctaattacaggaaacagagatgtcgccccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattaggaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatgcacattaggttaaggtcagtagttactcacttaagttacccattgcatgtgtttccagtgacagaaaaggatttagggatggatcgttgaggtgactgctatgcatagaaatgcctagaaggaggcggtggtttaagctgtagaaggaggcaggtgccaagtgctcccagtttggggtttgagctcccacattctgtctgcacagcagcaggcaagtcccgtggcctccaggctctgcatctgtgatgtaagatcgtaaacctgtcctgcctaccttgtttgagcatcagatgagataaggtacgtgataacactttgtgaatcacttaaaaacactatgtctatgtgaggttgatattattgctattcaataaatgcaaacgtgtaggaaattataaaatgattcaactgttccattcctgtttttgaaactttctgaagagaggtggatatgtttccctgaggtggggagctagggttgtgcctgtgttcatccaggaaaatgggatgaaaagcccaagatacatctgcgacatcatcttcagaatgtgaaattacagtgggtttggaatctgggccttctctctgcctgctccctgcctctccttccctacccacagtctccagctctgactcctggcctcccagggtcctctcccagcagcctggaaggaagggacatcctcattccagggcccaggccatgaggaaggaagcagtgggcagggatgcaggctgcaggtgtgggcagctccaggtgcccactctaggcttcaggatgagtggctcccttcctgcagtgggtgcccatcctggcaggtacagtcaccagagaggcccgcctgcttcagctgcataccatggggtttttcctgagactaaagagggtcctgctccttatatccattgaccagtgagtgatgaggaagactgaatgctgacggacgggaggaaggaagtcaggagaaagggagaagggctggccaggaaggaggagagaggaaatgacagaggagagggagagatcaggagccccatgcctgccagccagggaaggccctgctgttgcactcttcagaaccccaacttgggacattttgaatagatgttaggagtgtgagtggaatctaatgagtgggacagacctcccaagtgagcattgaatatgagggcgggtggggcatggtagctcatgcctataaccccagcactttgggaggccaaggtaggaggatcatttgagcccaggagtttgagacctgcctgggcaacatgggagacactttctctacaaaaaattaaaaattaactgggcatggtggcacgtgcctgtggtcccagctactcgggaggttgaggtgggaggatcgcttgagtcctggaaatcaaggctgcggtcagccagattgcaccacagcattccggcttgggtgacagaaccagaccctgtctcaaaaaaataaataaaagataaaaaataaagaaaatgagggtggaggaagaagagccagcggaagattcttctgagacatgggaagtaaatttgcaagattgctgtctgggagctggacagacaggaagggaacagaactgggatgtggcagggacaggttccaggcactggcaggatgggggccagtgtgcagtgggccaagagggaatgggagcgagaaggtggggcgtcagcaacattcagctccctccatagctcgatgagaagagaggggtggggacaggcggtagctggagggtccttcaggatcattttatccgtatccctttcgtatcttttagtgagtttttgttttccctaactggattgttggcattttaagggcacagtttgtatcttctacctctttgtttcctccaaagttggccgatcaccagatcacttaaaggaggttgtttgttttataagcgttttaccagatcttggcttaacacttcccccagagttagtcataatcattctagcagggcttctagatgctgaacaatgaccgatggtgccacttgatttatatgaagatactggtttagttttaaaagcaaacttacattgaacaaagtgtaggaaagagaaaggagagggctactcaagtgcctgaaggtccgagcagtgaagaacatgtttccatatgcctgccacccttaggctaaggacacggttttcctatctgtttattgaattgggtcacttgctttagttataatatatgaagggataagactgaatttcacttctcaattaactagccctcttgctctcttttgatcacacgttctggggtcagattccagctctgccagtcagtggctgcactggccaaggccacgtggttgaccaccatccagagttctgccaagagccttacctgccagaggcacgggaggtgtggctgttgcgcagcttctgtggcccaggccctctgcctggcacattttaagtaatgtgagcgggttacttaatcttactgtctgttcagctgaaaactagggccaaccctggctcagagctcagggggccgttgcgaggattaaatgagagaatccatggaagatgtttagagtcgtaccagacacataggaagtgctgaataaatcagaatggtttttactatgactctcacctttcaatgtttgtgacttaaacttatgttacagttagtcatttcactggcgtgtgctaaccaaaggtggcctggcccctccgcatccattaggagggcttgagtttaaaatccaggccctgtgagtctgcagggaggaccgacgggagagctgggtactcctgggacttcagtgtccagtggatgctggggttctcaggttggtatattgagtcacatagttccatgactcccttggaggaagaggctaaagttgtctagaggcaggtgtgatgtttggtctgtcctgtgtgcactgagcaccttctgtataccagtccccctgcttgcttcttccagacagaagaaaacacagatggcaattggtcatatttgaacagtgcctcttatagcttacaaataccatcttattgaacactcatgaaaaatgctgggatgtatgttatttttactgtttcaaagatgaaaaaactcaggcacagacattctaaatagttccagctcttaggaaaatgcttctttagcattgcgggagaaacagtatatttgtacaaggcaagtagttcaccctgtaaggcggcacgtgctttggaggcacctaaatactacacagtgttttatgcatgggcgtttttcttacaaaggaacatagctttatcttcctgggggtgtttatcaaaccacatctatgtagcagatgctcttcaagcatttcccatattccctcgtttacaacaccctggaaccctgagttaattattagtcccatttcatggctgaggaatctgaagctctgagaatttgaacttcttgtctaaagtcacatggtgaggaagtggtagaactgacctggaccccaggtatctggctctggtctttccaatagtgcctcttcagtgggtatcccttaaattctcaggggcaggtgctttctcctccttttatgccctttttttcagagcaaaaccacgttatcctaactgccaagcacaacccacaaaggctcttatctctccttcaaaaaaagccattccctgcctggttgatgaggtcacctggcattttgcagggcattttgcagggtagatgccagctcgggaaagccacatagataagccagtggatggcttgtgttactgcctccctgatggtttgcttttaattcaagtcgattcatttatctgagatgaaaaagggagaggctgattcacacacattgaaaagcagggaatggtgctggagaatgaggccgtgactatttggaataagatcctggagatgggcagtgctgatagagtaaatatccagggagcaggggaaggtgtgtgcactgacaacaggagttttagcatctgcccctccttgcttcaaggggctggcgggtacccgaggcggggtcggagggctgagtgatggctcccatcctccctcttccctcctgctccacgggtgtaaccttgaggtgggattggagggcttggtgacctctctcctccctcatgctccatgggtataaccccaaggtgggatcacaggctgagtgaaggctcctcatcctccctcctccctcctattccacgtgtgtaatcccaagatgggatcagagggcagggtggagggttacacatcctctcccctccctcctgctccacgtgcgtaacccccagctgacttacagactgtggtacctgctcaactgcttcaattccagaactggaactgcagggaagctgtttctgacatccctggttttaattacaaagggccccttgagaccttgtcagaaatactgccagcctagccctttaaaaactcatgatattgggttctctatcagtgtcgctccctggctgtaatattgtactataattaggcaagatgtttcctttgggggaaacggggtgaagggtatgaaggttctctctgtgtcatttcttaaaactccatgtgagtctatagtgagttttaaaaagaaaaagttccagcctgggcagcatagcgagacctattgtctctacacataataataataataaaattagacagtgtggtggcgcacgcctgtggtcctagctatttgggaggatgaggtgggaggattgcttgagcccaggagatcaggactgcagtgagctgtgattgcactactgcactccagcctgggtgccagagcgagacgccttctcaacaaaagaaaaaggataaaagaaaaaaaaattaaaagtagggtcatttaaatatggcaaactccaaacgggtcttctctttgaagttttagggagcagcttatttactttgtgtctcacactttgctaatatccaaaatgcagaacattagggaaccgcttgaggcaggaggggaaggaagcactgattctcgctgcagcatggatgaaccttgacgacatgatgccaagtgaaagcagacagacgcacaagactacatcttttatgattccattgataggaaatgtcctgaataaacaaatctatggagacgggaagtagattgatggtggccagggtttgggagtagcaggggtaggagggaatggggagtgactgtaagtgggtaccaggtttcttttttgagtcatgttctaaaattagattattgcaatggttgtaaagctctgtgagtgaactaaaagccaccgggttataccctttaaatgagtgattgcatagcatgtgaattatacctcaataaaactgttaaaaaaaacagtagggtcctttgatagttttaatagaagtcataataagaggaatagtcctttttcagagactgcttgtaacttgcaaattcaggccactgtcctggggcatgttcctggctctcataaaccagattcacaggcccaccacgcagaccatgagggtgtttccagtcactcatcttgagggaaggaacacccagtgtgtgccaggcattttgccaggtgcttttacctacgctttattatgtaaactttttgcagccctgcatggtatgtggttttacgccttttttttttttcttaatagacagtctttatctgttgcccaagctgaagtgcagtggtgcagtcatagctcactgcatccccaaactcctgggctcaagtgatcttccccacttagcctcccgagtagctgcgactacaggcacataacaccatgcccgggtaatgtttttttttttttttttgtagagttggggtctcactatgttacccaggctggtcttgaactcctggcctgaagcaatctgcccacctcagcctcccaaagtgctgagattacaggtgtgagtcactgaacccagctcatgcctatctttttatagatgagtaaatggaggttcctggctgggtgcggtggctcatgcctgtaatcccagcactttgggaggccgaggttgggaggaacatctgaggtcaggaattcgagatcagcctggccaacatggtgaaaccccatctctaccaaaaaaaaaaaaaaaaaaaaaatacaaaaattagccgggcatgatggcgcgcgcctgtgatcccagctactcaggacgctgaggcaggagaattgctcgaacccaggaggcggaggttgcagtgagctgagatcgcgccactgcactccagcctgggcaacaagagtgaaacgccatctcaaaagaaaaaaaagaaaagaaaaaagaaatggaggttccaaaaggctaaaccacagtaagggagtactgcagcaaaaactagaatttgggggctccttgacccccaagcctattctcttttcactgctggtatagtcgggttgccaaggctgccctcttggaggggccgatagctcagggaggtcaccagaggaaaggcctgtgagctctgtgcaagtcattttcaggcttgtgtcctcagtggggactctactccctccggaagtgagtatgacattctgccctattcccttggagcagctcttcccaggagagcttcagtggaaagaaaactgtgggaaaacatttggaggcatttcatggacacgtttctgagtgttatgagctcttgaaggaagcatgtttatttccccaaagtgctcagctgtgtccgggtcctgagtttttcaagggtttataacccccggagctgaatttggatatgcaaggaagccatgggattgcagccagggaacatgctattttttgtaagtgatgatgctgttgtgtagtaaacaggcccctcgtggtaaatggagagcagtgaatggaggtggagggagaagttttgggaaaagatttgcactcagttaatgatgctcaaggtagttcaaggcagactcagtagctcccgggttgcttagtagaaatgcagattactgggtcccagtctggacctgcagcgtcagaaactctggggtaaggtctgggaacctgtgttttatttttatgttatttttttgagacagggtcttgctgtgttgcccaggctggtcttgaactcctgggctctagtgttcctcttgcttcagccttccaaagtgctgggattataggcatgcgccactgcacctggccagaacctgtgttttaaggaacactggagatcattactgtgcaccctgaagtctgaggagtctagcaccagatgatctgacgacacatcattgggatgtggagtcatggttccagtcaccagcctgaagttgtccttgtctgtcaccctccccactttgtctaagggtgagtggaacagacagaaagtagactagtggttgccaggggctgggagtagcaggctaggagggaatggggagtgactgcaggtgggtacagcctttcttttttggtgatgttctaaatctagattgtggtgatggttgtaaggctttagatggcttgcttgagccttgcaatgggaatgagtgccttggcctaaggagaagggaagaaaatcttgtggaggaaatgagcttttatttttttcctttttttttgaggcagtctcttgctctgtcacccaagctggagtgcagtggtgcaatctcagctcactgcaacctccgcctcctgggttcaagtgattctcctgcctcagcctcctgagtagctgggattacaggcacctgccaccacacccagttaattttgtatttttagtagagacgaggtttcatcatgttgcccaggctggtctcgaactcctggcctcaagtgatcttttgccaccagatattaaaatgtatcaaaaagctgctctatttagtactgattgagatgaatggagcaaaatagcccaggaacagaacctggtattgtctctctgtaaagtatgagtgaatttaaaacattattagatatgttatctagtaataataatgataaagtattttttaaagtcatcatgaatcaatagaaggaaaggattattcagtaactatgagcatgtgggtcttagtgtcaccagtacttatccttcttcttaggagggatttgtttttttaatcttaaaggaaatagatatgttaaacctatcaggcttccttatttacattggctagagagcctaactctaaatttagccaatgtataagactaaatgtcaagtatttatctatacaaacacacacatatgtacacacttgcatccacatctacatacacatattttacatacacatatacacatataaatacacacgtacatacatacacatacatacatgcctctttcctgattttattttaccattatttttcttccgctttatcttgcattactctttctggtttatcacattttcttgtattttatgtatctctataaaccactttaaaactttttgggggaagaaagtggactatagataaagaaatagaataaggtataatatatagaaaaaaggcagtaaaaatacacccaaatttgaataggttgattttggggtggtggtggtaatgggattattaactttccctaaaattttctgtatttttgaaattttctactcaaagaatcatatcatcagaaaaaaattattatttctgctcattccctttgctggccagtgaaaggaatgcatttccataagtgagggtctggcagagcagtgttgaggggaggggtctttgccgcagcaaaagctggtccggttcccaggagagcccctcctttgctgcttgacctgattgcaagtggaatgtgagagccagaaggaaatattccatcacttatttagagcattcatttggctcttccctgatctaggcgttcagtacctgctcagagggagtttacattctagtcaggggtcagagagtaaatgagtgaaatggattcagaaacgatgccaccctgggatggtgacatatagccccagtgagaaggatgaggagatgcccaagtcaagagcgaggggaatgggtttccagagagagagagggctgcttgtgcacaggcttggagttgcccaggggttgggcaggtcaaagtgaagaatggccggggtggccattgtgggtgagcaggtcagggataaagagtaccttggagagatcaactaggaccggatctgactggccaagagaaagagtttgaattggactctaaggatggtagacagctactaaaggatttaataaggggaatggcagtgtttgatgaaaggtttaagatccttctagctgcttctgaagggtgatttgtagaaggacaagagatgaagccaggggagtgggtagggagattctgcccaaactgattgctacacagtgatatttttatgcttttcttttttttctttctttctttctttcctttccttccttccttccttccttccttccttccttccttccttccttccttccttccttccttccctccctctctctctctttctttctttctttctttcttttatttttgttttgggtgttgatgaggggacatacaacttaagaagaaaaattggaattattttgtcaacttttctacatcagcattttactgatggaataagcttgcatttgaactggacatcatttttgtttttattagataacattatctgtattacagataccagatatgtgtgtacccatttatttactaatcactaatacttacaaaaaagtaaattttgtcaaaagaaaattcagcttagatggccatattgtatgtgtgtgtgtgtgtgtgtgtgtatatgtgtgtgtgtgtgtgtgtgtgtgtatatatatattttttttttcttgagacaaggccttgctctgttgccctggctggagtgcagcggcacaatcttggctcactgcaacttctgcctcccgggctcaagcaattctcctgcctcagcctcccaagtagctgggactacaggcatgtgtcaccatggccagctaatttttgtatttttagtagatacagggtttcaccatgttggccaggctggtctcaaactcttgattcatgtgatctgtctgccttggcctcccaaagtgcaacggctatatttctgacatatacaaatccaagcccagttgatcagaatttagcagtatctgcaagatttgaaccatttcagaaatctgagctctctagcattacatggactgatgttttcttagctcagaactgcttacctgtgtgtagaaaatctaatatttaggaagaataattcattgctttaagtgttcagtcctggtttttatttctattgttgcacaagtttgatttgaccttggacaaatcatttcagtttgtattttagtgcttgtgtgcagaagatgggtagtaatagtcctggtaatcctcctgccatcatgttaactgggtgagagctcttcaagacctaggagagataatagcaggtgcaaagtccctgtggtgggaggcagcaggtagatattttaggagctgaaaaacggtctgtgtagctggagagcagggtacaagggagaggtggtccagggtcatgttatagaggtaggccagggccacactggttggggttttgcaaaccttactggggacttgaatctttatctgaagagcagggggaagtcattggaggatttaaatcagggaatgacataagattgatggatatgctatctcctttaatcctcataacaaatgtatgtgctaggtaatatccccgttttaaagcagcacagaaattagggcagtggagattaaggagtttaccccaggacaccatgcaggtgaatgatggagccaggaaaccaactcgggtcagcttgcatccaaagtcctcagtcttccagatcagcgtacctccatagtaatataacaatgactgcagttttaaaacactttgaactcttaagatgaaagatttcccttaaattacaaagtggtattatgctgcagaaatgtgagcggtaatgagagagcaggtaatgcccgggaacttttgaaaggcccggtccgtgtggctctgctccagcaccttcaagttccctgccgtctggcggggggcgtctcataagctgctttcaacacaaagaagggtttggctgctccccggccatttgacactgccattgtccataaggactcgttgtccgtgaaatgcacccaaagcttgagctttcaggggttttgggaaatcagatctgggcagtgcatgtgtggtttcgctggagacatcatccaatgccaagtttctgctttctgctttctccctcttggataatcagctgggttacatggattcttagaagctggttgtagagatcaccatctcgattttgaacccaagaagccttattcagggttcaagtgggaaaatacctgctggcccacggcccttgaggctcttggtgatgatgacatatgtctgtttctttctagttgaccacgttgttcctgagcctgggacaagcctgctcgctgcctttgaccagtggagggaatgggccgacagcaagtcctgctgtgactactctctgcatgtggacatcagcgagtggcataagggcatccaggaggagatggaagcgcttgtgaaggatcacggtaggttgcactgagtcaatgccctctgcagatgtttccgcttcagtccatcaactggcacagccctgggaagaaagtgataatgcttccagatcccatttgtgcctcatgcccatgcctgcccctgggaaggagagagggctttgggccgcagcttatgctgtttggaggtggccttacccagtgcagtaacatgagccttcattgatgataagagaagatgaggcttactgctgggacctgttcttaggtgacagctgctcacagcttattggtttgtgagcaccgtgctctctagccagggtggggagttgaggctgctgagagagagatttaccctcaaaagataacaaatacatatctcagtgaggatttgacagtctcaggagagtgttgggcagccccttcctacaaacctggatggatctaggatagatttgagggctatgagacacttcaaaactgagtgacaacctgagagggcttttcctttccctagaattattttggagaacaaatttccagggattgggaagattcacagagaggcaggaggaatctttaccacctcaaggtgcctctgggactcttgtcaacaagaacctcgggggtttgcggggaagagccaggccacatcatcttcctgggtctcgctgggcttggctagagaccagattaacttcactggatcttagtgttcagggaaacacctattgctttagggttctggggacttccaggcttagaaacaccatgtgctgtgagtgacatggcaagagggaaatctctaggtactagaatgatagaaaatgccccggaatgaaaagcaagagtcttgggtttatttctctgatcttccacagactaactgtgtgaccctgggtaatttgctgaaattttatgggtctcagttttttaaacatttctcatatatgagggtcttggactagatgtcctctaagattctttccagcacaaagcttccacataaaagaaaataggtaaactttgacttttctcacttttgatcatgcggagactccaagtggtttaactgtggatacttagactgaatctgctccaaaccaggcaggagggttaccatggtaactgttgcctggcaacgggagaagggccaggatgtccagaggcatttaactcaggcagctcccagcaccccccaggtggcttgaattaagctccaaggctgcgaggttgtcaggacaattgtttaaaattgtgatgaatgttgggcagggatgtttggtctggtgcctagggaggcaagaactccaagacgccaggatgagaattgcgacatctgcttgttgaactaatggaccttttcttacttaaaaaatcattttcttaaaaatcagcatggaaggcagtctgtctgccaaagaaaagacatttatcacagttcttcataggcagaaacttctaattcattttcttgttacagtcgcaacagacttgtttggtagaggcagcttaaaaaattaactgtggtaaaataaatataacattcaagttaccatcttaaccatttttaagtgtgtgtgcagttcattgttttaaaatacactcataatgttgttgcaaccatcaccaccctccatccacaggtctctttatcttgcaaaactaaaacactacactcactcattaaacactaactctccactgtccttcaccccagtccctggcaactgctgttgtactttctgtctgtgaaattgacttctagggacctcatacaagtggaatcatatagtatttgtccttttgcaactggcttatttcatttaccatgatgtccttaaggtttctccatgttgtagcatgtgtcagggtgtctttcctttttaaaggctgaataatattccattgtatggatagaccacatttggtttattcatttatcagttaatggaggcttgatttttgcttccaccttttggctattgtgaataattctgctatgaacatggatgtgcaaacactggcaacttttaattttgatatacttgtaaacttacaggaagattataagaatactaaaaagcatccttgtgcctcttcctcccacattcacaggttatttatatggtactctgcttcctttaccattctgtgtctccatttctctcctctctctttctctgtactgaaacacacacacacacacacacacacacacacacacgtacacacacagacagtattatcactttcttatcccttatttggttatttggtttatctattaaaagtccacttctctattttgtccgcactaggggtaaattccttcctcgtgtacatggctttcaaagatcgcttccagctaacggattgccaggtaagaaagtcggcttttcggaagaggcaccctgacatttggtaccttcaggctgtggccgtttgggaaagcagtctccgatgtatgcatgtttcctagcttcctgggaagtggctggtggatgcagttactgatgtaactgagccttggaagagagtatgaacgcagtgccctggcccccagcactgccactccgccgccctggatctgaggctctgccccgcacggcgtgtgtgggagcggcactcagaacctccttagcaaacctggtgcagagccaggtgtcacccaagagcttctcactcccggtccacgtcctgctaagttgtactgcctctgttaatttctgaggggtctttctccatcaaatgtggccagtaacattgccctcatcatatcaaaaaaagtcaggctaatagaatcgcctaggtgtcctgtttctcatcccagaaatgcctctggtggggagatgattgtctttgtgaacaggaagatggaagtccctgtctctgatcccacccttgtctctctctcagatttatgaagtactgagtgtgatccgggatattggcgccatagcccaagtccacgcagaaaatggcgacatcattgcagaggtacagggctttctttttcgtcatttcttcatcacctggagggtgagaggcaggctcaagaaagggaagctgcatctgtagcttaacaccaaggtggaaaagcagagggacctggtgttcccttgctggagctctgctcagtctcacccatggcatgaatgccagtgacacacgtgcctctccgtgtgtgccacagaacatctaagtcagttactattgcagagagaggccatttctctcggtgctgtaacgcagctgccttgggtggggtacgggaaccctcacgtcacacacaggcattttacaccgtggctgagggttgcaaatgcaccagtcgtcagcatcccagggaacagctgaatgggttttgggaggctgtaattgatccatcctgctcaggcgggactgggaacagggcagtgaacccttctcttcatgaggtcttgggatgagggcagaacgatcggcagtggtaattttccatcttgcccggataactgcatgcccgggcctctgccatcagagctgtgcaaaatccactctccctcacagcctgactttctctaaacattgcaggagcagcagaggatcctggatctgggcatcacgggccccgagggacatgtgctgagccgacctgaggaggtgaatgttcaccaagcggaatgcgtgaatcagtgtcccttgggcactgtgcagagcctcagggaacctgcttcctgcctgttgagaagggggcttctctgatgctgactgtggtctttctgagaagctgtgggtcacgtgtgtgtctgtctgtctacgcaggcaaagtgaagtgttagattgctcctgagggtaaggtggtgtggactgtttcgccagaagattcttctttctgtctgtaattcttcaagcccttgcttgtatagacacaaacagttcttcattggcatcctgcaatgtagattttagtggttcacaacttatggtctccaatatcttaccaaaattcaccaaaacgtagttggaaggatggaaaagctcttctaaatgcctagaaggcgtgtggggaattgtttttccaaggtaaccctgcacaggatatcacatgatatgcagagtttggtagacagaatcttttaaaattatggagggaagattcagagcaggggcctgtgctggctcaaaggtggagactcaccgtcttggtgaggtgtgtgagttcgaagggagggtgcacacgtcttaggtaatggagaacctgtgttcatcagttagaatttgtggctgtgaaatacttttcagaagttggttccttaatgacaggctggatgtcaggctctaggggccctgactagggagcagcctgcagcttcgagtgaagcgtgcaatcagggaatctccagggaaccaccaggatttccccttcatgggaggaagtggcagaaaagggactggcgccgagcagtgggggaagatcaccaagggcctgagtggaggctgacagtgaggaggctccagaagcccgggagggaggagcttggcaagagctccctgcagggctgtggccactgagtcactgagtgtcagcaccgtgccaccaccctgagtttgggatgtggtcatgttcataccagtgtgggaggggagccggtccctgtgataaggaagtggattcaggagggcttggaagcaaaggcaccatctgtgtactgcctcgggtgcaggagggggtggttgggatcctttcagacttgaggggaagggatgaggctggaagaggagaaaggagtcaagacaggcagaaagacgagagtgggagccactcggaatgctttgcacacagtcagggtccacgctttgttctatccttcttgctgcatgcatatgcacacatagacacacatgtacacacagacataggcacacgcagacaggtaggcacacaacagacatagacacacatgcatacacatagtaacacacacagacacatagacacacagacaactagacacagccatagacacctacacacacacacatacacatagacacacagacacatacagacacagacacagacatacacagacacatacacatgcagaggcagatacacagaactgcatgctccaagacactttcagtagcatttgaggccctgaggacattttcctctccccagatgacagaatggaagccgtgacattttcaggattgcacgttcctgcttcaggccagggatgcaggcccttttgtagctatcaaccttctcatgcgtgctaaaggctgaaagggtggcctggcacaggcccgaggatgagggaggcaggcaagcccctgtgtcagctgagggaagccccatgctgagaccgtggctggtggacagtgattgcaggggacagcttgcaggcgagagcaggctaagatcagccgaccataaacatgcctgaggctgattttattttattttattttattttttttcctttttctggagaacggggtctcactatattgcccaggcaggtctcgaactcctgggctcaagctatcctcccacctcttagcctccctgagagctgggattacaggcgtgagccaccgtgcccggccgaggctgattttatgcacatttgtgtgcacacagatccacgtgcacaagcacacacacgtgcacacactcacgttcacacacatatacatacacacatccataggcacagacatgcacgtgtacacacacagacacattttagcatacgcacatgtgcacaggcacagacacgcacatatgtgttgtacccacatattttcacatacacatatacacatgtacaagcacagacacgcataggtgtacacacacattttcacacacacatgcacatatgcgcttgcacacacctatgcaggcaccatccccctttgcagacaccgcaagggttcgtttctgtggtttcacttctccctctgggccggcttctgtgactgccctcgccagattccccaggatccacctgtcgggtggtttaaaccatggcagcataagccatggttgctctcagccctgacctccctggaattgggctttgttcccagggctttgttccgccctgaaacagtcttgggattgggccttggaaatgcacagagtccgggagaggtggagggctgacacagttctcacgtgagccctgttcaaagctgccttcatttagtgctcacgtgtgctggacactgtgttcctggcccacatttcagttttgtaactgtcctgtgcaggaggtacaacatctccttcccacaactccaggggatgccattcatgcaggctgcatggctgtattcagggagcaccatttacattctactgcccatgagtggtggtaccagagctgtgctgcagtgggctccttggttatctctctttagatgaggacactccagaagcatgaagttaagtgactgcccagttatcaaagcagagagctagaaagtgcagggtcctgcctgctaccccaacccctcccgcagtgtacacatactcagcttaaagccacacctggacctgggctttattagaaagtttcctcctgctttcctcccgtttggtgactgggagccagtccctctgcctgccatgtaccagctgtacaaggaggtgagaagatgtcctctgagaaaagcaaatgccacttctgcaaatgctacatgaggctcctgctgagaccctcactcttcaagttttagagccttctgaggggcttgcattccttctttctcctgctttctgcagagaagtacacaaacacagaaagaaagggccctggctttgctgaagaggaaaatgctctcagagagttgttattctggttgcttgtattcatccattttcatactactgtaaagaaatacgtgagactgggtaatttataaagaaaagagatttaattgacttacagttctgcatggctggggaggcctcaggaaacttataatcatggtggaaggtgaaggggaagcaggttccgtcttatgtggcggcaagagagcgagtgagcagaaggcaaactgccacttttaaaccatcagatctcgtgagaactcactcattatcacaagatctgcatgggggaaaccttccccataatccagtcacctcctacaggtccctccttcaacatgtgtggattacaatttgagatgagatttgggtggggacacagagccaaaccatgtcattgctatttcaaccagagaaattgaaaccatttttacgtgattaggcccagcagctgttgccctgagaacttcagaatccccagcaactgattatggagtctccttgagggctggcagatccagggatgcaccagtatgggatgcagtttttcagctgatttagaggcctctcttgtatgccaggccctgagtccttttagccatatgacagcccagtgaggcgaggaggggggatgcagggggtttgaaaggcttggatagtggcagagcgtgattagaactcaagcccacaggcacctgccggctgacgtctcctctcatggtgagtttgtcaagagggatctgttgtgtgttaaaccctgtgtgggtgataaagagaacaagtatggaacaattttgtgtgaattttagcttcccagtctacttggggaggtgctgctgatggaatgaaacacatcccagtgtaacttctctgtagtttggtgacctatccatcactagcatgatggttctcttggatttgaactttccaaaacatgttcctaacccactaggcctttcttcccaacccaccatgtgagaccacccagtaggattttccctcgttttccacccagaggattggaaaggacactagggagtgcagacatctggaactgaaccatctgtggctgagaggagtggcgactgagcctgcgtgccaatccgggcagtgcctggcattgtggggatgcaaaacagataagaaagtgatcctttctgaagggactgtggacaaggcgaggagaaagaggtagacagaaagtgagtgtagagatagaatttgacagtggctctgagctgtaagactgatgtctgggaagagagtggggacttggagatgaggataatgaagaacccttcacagggacgggcactttccagcaggccttgtagaatgacagatgtcctgacactgctctgtgtccctggacaggtcatttccctttctgagttacctcatcattaaaatcagaagataggcgtagtggcttgtacctgtcatcccagcactttgggaggccgaggtgggaagattgcttgagcccaggagttcaagaccaacctgggcaacatggcgaaaccccgtgttgggacaataaatggagtagtcacctgtatctctgggaggtgctgagggttctagtggagtccatctcacacttcacacccatgcaagacgtccctgtccccgcctggtgctgccgggccacaggcatctctgctgtaagtggagagagagggcttctccttcagctgtcttaggaatgaaaaacatttgggtgtttaatatgctttttcaagagccctttgcttggattgtggatttctagacatcccttttcacatagttgatgcctgaaaggccaaatgtgaatgaagttgtctcagctctgctaaattagattaccagttaatgcaattacagaatttaatcttttggccaagctctggtggagacaaggtaaccaattcagttataggggctcagttatttcttgtgaaaaataacagtgttctgtggagcagcctagactgaaataccatgaacataaaatgaaatcatttatatgcttagcaaacatttttgagcacctgctgtgtatcagacaggacattgggagctattgggggcagggcatggaagatactaagcagtgagtaagccccagtccctcccctccaagagttcaagccagagcccttttgctgggatggagagggagccagtgatgttctgagatctgccttccacaatttcacctgctccttcccttgctgattggtgattcctctgtaggatagaacttgatccagggagtcttgcctgatcagatattccacagtcatcatgtgggatttgaaatatcattcatctgaacatccgatgtatttatttatttatgagatgaagtctttccctgtcacccaggctggagtgcagtggcgccatctcagctcactgcaacctccgcctcctgggttccagcgattctcctgcctcagcctcctgagtagttggaattacaggcatgcgccaccatgcctggctaattttttttttttttaatttttaatagagacagagtttcaccatgttggtcaggctggtctcgaactcctgacctcaggtgatccacactcctcagcctcccaaagtgctgggattacaggtgtgagccaccacactgactggaacatccgatttaaagcgccagattatttactcaagcagttcttcaatcttgtgctgaaggtcgtaccaggctgtggctggccatgtctgtgcttcacacacagggggccattggtgtagacaaacggggcccactccgttcctagagccctgtgaggctgcattgtttcgtgggtgatgctgacttcattcatgagcatttaatgggagcccagcacaaactccacatcactgaatatcttgactcaagaccctgggagcagaatgaatatatggaattgagagcaatcagtgtctgtgtgtggcggttctcaaacgttagtaagtgtgaaaatcacccacattgctgggtcccgccctcagagtttctagcctgtgagtttctagtccagggcagagccagaaaatctgcatttcttacagactctgggccagtgctgatgtcacaggcttgctgcctgcacctggagaagggtcagaagggagttttcttttctttttcttttgagacttagtctcactttgttgcccaggttggagtatggtggtgcaatctcagcttactgccacctctgcctgctgggttcaagtgattctcctgccttatactcccaagtagctgggattacagtcacctgctgccatgcccagcttttttttttttttttttttttaattgtatttgtagtagatacggagtttcaccatgttggccaggctggtcttgaactcctgatctcaggtaatccacctgcctcagcctcccaaagtgctgggattacaggcatgagccactgtgtccagccacaggagggaattagttcaaccaaaccaatgttgagagacacaaggcaagtcatactcctttgaattgtcccctggggtaggaccttggagaccagcagcctcgccttcatcttagcctctctctggggtggaggataaaggtagcggctcgtggggtgggctgagccacattctcatgctctgctgctgttttgcaggtcgaggccgaagccgtgaatcgtgccatcaccatcgccaaccagaccaactgcccgctgtatatcaccaaggtgatgagcaaaagctctgctgaggtcatcgcccaggcacggaagaagggtgagtgctgtggccggactggctgatggcaggtggggaggtttggaggggaggggggctcctcactagggagggctccttttccagaccctcatgccaagtgggccacttgcaccatgttctggcattaacctaattacagcagggcaaggcaggagctccagtttcctcctctgctccactgctgcggccttgttagtatctatttaaagccatgtgcacgccaaggcggggtgggcaggcacatgtcccccagcccccgtgcaagagctggacttactttgatgtggttgaaataaactaggcacatacacagattacgtcagtttccatccgccccagaatccttggtcacatcatgcacctcccctccaaggctgggagtgatttctgccggggtatgtaaggcagctttgtggggtgtggggatgcattttgccccagacactatcacatccagatgttttggtgtttgataaactctcttgatgcattctgaactggggctgggtctctggtattactagggtgtccactgtaactaattgatgaagtgcagcttccagtgcttcctctagaggacgccccatgaggcacctcatgcattttgaatgcagctgagccctgttgtcacccaccgctgacaacatgaatttcgataatcacactgcatcttttatgcttgggagttctctcctcgtacagaaagcctgagggcatgtcgttcattttgatggtggatcttaggctgatctgaaatgaacattataaaagggtccccttcttccttcctttctcccttttatgttccctcctcccctttgcttgttgggatctctccatctctgtgtctccacttctcttcccttctttcctgatttctgtttcattttatctttcatttgactctttctcagtccctctgtcattctctctctgtgtctttctttccctgttaggaagggagccatttgacctctatggcttggtttctacttccctgcatcatgcaatccacatggatcaaggtgggctgtgggatttttttcactggcgggtgacttgctgcaagccctggaacaaattgctcaatgatgactgagtcatcttgtcccagagatgatgacttccagacggacccagcgactcctggccctggttctttggagtgctcctggggcctctgtccttaggctacacatcaaatggttgccgcctttctgtcttctcctggcaccttgaaggaattgccttttagaaataagaaagcattcacctaaaataatgtaacctactcagaatgagctttgagttgttttctaggagatattgtggatgacgatggaatcggtggccttgggccacccagacacgcatttgcaagaaggcagcgcatttgtgggaatcagcctctgtacagaaggccggccacagcactgctgcccccacgtagtgtggggatggttggcatagtgtctgaaagggggaaagaatgagacggcttattttctgtattttactactgcgctgtacctagatgatgatgatacgtgagttaggctaacatttcaacgtaattttggatagagaacttgtctaaagtttacttcatattcaaacctgtccaaatgagaagacggaggggtcctacatgtcccagactttagttgggggaggtggagtcgtgggccagccctgccgcaggcctcctcctctctgtccctcagggttcttctcaggtggagttgcggagctggagtgtgttgttgcggtgcccagtatggacctattaccccaactcagtgcctggtagcccccgttgttgttttttttaatttattttattttatttttgagatggagtctcactctgtcgcccaggcaggcgtgcagtggtgccatctcagctcactgcagtctccgcctcctggactcaagcgattctcccgcctcagcctccttagttgctgggattacaggcgcccccccatcacacccatctaatttttatatttttagtagagacggggtttcaccatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctggccccctgaggcaagtgtgtgcactgccacagccccctttctgatgctgcatttcttcctctgtgaatggagagattctgaattcattgaatgcattttcatgatgtgatactttaggcctgcgtaccaggaaaataaatggtcccaaccacagttagctcctcgacttgcaggggaaggatgctgagtggaaagtcacgttgggaggtagtcggggctacaaaaggggtacaagtcaggagaggttgagcccagaagggagtctcagagaggtcaggctgcgtaagcagactcgaaattttgctataaatgtgagctttgaaaaatgataatcctgccctgggaggagtagtaatgtctccttctcttagtgatccacatgaacctccccagccaagacctgctggtccagaatctaagacaagagaagttcggggaagtgaggatatgaggagaaacgaatgagaactgttttcacgtgcctgcttgagccagcacgactgcatcctgccttccctgagagacatgctgagagacacgctgcttccatcagccgctctgtggctgttcagcaggatggcgtgttcagccggggagtggtgtgtcatcaacccaatttggcagctgaggcaatgaacacagagccaggaccagaagacctgggggcatttttactcttgaaaagaacttagacattgatcaacttaataggctcatttcatggaagaagtagaaatgcagaaattgaaaatcttgccctggttcatgtagcctgtgggaattagaaaccatgattccaggctcctggccacctctctttccatggagggccccttgtggggatttcttctctagaatgggctccctctgaccacattttgtccatgtgtgaaatccagcatgactgctgatgccttccatgtgtgagtggtggccgtgggcagtgcctgatgacctcatctgatggacattcttttccgtcctcctcctcacccctctcccataacccgggtgcagaaacattcaggacattaaaccctgggaacctcaatttgagataagacctcttatgtcctgtgggtcaataggagtgactcaaacgttatgagaagcacatggtcgcagggcctgtgaggaccacctcagcttggggatgagtccttagttaagcttatgcttgatgttgcaatcttgaacagaaaagggggatgagagaggagagaggacagtagagaaagggggaagatttattttaaagaattatatttaaggaatcaactcacacgattgtggggatggcaagtctgaaatctgcagatcaggccacagactggagaaccaaggaagagctgatgttggcatcggagtccaaaggcagaattccttcccaatctatgccctcacttttaacggcagatggtctgcaaggttgggaattcaatttgcattgtaattcagccactgccaggatgagatcctacttctggttttcagccatctcagctctgcatctatgggacataagggcagacatagaaacttttgattcattcatgtggtgcttgagctgggaatttgaatccctgaattcattcttcttttttcccccactttgtctagtacaattaggagcaaccaaccactctcgttatacttgttaattttacaaaaatgtttaaggtatctgctacacacccacctagaaccttgcctcttagaagcctttgggagtatttaataatattttctgtgtctctattgtcccatcatgccctgtactctcctctttttactactggacgtagaatcattagtgcctttcaacccaatcagatctgagaacgaatttcagaaacctcagaacccattcagaaaactcatttttaagatgatgttcttctagaaccactcttgctacgaaaacctgacagcacagtccccaggctgtttgttagggtctggcataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgtttcgcagggagagataagcctgtggtcagcagcattcatccccatggtattcaggccactttccaagaaccagcccctccttgtacttaagtttctagaggcagggccgaggagcaggcacagggagaggatgagcgtcggcaagttacaggaaactcaggaaaatgtttatgtgtgtccagggattttcagagactatccagccattctttatctccaagtgcctctgctctcatgaacttcttcatgtggacaaaagcaggaagcctttagggccacgcatctcttgttttcctgtgacttacacagccctcacctttgtgcttagatggactgtggccagcgggacctccaggcctggctgggtcaggagagttttgcttaaccagatctgtttgatccttgaaccaaaagcggggagccagagagatcctttgagaactgatgactgctgctgggtcctgcccagccatttgcattttataaaggtctttggcagcggccaaggccttctcattatgtggtgtttttccacttcgggatgaaccggagtggtttgtgcagccacctgatagctctttgcaccagcttctgcatgggagactttgagcaggccaggagccaaggggaccctcctaggccttccgagcacctagcactggcccttttcttcctcggggcttccttctggaggaggtttccctgggtttggagtcctccctcctgctgggggtgggggcgtggttgctggtggcctggagtgagctgcctgctgtggcctccagcactccccagctgaacagcgagtcctttgtgaaattcctgaggcaggagggggcagctgtgcagagccagctctcagagtggccgacagggagggtgttgtggtgtatcatcaagtgataaggccttcggaaaggctgtggagaggaaggaaaacacattcctgactgtggtgtgtttgcccttgagggccctgtgtttggggaagtagagaagcttggctgcattgttgtggggtgggagttagccctgtgctggggggagctagtgagagatgaattcagctgacctgggatcaaattccagcttggatgcctttaattaataacatattagaccatttaatcaatttaacacacgtttttggagtgcctactatgtgcaggcaggtaaatgatcttcaaggtgtctccatcaggtggaaagtcaaaaattcagaactgggcaatgactggaggggaggatgggattctcaggtgaagggtgtgagacccgagttgtgttttggacgatgttaaaggaggagatcagcttccagtagtgaagagcatctgatgctttggtgaggaggattttcttttaagtccttgaatgcagaagggctcctttggaagattttatgcaagagaatgccatggaaagattatattatagtggatcactctggaagtgtcatgcggaatgaatggagaggtaggaagcggggttgggagagcaaacgtaaatctaaggtccaattgggaggctctgttggaatgagctggcgagagatgatgagggcctgatttaaggaacgattgtattgaaggcactaaggtattggcattcagcgaatgtacatgagtctcaactttctggtttacatctgaatggacagagaagaggacatgatctgagcatcagggagttgatgtttgtcttggacattgcattaatatagttaggctaggcttccagaaactctgaaatcccagtggcataatgtccagtttgtttctctctcacagagtcagctgtgaagatggtggctgtaacggacagcttcttccaggcagtgactcagggatccaggctgtctcttgaggatatctggggggttatgtatttgccctgaaatacttcgccctggtgatgtcatgtgtgatttcctcccgcagacctttagtcagagctagacactgtgaagggctaggaattgtgaaaagattgtgtgaatgaacaggaaggttaaatttgaggtgccataggccatgcataaagaacagtccagatggcacctgggaccggatgcctggacaccatccgagcaggagattaatggaattgaaaatcagcaacgtaggagacagaagccttcaggatgtctgggatcctatagggagggtgtgttgtttgaagagcaggggctgaaggtggaatcttggggagctcatgacaggctggcagaggtactgaatttctccaagtctcagtttcctcatctgcgagatgagcctgatatttcctataaagggatagtgagtgcactgggtgctgctgggcaggcagtggctcctcataggggtggttcccttccccctgcattgtgttggactgaaccttgtgtgttctgtttgtcaggaactgtggtgtatggcgagcccatcactgccagcttgggaacggacggctcccattactggagcaagaactgggccaaggctgctgcctttgtcacctccccacccttgagccctgatccaaccactccagactttctcaactccttgctgtcctggtgagtcctggcgacttgttcacacttcacattctgtctttcttcagaccagactgacctgttaggcgaaaacaacatggtggccaagagcagccataaaactgggagacccttgttcaccaaactaggttggctacatgagtacagggaattgtcattctagcaccattttgggaggggattctggataaaaacctgggccatgttgaaagtcaagccaagaagggagaggaggcgtcaaaaggactccacttgggttggtgtgatgccattcatgagacagcccaccaaataggtgtaggcgcacagcatcttgacgaagctgcagcaccacgttatgcattttctttgcagtggagacctccaggtcacgggcagtgcccattgcacgtttaacactgcccagaaggctgtaggaaaggacaacttcaccctgattccggagggcaccaatggcactgaggagcggatgtccgtcatctgggacaaggctgtggtaaggagcgatggcctcactccttggtggctctcagccttccttgtcctcctcatctgggggccatggggctcatggaggccttgaaatgacagacagtggaggacatcctagaagccagtacttatatgacaatatttctgagggttggaaatctaagacctcttctaataggtcatttcttcctaaatattacatatatatttctttttaaaacaatttttaaatttttttcagacaaggtcttgctctgtcaccaggctggagtgcagtggtacaatcatagctcactgtagcctcaaactcctgggctcaggtgatcctcccatctcagtctcctgagtagctaggaccacaggctcagaccaccatgcctggctaattttttttttattttttgtggagatgggggtctcactatgttgcccaggctggtctcgagttcccgggtttaagcaatgcctcggcctcccaaagtgctgggattacaggtgtgagccaccacgcctggcttacctgtatatttcttatcattatcatcaatggaacagtaaagactgaaaacctacacagctttagatgtgactctgggtcagtcaggaacaaacttccttagcaaccaggtgacttactcagttaatcctcgtctactcttggaaatgggctcaatttccttaaaagtgtcttttagggctctctggacttagcatgtcttctactgccagcttctagtaggcctgctatgaacatacactgacctttagaggatctttgggctttttcattttaatgttttaaaatatattaacagaataggttttctgttttttagtgaattgtttagattatatgaagaatatatccttatttccagaagaataaggaagtaaataaaagtcactgtgtttcagatataaccacaattaacattttggcaaatgtctttccattttttgctactacacaggcacacacatgtatatgtgacatgcgtgagtgtgtaaataatattggcatcatacagctgggcccactcccaggttcatgcctataatcccagcattttgggaggccgaggtgggtgaattatttgagcccaggagttcaagaccagtctggcaacatggcaaaaccctgtctctactaaaaatacaaaaattagtgaggcatggtggcaggtgcctgtagtcccagctactcggtgtgggggaggcaggaggatcacctgagccttgggaggttgaggctgcagtgagccatgactgggccactgaactccagactgggggacacagtgagaccctgtctcaaaaaataataataataataatattggcatcatacatactattttgtagtcttttttaaaaaaaattttatcatggaaatatctccacctgcttaaatatacttgaaaaagttgatttataataacagactcttccatgtgagtgctaaactgggactcatttatttatttatttatttgagatggagtctcactctggagtgcagtggtgcgatctcagctcactgcaacctccgtctcccgggttcaagcgattctcctgcctcagccccctgagtagctgagattacaggcgtgtgccaccacacccagctgatttttgtatttttagtagagacagggtttcaccatattggccaggctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtctcattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaacatagtgagatctgtctcttaaaaaaaaattagcctggtatggtggtgcatgcctgtcttcccagctactcaagaggctgaaagaggaggattgcttgagcctgagaggccgaggctgcagtgagctgtgatcactctactgcactctagcctcaatgacagcaagaccctgtctcaaaaaaaagattaaaaaaaaaaaggaagcctagatctgtggctgtattttgttgaaaaggacagccaattgggccaaatgatatttcctaaagagggattgccacccctgcaaattaaacgaatttttttttgttttgaaataattatagattaagaagcagttgcaaagatagtacagagagaggtcccgggtacccttcacccagtttccctcatggttacatcttatataaatgtagaacaatatcaaaaccaggacactgacagtgtcacaatgtgtgggtatagctctaggctgtgtggccacctgtggagtcatgtgaccatcaccacaatcaagatgcaggtctagtccagcatttcagagaccaacctcttgctgctcctcccctccaccctccctaaccctggaagaacccatctagcccctcatctgttctccatctctaccattttgttatttggagaatgttatagaaatggagtcatacagtgtgtgacctttgagacggtttgtgtttcacttggcacaacgctcttgacatccatctaagctgtcgtgtgtatcaatagtttgttattgaaaagtaactttttaactcgtttctgctgtgtgcctcctgtgcacacctatgctgtctccctcaggtcactgggaagatggatgagaaccagtttgtggctgtgaccagcaccaatgcagccaaagtcttcaacctttacccccggaaaggccgcattgctgtgggatccgatgccgacctggtcatctgggaccccgacagcgttaaaaccatctctgccaagacacacaacagcgtaagacctgttaactgtgcagaccccatccaaacgaattacagtcacagagacacagacggagggagagccccagggtttctaaaaagaacttgctgtgatgggaatgcgctcgactgaggatgttatgatttgcaatttgctgggaaaagaatagttatttcattttctttagtgaggtcaataagattgttactctcataatcattttggaataccacagcctctctatctatagacctttagagcctctaaagtgatgtcaggatgtgcaaagcttccagaagtcaggcaccgctccattttcataggttggcacagcacttctcatggcagtacttggtgcaagggacctcaatgaagcagtgagatgtcctctcctgagatgcccactggggactttgatcctcttaagccattgttttctcaggccagtatccatgcagaaaactggatgacagccattcttattatcttaaaggaattgattgactgacttctccctaacagaagtaccccccagccatttgattgttgttttaggatctgccgctttgggtatctcttccctctgggtctgggctttagagcttagagatgtcctctcttgttaacaggacccagggcaagtctgttaatgtcttacgctcctcagctgagagtgaggggttcagacgaggtctccaagtgtcctgtgattctgtgaggtcagcagacattaagcagagttgttagacactgccgattcctcacaagcaacatggtataggcagaaaaactgaaggaatatgcccagagggagagctttggaaaagaaatgggcctcgggcagaagagtttcgtgtcaggaactcatttgaatcttgaagacagctcaggccagcaagcactgacacctcccccacacaccacgacagcttagggcaggtttctggcatttctccgggacaaccctgggactttgccctgtcccagtcctctctcatttgcacacacagaggtgtttgggctgcaatgggctcaggctcagctctggcttctgccacctgtgaggaccagggtggtgggtgtttctcagaagactgttcaagtctgtgtttaaagctgtctttctccctctcccaccaccactcactggctcagcctggcagcgcagccttatgatcgcgccccttacagcccagatcatgacttcttgggtgtcctgactggctattttatggtcagggatcctagggccctgccccatgaacctccctattcatgtgcctgtaacttcacattctcattgactctttcatttgaccttctcaataaagggactggtattattatcccaatttgggaaaataaataaacggaggcttagagagcttaagtgaccagtctaatgttacatagcgattttgcggttgagccagaattagaacccaaaattgttcaggactcttccctgccagactgcatatgcagcctcttggtcaggcttagacggggaaaatgcttcccctctcttgcaaggttgcttcccccagaggtgctataaatggctggctgggctcgttatttaagacacaaatgacctagctggggaacttgcatttggagttcttaacctagaagacgagacagtgggaaggagagaagatttgggaagacagattctgccctccagacattttcaccccaacctaccctgcttttacctccaggtgacctatggaagaaatgttgactttcaaagcggtgcttttccatccccacctgttttaaagagccagcactaagcatgtgcctgttcgttcatcttctgggaaaatgcaaccaggagactttccctgcatagtacagtgtttcctaccatgaggctaattagctttagttcagagcatctagctaactattatcgacagccctgttgctaagcctttgcttggattttccaggcatctggcccgatgagtaattttagggagcctgtgtggatgtaggttaaaaatgtctatgcatggtgagtgaggaagcctccctgcatcatggtttgatggagagtaggctctgagtatctgggaattgtgatctgacccttggacttgtcaatgttaagtcactgagagtcatggggctggttcttccatcttttaaaaatgatagatggccccagaggtcttctaggtgctcatttataagcaacaagactcaacgcatgcattgtgtgagatcttggatgctgcagggctggcaagtgttagcaaagtgcaataaagagccagacagtgaatgagtgaagattttctaaatgcctactgtgagccaaatagtgagctagatgcttttgttcattttatttcatttgattctcacatgagtcctgcaaagggggacctacttacccctcacagatgaggaggtggaggctcaggggtgtgagggatgcatccaaagtcacatagctggtgaatggcatacctggggtgtgaacccagggcagatgtctccatggccgaggctgcgcccatactctacccagtagggcacaagaggaggttgtcagggcataaactgttagctgtggagtgatgtggaagagatggctcttgatccaggccttaaaggatgactcacaccctttcaaaggttgtttctgagatgaccagggatgaggctttttgtattgtcatcttcacatacacctcgggagggtgcagatgaagaaactgaagctgagacaggattaaagcaatctccccagagtcacacaacttctggattttaccgtatctgagatgccatcgattttaagatattccattaggttatgtaccacgatgaaagaaaacatgcccaagacgaggagtctcataggagactgggccaccaagggccagcgtgtgcttattatggcatctctggggagaccatctgctgtgcagacaggggtggcagaaaatctcgcaggcctcgaccttggcattggttgccaagagggaaaaatgtctcccccaagaattggaactggaagtgggtgcttgtccagccttgtggtctgaatgcatgccgcctgtgtggtccagaacaatgtcaagctgagaatttactgtaaaatgccctcagtggggttgtcccccaacccagtggcacaaacaaacccatatccccctagaagaacttggatttagtctaggctggcagtacccgcgtggctccggctgctataagacacattctgacttcagggatgagtgtcttagaattgatgaaagacaattttaagtcttgggtctcagtaatccaagtgcagagtcctcttccctccctgctggcgcctctctgctatggttcctttggtagcttctgcatgactgctttgagactcagagcaatgtactgacagccctcgtggttgttttcacccaacattgtatgcggggcattgtgcatttacatgcccgatgtgagctgctgagctggccgaatccgtgttaccagccgctgcactaagcagaaatgtcatcttgaactgcagggtgctagcacagctctctgttcagaggccagctccctgagtgctgataacctggtctgaactttcccagaagcccagggtgctttttatggttggagcaacctattaatcctctagtccagactcagccacagccattggtccccgtgaaccaaacaggcaggaagaagcgggaggcatttgggatctgggaagtagcactgggttagcagaagctgcaggatggaatgactcctgtgcaatgactcctgtgttctgttgcttcattaccaaccacaaactcacatccatatggagaccccacctattttccaagagggcacacagatatgtctctgttttacccggaaaaacttgaaaccagaaggatagctacatagctacattgttctggaaattaactagccctcaatcattttatcggaggcatgtctcttcagtgaccacaatcctttcatttagggacttcagtttaaccacaccgcaaacagactagaaaaccaggctagccagtgggaaaacctacttgtggatggctcatttcaagattaaatttagaacttggtcagagaaggcctttggaattcaaccggaatggagctggagatggtgggaacacagtctctgttaataggaagaatcattttctttatatttgtgtagcatttacaaacatgcacccttttcacacaattattctgtttaattatttttctttctaatgtggagaggtagaaaaagttatttcatattctagacagggaaatggagacacagcaagtaagtgcctgctggggtgcccagttgggacaggatccctgtctctgagtctctcttttgtctctgtggggttggggcagtgggtgctgccgggtggattgagtccagccagagtggcctgttctagagtttactttgccttcttctcagtctctcgagtacaacatctttgaaggcatggagtgccgcggctccccactggtggtcatcagccaggggaagattgtcctggaggacggcaccctgcatgtcaccgaaggctctggacgctacattccccggaagcccttccctgattttgtttacaagcgtatcaaggcaaggagcagggtgagtagttttgttctgatgaattttttgttaaatcacgaattaagttcaaggccacaaacatttattaagcaccttgagacagaatattaagatgaatttagtggattccagggataagagggagcctgaattttttattcctggcatttaaaatactggagaaggagtcagtcgtgtccacagagagccctagcaaagtgagatcatggtatatgctatgataaggagtgtggagtaaggacccagaggagggagccactgctgtagttggggagagtgtcatggggagaggacattttgagttgggctttgaaggttaagtaggagtttgtcaagtcaaagaagggagatgagggaatttgataagagtatcatgagcatagaaaatgtacagtgtattcagggcatgtgaagcaggaaagagatggagctataagggaattaaaaggagagaatgcaattggaaagaaagtttggggccagatcttgaacatgataccagatccgcctcacagcatgcttaggggattcttacagggtttaaagttgaagtgtcttgggggaaaaattgtaaggtgtgttagtttttgtagagttaaccagttactggaccttgtggggagttttggcctggcatggtgggagctggccccacacaacacctgtccacctgtctgtaaggagagccctccatccctagatctcacaggcccatcctccctccaggagggtttctagagaggtatcctctgtggctgtggcctgagctggggggactcttgtgttttgcagctggctgagctgagaggggttcctcgtggcctgtatgacggacccgtgtgtgaagtgtctgtgacgcccaagacagtcactccagcctcctcggccaagacgtctcctgccaagcagcaggccccacctgtccggaacctgcaccagtctggattcagtttgtctggtagggttggggcttggggagggcacagttctgcagggccagctcgctggtgctggcgaggctacagttgcatttggaaaggacacagaaatagaagtgaatgatattccctttctctccaacgtgagaaatacagtggactcagatctctggagatgtattttctttttcttttttttgaggcagggtctcgctctgttacccagactggagtgcaatggcacgaccttggctcactgcaacctccacctcctggttcaagtgattctcatgtctcagcctcccaagtagctgggattacaggcatgcaccaccatacctggctaatttttgtatttttagtagagacggagtatcaccatgttggccaggctgatagaactcctgacttcaggtgatctgcccgcctcggcctcccaaagtgctgggattacaggtgtgagccaccgggcccagcctagcttggcctggagatgtattttcatagttaatgactggttgggtttcagaatcttgagatcagtttgtgtcacacaatgcccatactgtgttttacctaatatattaagaagacatttgttcaatttattaggtccatcataagaaaggacactgtggtatttcaggacttctcttctctcctacagtatattgtagtttagcttgtggagtttggagtttcaacagcctaacttcagggctcagctctggctgtgcttcagtctcctcacctgtataatggcaataatagtagttgctcccccgtgaggttgttgtgagggttaaatgggttaatatatatgtacagtgcttagaatggggccatttgagaactgttagttgtatttgcttgggtaatttgtgtgatatccccttggtgagaggaaagggttcagatttttaagtttccttgcttgaaacttctttcccatctttcatttgtcccatgactagaacattccactcttccagctccctgggccacagattcctatggcgtattaaagaaattgttaaaccagagagaattttttttcttggtggttgtatgggtttttagaaagtaacctatgtcccatatatggattaccagttttcaaaacatttaaaaataaggaactttactttgttgtaagtaaaacgtgtataatcatgtctgtgttttctgatctctcaaagctgttccaatataaggtgccatcgttcctcctacttgtgattatatgtgtaggattaggggattagaatgccagaagagggctatgtcctcagaaaagccacagccaatttgactaatcagaacaggggacaggacagagtctaagatgtagtgatattttgtatatagttttactttctccagtaatagatccaacaacctttatacagtgtctgattctttggttaccttaggctcatctcctttttaaaaagtttatttttatttttagagatataatagtatctcactgtgtcacccagtacccaggctagagtgcagtggtgcaatcacagctcactgcagcctcgacctcctgggctcaagtgatcctcccagctcagcctccccagtagctggtactacaggcttgcaccatcacgcctggctaattttttaattttttttttttgtagagataggctctcactgtgttgcccagactgttctcaaactcctggactcaagcaatcttctcacctcagcctctccaagtgctgttagtaggattccaggcatgagccaccatgcctgctctccacctcccttctgtagtctaaacttcagtgaggttttaagagaagaacaaagaatgtgaggccgggcagggtggctcacacctcttatcccagcactttgggaggcagaggtaggaggattgcttgagcccaggagtttgagaccagcgtcagcaacatagcgaaacccctctttacaaaaaatttaaaaattagctaggtatgggggcctgtggctgtggtcccagcttcttgagggggccgagtgggaggatggcttaagcccaggagattgaggctgtggtgagctatgatggtgccatagcactttggtctggaaaacagagcaagacgctgtctccaaaaaaaaagaatgcgactagcacttttcctcctgagctgtgagatttcaccttcaagcaggatcttgtgtgactgtcctggcccctcacccgctcctctcttctcctctccctccaggtgctcagattgatgacaacattccccgccgcaccacccagcgtatcgtggcgccccccggtggccgtgccaacatcaccagcctgggctagagctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggccaagtgcaggaatgggccatgccgtctcacccacagtatcacacgtggaaccgcagacagggcccagaagctttagaggtatgaggctgcagaaccggagagattttcctctgtgcagtgctctctggctaaagtcacggtcaaacctaaacaccgagcctcattaacccaagtgaaccaaccaaagtcaccagttcagaagtgctaagctaataggagtctgacccgagggcctgctgcttcctggttaagtatcttttgagattctagaacacatgggagctttttattttcggggaaaaaccgtatttttttcttgtccaattatttctaaagacacactacatagaaagaggccctataaactcaaaaagtcattgggaaacttaaagtctattctactttgcaagaggagaaatgtgttttatgaacgatagatcacatcagaactcctgtggggaggaaaccttataaattaaacacatggcccccttagagaccacaggcgatgtctgtctccatccttccctctccttttctgtcacctttccccctagctggctcctttggacctacccctgtccttgctgacttgtgttgcattgtattccaaacgtgtttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattc

SEQ ID NO: 11942 - DNA, 66988 bp, Human
  misc_feature (1)...(66988): n = A,T,C or G
gtaaaatctacaggaaagatgcagagagagagagctctgctggtttccatagtatgtagttaattctccttttactctgttctaaatataatcctgctcatttgcatgccaatccccagaatgctttgtaatttcacaactcttggctagtggtctcagcacttacgctttaagaacaaagcaaaatgtttagggcgtgcctttggcccagtctttttattcccccttgtgttttgcaagagtatagggaggtgatctttgcttggcattcatcctcctttgcagagtatcacagaaataaagtggagactgctgtggacttttcttgcgaagactgcattcagtccaattaaccataaataaccagaagcttggattaactcacttgagagggagtgtttaaggggggctttgtgtgtccttggattatgtgaccagtctggttcgtttcgggtttatggaaagcccaagccggagtattctgtattctctttctgtggatgccttatatagtttctttatcgcaagcacgtcttcactttaatgacaagatgtctagaattgccatcagtgggctgccttatggaaacgtgaattcaagattcaacacagctttagtcatgcttagtgacatacaggatttctatttaatagaacattaagattgacaattggggagcggtgggaaaattgtcttcaaagggttttataattttttttgcatagcaagtctttttttggttccttaaattttatgtttggaattatttgtcgtgagagttgaggagctccctcacccccagccaccactcagaccccacccacagtggcctctccaaatatgtctccctttggccgtttgattttagcaggtagctaaaggacaatgtattccatcgccgaagggccatggttttgcttgtaataacatataaaccttcgtctgtcagccctgcctaaagtaaactcgggattgtgagcagtgcacgtggttcattactgatggggagcaatagcagttctactccaaatccatggctgcgcaccaggaacgtgtctgggctactgccttcccactccacaggtgttttctactttttactcacagagcagcattcatgttctttctttgattctgagactcagtcaggcagtggagtttctttaacaagatactacttggatattttttaaatacagggaatggttgagtccactgctaccgtgccccttgcagcctctgagagcgagtcacggctttccattttctaatgtgtatgttccgggtctggggaccccagcaggcccgccaggttgcagagtcggaccagtctccggcgtctgaaggggctgcgccgctgtttaccaccccgcgagcagcagaggcggcgcccagccctcctctcgaacaaaggcgcggccgccgcattcgacccgcgccatggcagaggagagcgggtgccgggagggaagccgggaaccgtctccattctgaaactagggcggggaaggtaggagatccgacgaggagctggctgggggcggcggcgcccgcaactcggccccgcggccgggagggcgtagctgatgctcccacccccgggactcagcctccgctcccgaaaagcccctcgcgccccctggtggctgtggagcagcctgactccgcagcactcgcgaatcagaaaaaaaaaaaaaagaaagaaaaagaaaaagtgggtgaggcagatgcaaagaggaaaatcaatagggataagagagaagagggaggagtcgcagatcagccattcttgtcttatggggtcccagctggcgcagcaaaagaaaaaaaaaaacaaaacccgggcgtgaacgcgggtggaggagggtgtgcgtgggggggcgggggtgaaagggggaccggggagatttactattgtctctggcagccgccgcgggagcccgggaggggggcggaggcgggcggaggcggcggcgcggccagcgcaccattcactccacctgatctcggggcgctgtgcgctgaggaaggcgcgggcgagccggagcagaagaaggagggagggagccagccgctgcagccaccaccgccaccatgtcctaccaaggcaagaagaacatcccgcggatcacggtgagtccgggcgccgctgctccctccctcctcgctcgctccctgtccgctgcgctgcgggcggggtcggctcggatcccgccggcttctctggcctggtccccggggagggacggagacccggggtccgggtggcggagcgcggcggtcagtccagccggcgccacacagactgagcgaccctggggtttggggaaaacaaaacaaagaggaaacccaaacagtggcacggagaactttggattatttatcctcccttcccaccgccggtagttccccaggagcgcggggctcgcggctctcccaggaccactgctccgcctggagtgtcggtttttgccgccccaggttgaggtgtgctttttgtctaaggatccttttggccgtgctgggtttggagagatgacacctttccccaggggtacttggcagcccgaccgcgcccctctcccagctccagccccacggctctgacccctgcgccgcgagggtggcagggtgtctggaccacctgtcctcgccgtgtccccttcttgcctgcgttcagtccgactcatgtttcaatgtatcgtttatgggactggacagctaacgtggctgcagtgggaatgatcaactttatgtgtgtgtgtgtgtgtgtgtgtgtgtgtgtgtgtgtgtgtgtgtgccttcgatgcactatacatttttcatttcttttctccctcacatcaaagaaaaggccgagtttttagagcagattttagtttactgtcgcgggcgcacgctgtatgcatgcagtgttcaacccattgtgtgcaagacggagacaccgcgactggcgggtgtcagatgcgctagggtgtgcctagggcggggtggagaggggacgtgccattatcaggtacagaagccgcgtcttcaccggcgcccagcaaggctgggattccgtggtgatgcgctgtaatgatgcccccaaatagtaggcacatatggcaggctgggatggtcatttacaaaaatagaataaataaaaactaacgttttttagtttagcacgaagcagtgcggttgtgctttgtctatagtgaattggatggtgtgtgtgtgtgtgtgtgtgtgtgtgtgtgtagtgggggaatgggtggctactccatctttgcaagctgaacaaaggaagtgatcagctggcccctgggaggctctgcagccgccctagggcagagctttacctgccacagtagttgatttgcagggtccgccaggttttgttgtgggcatgagtctgtttgcacttgttcccttaggcttggaacatcctgtgcgtttgcgattgagatgcagaaccttcccctctgcaggcaggaagaagcctcccttgcgcctactatgttttattgtcaaatggtttatttcttttgccgcaccatacctttttcatgcaactgagcttcacttcacacaaatgcaccccacccctaccagcttcccagctggtgctggggaagaaacactccccagggagaagagttgaggccagcagggatccttttgcctggtagaggctttgggttttaactgatcctcctttaccactacctgatggcattcactttccattattgaagaaacatcgtgggtcttttacaatgcacagtattgtctagtgctgactgtcttgtctttccaaagagctgtggaaattatcatccaaaaaaagaaagaaagaaagaaaaaagaaaaaaagaaagagaaaaagctgattgggacaaaagctcaatttttacttatctccccaactcaggagattgaaccacagctctcatgctattctatgctggaggtatgccacatgtatctgccacttgctttaacatccagtatatatttgctagttttcctgtttgggataggcagagaaccgatattttttttccctcctagactgcagtggttcttcttctggactcagcctgtgacatgacattgagagccacacccattcttctaggtatcatttaagccacctttaaggaaagataaggaaattcagcattgataacttgccttaggagctccagtaaatgtggttgtgccccaatcccaggaccagatttgcagtggattcccttttgtctctggttgaatgatcttccctggggtacatccttcattttcagtgcggcttccatcctttctctctgtgtgtggggcgtggtgctgcatagcagcctctgccttgaagctggggctgtatctccagcagctgttaacaggagtagacagtggttgtgaatttcttcaaaccaggctgccttgaattcattggttttaacaaccaaggggatgaaaaggaagggcatggcaggaggcggatgttggtctttggggataaggaatccatttgtaaattttctcatgcttcgtttttgcatttccatgaacaaggaatctattttagaataaaatatttatgtatgtttgcatgtctatagaagattatagttgtctatatactgtgaaggttgaggtaccttttctagatatagttgtaaatataacaatgtagacatagatattcatgtgcagcaaatatgattaaagatctaagtataacatataccccctaccatcaattctagtacattttaaaaatggtaacatggaatttgaattgaattttctatgccacctctattcctttctgtgaaggcagccccacccagtagctgaagtgtcactacaatctgaggactagtgggggcagtctttcttggcctggtaccctttgccttcctgggaactactttctaccactgttttgggtccaagataggattggttgtttttgttttgttttgttttttcctccttccacctatttttattgccctcctgagattaaggcattcttactatccttgttttattggtttcctgtggtagggctggaaatgagggggagatttctgtgtccctgttggagttggctcggagtagctacctttctcccgagtagctcccaagacttcagatcttcattgtcccctctcagggcagctatgtggattatctgttctacctcaacacaagccttgcttctaattatcagagactggcagttttgggggttcgacagatcacagcaagggatcttcactgtctcgcgatgggcctggtttacagatacataatgattatcacttaaatggattaattgatttaaaattgttcctaataatagcccatacctgttgagtgtttattttgtcaggtattatgtttttttatgccttacatgccttgtttcgttgaatccttgactcagtcaatactgtctgagagggactatagttacccctattttacaagttaaaaaaatcttagaaaataaaaaataatttgctcagggtcagagatttagtaagtgttggaggccagacttaaacctacatacccaactgaaattaaaatgcatgtccctcaccatcacactctttttggtgtctccgcctctgcctctctaccattgctgttacttgacattggtagggcaaatggtttccagaccatctgcactgctgggaggcatatttttcttgtcactgtcaacaaatcccacaacatggtctttcctaccttttatattaagtacatataagaacacgtttttgaaatagtagtcaccatcaattctacaggtaggaacttttgataagttacagttattgttttcctctgacatacgttacaacttgaagctgaccacaggaatgggccaggtcctaatacttaggcacttaggttccagtgttttatatgtattttcatattagaacctccacagataatcatttcccagttaaggaaggacattgaaatatggttaggtgaagtcagttatttagagttgcctggtgagaatattggggcaaagctagcaatcaaagctaggccttgtccagcttcaaagctgaggctgccatggtgcagcagctgcctcttggaggcacgtgcagctgagatgttgaaagttgtggaaacagctccagaattccctctaggagacaaattatagagaactggtcttttccaaccactgattggatttctgtaaacattgtcttgcagataatgcatttgttttgcattgaaagtttggttgtgtgtgtggtatttgggaattgctggaagacgtatccccagttaggaatacaacttgcaaagttcggtctagggcgtgtagtcagagctctgtgatctcccttgaaagggtgtgattgtgagtgtagtaggtgccactggaatttattttctttttcggagaagtgaagggaccttatgaactggagtaacacccagatctctgcagcagttaagctgggggcctagaactagactagagctagaagaagggacaaatgcaatccgacctttggatctacacattcctcttgcttcaatgggtgtcatttaagaattagaggaaaatattaggagatggagaactagagttgaggaaaccaaaagaagaggagtcacagaaaaccagctctctctgtgcaaggcatcttgaaaggggaattccagagtcaaagacagaagaaaaatagcaaacacttaagaatggaaagcatcttagatatctgatcatggaagtctcagcccagtctcagccctgcctaaagtgttcatttgttattttaaattttgagcaggtatgtgctgattcttagccaggttattccttttcctcaaatactaggagaaggcctcaggtatagaaagagccctgaacattagtagctgtgaccaagccagctgggcattgggaggaattctgaagaaatagatttcctgagagaattcaagtctatgtggcaagaccctcagtttgtaaataaaaaaccttcctgcttattgcactgagctactaagaggctcaaatagtggccatgaaagtggtctgtgaactctggatgtgttcaagagagcagatgctgatttatatttataaaatctcaactactttggaatgtggaaattaataaaagaagacttgacaatggtctggtttagaaagagactacttaggaaatgattttgtaaaaataagagttttccaaaacaaaaataaacagcgttatataaaaacttttttgttgttgtttagttacgttacagtgttcctaagaattttatgcttgtcatctctgacagtccgacacaggccattagaccgcctttgaacttttgatacagagactctcccttaacctgaatagagggcattttcctaaattaattgaactctgtatcattttttagtcctgatcaccttctagcctagagtgacacatgttatgaagatcctttcagctgtttcttcataactcgttttttagtggcttgactgctcttttttcttcagttggaaaaaaataaaactaaatttgaaaagaacaacaaccaaaagaaaaaaaaacccctcctgtcctaatgggccctctgttctttacctattgacatattttatagggccatttgtgtttgcttattacatttgaaaaacggcaaaatgtttacagtagtaggaatgagtctctaaggtgtaaatgttttcatcctttgatgaaatcagtgcatctaatcagaaggagacaggaaatttgaatatgtcattacctcttgtgatggatatatgtgtttgtttgtttgtcttttgttttttgagacggaggtttgctcttgttgcccaggctggagtgcagtggcgcgatctcagctcacggcaacctccgcctcctgagtagctgggattacagacatgtgccaccatgcccagctgattttgtatttttagtagagacagggtttctccatgttggtcaggctggtctcgaactcccgacctcaggtgatccacctgcctcagcctcccaaagtgctgggattacaggcgtgagccaccgcacctggcctgtgatggatgttaataggagaggcgaactgctccctggttactccctcctcaaatcaatgctcaactttgccttttctcccactttctctaggcaaatgagaaacaaataagaaagaccttggaaaacccagagaaatcgactcctgtattttcagactccttttgctgtgaagtccctctttcatcaacatatgcctatttcaatatacgaaacacaggtatcctcccatccctcaaaaaaagccaaagctagtttggtggaatagaatgaacctctcaatttggcctcttcttttggttccagtccctacatgaagcccagtataaaaactacttttcttgaggaactttcttctgttaattagattgtagggaacacagtggtaagaaatatgggactaagcatggtggagctattattgttaactgtcttagtaaaagctacatggattatctcatttaactcacagcaactcttatagctacagttattaaccatcattttgcattctggagagaggctcagagaaactaagtaatttggctaaagtcacagagctgaaaaagcaagatcctgggattgatccctgcaaaggtgaattcgtttcataggcaagaaagcagtagttccataggcacaggtgactacctcctcccgccattagccattatctccagctgtccacacctgttagctcctaaatgtgggtcagtattcacagggtggaaggattggggatggtctggccaaccctgtcacatcactattggaacaacaagtgagttgtgtgtcctcttgacagtggttcatgcattgcttctgccagctgtctgagttagcttctggcttttgcccaggagcatgtatgagtacagggtggaaaagcagatgctgtttttctgccttgcttcagagcagatctgggtctaaggccctttctcactctctatccctgtcttcttcccagacatagccaggctgtctgtttcccttcagtcacgcggagaaacattaacaggacacacccagcactttaagctagatggggaagctccacagtagaatggtccaggaacccatttggaacatctggaattcaaggacaacatttctcatggcctaattactatttcttttctctggaagtgctggacaatgagattttaagggtaaaacgagattttattttttaagagaagagttcctcggactagaagagcaaaagaaccatcttgttcttggatgcggaataaggaagcgaaccctggagggagtatcagcacactgtgcttcaggcctgcctttgcctctaatttacttgtcactttgggcaaacccttattatccctctcagattctgcatcagtaaaatgagggcattgaaccagatgatccttgaggtccctgccagtgcaaatgaccctgtgagccagcccctcctcactttgttccaaattcacagagaggagttctaaggccttcctgtgagggaaaagagagtagggagaaagtggatgagagcgaccattgttggctgaaactcagagggaccagccaacatctgtgttggatataagcggctttggttgctttttacacttaaaatcccagtctttttctcattcagggagtagacttaattaatagattttgtgcagaggagaaatggaataatgatgactgagatcctctgcctagtagagcgttagtattaattcagatgaacattattaaagtgatatcatgattcatttgctgtcacatacagtctttctttaggataaggctactattgataagggcatgaaggcgataattgcccaaaatctagactggccaaacaaacaagaaaacaaaccaaaaacaactcggagtctgtatctgctcaccaggctcttttttcagctgctcttgctaatattttaaatatgatggctgccatccaatggaaataatctacccccaaaggcccaatcatgccatgtacatgccatgaggatagggatggtttttgttttgttaccactgaatctccagcacttaatctttggttgtcacatattaggccctctgtatttgctgaatgagtggatatatttaacacttacctacaggaatgatttcaagagagaagatcacctgaaagtgtaccaatttgttcttgtacataagcttccctttgacatctttctagaatattaacttctaaataaggccagactcttaaggcataggatcactgggccaagagaaacatgacagctctttagcagaacaagcaagtcattgtaatgcagggcctgacctgggcacatgtgccagaaagtccatccatcacttggacttctttcttgtctggcctccagtcctctttttcttccagcttctgcatctgggctcattctgagcttgtttcaggggcctacctggatacttattgcctgcaacaaagacatcatttctcttactgcaaatgatttgaaagaattaatgcagacctttatgtcgtctttcatatagaggaaactgtcaccatgactctttgaaccagaatacaacatagatcttaattgaggtctctttctgcctttgcacgtaaactacaaagtcattagagttattagcagcaactagatagaccaatctgcatttgtaaagcaaacttggtattttggaagtattggttaagaagcagctcatagttctttttgtttccctattagggctggacatttacatggaatggttttgtgtctgtgtgtttcaaaagatttttagtctcttaccccactgcacctgtcagctttctctgagctacatttggagctattcttattactcgtttttattctaaatgtaattctttggtttgaggggtggggccagttaacacagattttaccaggcttatctctgggtacaaaccagagagtttatggtttcaataggtttatgtgtaatggtaatcactagagccttttaaagggaggacaaaatgggagaatcaaagtatattcatggaaccaaaaacctttgattagaaagtgtttgaagaactatgtgtgttataagagtgtcatatataatataatcaggtatgataaaagcattttgctattttttattgcataaaagatatttattgaccataagctctggcaaaagttagtttaataataagaataattcacatttattgtaccctgtgtaaagtgctttttattcattatctcacttaattatcaaaacaacttaattaggtagatagatttttcaccaggtctttctttccattttattgatgaggaaatttagagagattaagtaatttgcctaatatcacacaaggcttaaatgatggaaccaaaattcaaacttaagtttatgtgacttagagcccccattcttaaccccacggtatggtgctaccttaaattatccctccggagggataataacttatccctctcccacctctggagtcacaagactttgattccaattggagttcacttacttcaagtccaggggtaagtccttctctgcacctgtttcctataaggtatgagtggtgtaggttatgggggacatggaaaacagttggtgcccctcttctgcaagggggatggactccttagcactgcttggcatcaggaagccctctagccctcctgttaagagcggctttgtttctggcatgtccaaagctgctccacactgttatacttacacaaacaacttgccagggagattcccaccactctcagcatctttgcattgaattagcaaaactaccaattagggattcttcctaacgtgaatttaaatgccaccttctcatttcatactccacactgcatgccccattctcttaaatatatcttaagtaagattcttttgaggtttgacttactatggctctgtaaaattcatactttcagagtctccatggagataacttttttctttatctctccttaaaaaaaaaaaaacgggatacatgtgcagaacgtgcaggtttgttacataggtatacatgtgccgtggtggttggctgcacctattgacccatcctctgagttccctcccatcacccccccaacccccaacaggccctggtgtgtgttgttctcctctctgtgtccatgtgttctcaatgttcaactctcacttataagtgagaacatgcggtgtctggttttctgttcctgtgttagcttgctgagaacgatggcttctagcttcatccatgtccctgcaaaggacatgatctcattcctttttatggctgcatagtattccatggtgtatatgtaccacatattctttatccagtctatcattggttctatgtctttgctattgtaaatagtgctgcaataaacatacgtgtgcatgtgtctttatagtaggatgatttatatttctttgggtatatacccagtaatgggattgctgggtcaatattttttttaagtctaatgccccatcttatgaataataaaaccaacacccaagtggtacccacctaattagtgtttttgctactatctgttttactgtgggacacaaggattttaaaattaactaaggctttttttccattacaaaataagtatgctggttgtagaaaaatttaccaaaatcacaaacaataaggacaataaaaataagctacaatgaaattactcagagagaaccactgtaaactttcagtatacccatctagatttttttttttgactatatttgccatttattaaaatgattccacatattgtttacgctgttttatgccttacttttcattgcacaatatattacgacatctttccatgttttaaatatccttccataatttaatttttaatagctatatattattacattccttggaaaatctagttaaatgaatctcattttttttgcattgttttgattttttccgagatctttgcattaacaacaaaaatgaaatgacagatttattgtcggttgttttttagttgaagccaaactaaaaactgcctcaggatgagaggttgagtaatcttcccgaagtcactcagctcacgagtatcagactacagattgaaatcccagtgtctttactcttagccttatattcttgtcaccactcattccttcattagttgtgccattttacatggaaaactctgctttctctcatttcctcccgctcttgaatgagcacatttgttttctcaccgccacctttgccttcctccctgtcttgctgaggctgttgacatttgtagaggtacactgtgtcttgggacctgaagctacgcagctggagaggaaacatggccagttcttccccactccttactggctcaacctataagcttggaagctggttttaattttacattttctgtgtgtatgtgtgtttgtttttaaaacttttttccacttaattctttcaaggagacctttatttgaaatcatgcactttttcccgcaaagcgaatctgtgcctcaaatcttgatgagattactttgtttggggatattgataaattcatagtggggtttttggtttatccaattaaattggtttaaattatggccttatagagagaaagggcctcagaaaacttagagggttttaaggcaattgaatataatctgcttctagggacttcatcctgggtttattccacaaagaaggtatgttctgtttgtttccttttcatttcacttacttcattgcatgctctatctcagaaccctttttgctatgagaaattgtgggaaaaaacagccttgcttggctaggggcaggaagagaaaagggacctgttattccaaccccttcatttgaatgattgagaaaatgtggatcaaaaagggaaaataatttgccaaggtcatacggtaaaataggtttaaaaaagtatgaggcataggactcatttttccttgctcttctgataacttttgttatgagaagttatagtgcttttctcgtaattttgttgaggaaggcagagagtgagggggagagtgaattatgtcccctacccagtaattaaagtcttaaccctcagtaccttacaacatgactgtattggaggcagggtcttcagagaggtaattaagttaaatgaggtcattaggatgggccctaatccactctgactggggagttttataagaagaatagattaggacacagacacgcacagagggaagaccatgtgaggacacaaggattaggggagtttgatctatataccaaggagagaggattcagaagaaaccaagcctgctgacaccctgatctcagacttctagcattcataactttgggaagataagtttctgttgttaaaaccatcagcctgtggtactttgttatggcagccctagcagagtcataaagggagaaagtgaagaacaaagaatgaaaaaattaaaaacttaaaacttgagaagttctcagagagcagaaaagggagccccaaataaaatttataagaaattatggcaggccagagcccatgctaactgattttcaaccataattgtgtatatggcatttcattcaattctattaccatgccgagatcatagttattattaacccactttacaaatggggaaattgaagctcagaaagttaatttacctcaagttacatcattattaactaactggcagaactaagtccaaattcacctcttgtcagccttgaaaaccctcacttactgtactgttctatctccttttaagaaggttaatgtaagctgcttaggaaacattacttatcaagttatttaatgttaggagaaataaaaaaatgtactccaaagtctcagtgacctggaatccacttaattgattagacaggaaatatttggcccctgattttaggataaaaagagagattggggaaatttaaaaagatagcataattagatttcagtacagtcttccccatggctgcactttcacatgtctaaatgaacagctacacataatgaagaattaatgttcatagtgatgtgccgtgggccgtgaagacatctgatccatcagagagaatcaacaactgtcactaggttgcatttgctaaagcaggaaaccagatccataaatctataacatgaggagacttggaagctgtctatgtcagagttttacaaagacataatttcagtgattagatagataaatatgcaatcaatccaaaagaataatcaaaataacctgagctgctggtaaacccagatgttatgttttttgtttttatttttgaggtggagtctcactctgtcacccaggctggagtgtagtggcgtgatctaggctcactgcaagctccgcctcccaggttcatgccattctcctgcctcagcctcccgagtagctgggactacaggcgcctgtcaccatgcctggctaatttttttgtatttttagtagagacggggtttcacagtgttagccaggatgggctcgatctcctgacctcgtgatctgcctgcctcggcctcccaaagtgctgggattacaggcgtgagccgctgtgcctggcccacccagatgttataatatgggaactatgaagcactttcaatattgaatgcagatggctctgtcgaagctgccttctcactgttttaaagttgtgaagtctatcaatcctgaaatatatagattaaatttacttggatatttagtaatgacacagtcaaggtaagaggtggacaggcattgttttcaacagatactgggatcgagtcccagctaactgtatattagctgtgcatatttgttggttctacctttagagtagaatattaagccaaccacttctcaccatttttcatcactgtcatcaccctcactcaagcctctgtcatcttactccaagaactcttctaacttttctctgtggtttcactttgcctacccctaaattcgttctctattcatgataaccaggtggtcctctaaaaatgtaaatcaaaccaagtcactcccctgctcaaatatctcctattacacctcaactaaaacccagaccatggctcttgaggtcccatgtggagtggccctgcctacttctctggtctccagtcctgccactgactgtcagtgactcagcatcagccatcctcccattatgacactttcatgtccagctcaaagcttctgtacttgttgtttttttttttctccctaggactcagattattcacatctgttcaggagacagctccttagacatgccctctttgaaaatgtaaccaaatgtcccagactctcttcccagcctccaccgtccccttatcctttttctaaatttcacttatcactgttgaaattacgctatttatttagtaacttacttattctttgcactttcagccactgcagtgccttattttattttgttcactattgtatcaatagtactgtgaacaggaggcatttacaaatattagatgaaggaatgaatgaattaatttagactaatgtttctttccctgggttaagtggtttggcgagaacagttgtcaaggaaacagggttatcaaaaggctgttagtctgtctgctccatgatcctagggactctgtgtcataccccactgtatcaccaaaacctagctcagtctacccctgaatgaatggaatgataaatgaaagatgaagacttggggcaacaggggaagagtgataacacataggtgaaaactggctgtgtctgagatgactgacaaagatgataacttgtttgctattttttggacaaaatttaatacatgttacaacatacatcttgctttgatagacataaaacatgtaactgtaaacttcagtctgaaacatttctgagcagagacacatcacaaaagagtagactattccaaaagaagattattcacctgttgttagactcatagaatgttaaatagtgatcattgggaagagaagtgggcagctttatggctttgcaggtaagggatgaagtcttggaggttctaagcacagagaatgtattcccataatgttaacatggtctttgccgatagtaagcggtcttgaatacattccaggaggtgcctagtatgagtaaagccttagatctttattgaaggcgaagaaaccttttgttctaggattaactacccacttgtctctgatttttgagttctgataatttttaagtggtgtctcgtttgtatttagttcaagtgtttgtttcattcaaggtctgcctgacctcttgaagtccttgttctcagagcatctgcagttttatctatcaatacaacttgaagaagttcagggccaaagaatcaaaaatagcctctgctttgataaccacctctctatccaatgaaagcagagttgcgggtgtataggtttttagacagacagatggaagcctgtaaccaagaaaatcagtcatcaccattgtctgctttgtcaagaaggaaccagaaaaaaagagcgaactcttccctttctttccttacccatattcttttatagaaggtgtgtttgggttgttgtagaaaggtagttaagatatgtggtatgaatcaaaccaacctaaaaagaaatgaaaagtcaagttacttttcagggataaaggagagggaaggtaggcactaggtggaaggctttgacctgagaagatttagggagattctagcttctaaaggaactcacatttattgagaatctgggcttcatcctcacagcattcctttgaaaaagatattattttcctcgctttacagtcaggactccaaagcccttctctttcccaccattccatcaggctaactggcactgattcatcacttgaattcttggactgctttaacaatgaggaccctctttgcactcctgtatgatagacctaatctttgaggtctggactacaaggcagagcaaactggaagacatctgtggtctttgagacaattccttccttccacactctccatggggccctcttcatggccgcctggtgtgactggagcaccacagctgagtgttctgttagacttgcacaccacggacagttttaggaagttacataagccagtggttgtgtgcttatgaccacaatccccaagaagctcccacaagctttaaaaatacaatgtcagacttgaagaagaatccctgtggcctccacaaatagatggggagctattgcctgtcatttgaaggtgcttctcacacattccaaggcctgagcccgcattcctcctctgggagttgcattttggcgggctttcagatttggtgaaaaggtttcttgtttctgagaagcaatagggtgggaattcactcgacgtctttgtcattgtaaaggccctgtcaaagccagctgtcagtcagaaaagatgaaaagagagagctgcttcttaagagggagctgggtaccattaacggcacagcctcttggaaaggcgaaggggatcacagaactttgaccggaatccttggctcccgactcccattctagggatctttccacccttcttttctgcctttcagttggcacagccattttcagcgtggcattaactcaagcccgtccactaacacctgacctttctcttaaatcccaggccaccatttcagtgacctgctacattgctgtatggttgaccagtacctcaaaattattcttagtcttacacttcaattttgttagtcctttttctgtttcctgtgtctattaatgggtcctctgtagacatgctgctttaaaactcagtctggtttggcacgtctgcatctgcgtcactttcccttcctcttcagttacttagttgattgacactttcttctgcagtatgccattgcattttctaatccatattcttcctgtcacactggaccacagcaattaccacattcttttacttttttataattttctttattaagttccttttaaaagttataaagtacattacgcatatgcaactagagaaataatgtaaataaatagaagagagagaagaaaaagtttaaaaggacccctacaacctctctctgcatcctttccttctacaacatccaatgttaataatatgatgtgcatccttctggaactttcttccagatcagctcacacaaaaatataataaacatatttacatacagcattttttgtttgctttgacaagaactacatcatattttgcatattgctccagaacttacttattttagatatttcttcagttcatgatatagatttaaaggtggccataataatcataatccatatttgtggtgatatcatagtttattaaatcacatcccattgttggctattcagggcctgggctgggtatttcctgcttgcatccccagatatcctctccacctttgtctaccctgctccatactccgtgtatggtgtgccttagttggtttctttgcccttgggcttctggttgcatttagctcttagggcaccaataggagattagagggagagtgaacaatgaagtcggggtattttcccctgattccttcctatcactaggtcattgtggggcagctgcatgtctctgctgaaggttacggctcctgccaggcagccctctccatacagctacagtctccacttccaataaccactccctcccctttccctcttctggccttggcaatggctccctgatgctggtaggccctggatgctgcatatccatttatttgccctaaacactgcccacactttgttaagtaatttctttgttaaattctccttaataacttcttaataattttatctgtttcctgctggcacccagcatgctaaaggtcttttcttattttgttttgttttttttccccctgccacttgctgtttctaagtttttccttcctttatctccagcatgggcctctgtcagcttgattttttgaccctatgattgactattttacttattttttgaagatccttctagggctactacatagtaaaggtcaaacttcctagttggcagccgtttgcatcccttattccagtatcttaagctttggaagaaggagggtgcctaactccacaatctcttatagagatgcatttcttgcatcgataccattggttctcccaatgattggttgtgtaatattggaccatgagctaacctccctaagcttccatgtcttcatcaatgcaataggaatgacagtagcatataattcatagcacttgaagattgattgaacaacatgtacttaaagcttctacctgttttcagcaaataagaagttttcagtaaatggtaattatgaattattgtaacacgctgtgatcataattgccgttggccatacccacgtgtacaaatcagctatttaccttagattcacttaggcaaggcctctgtggatcctttaatctctgccagacaaaagatttttctgcctgcctctctcctctctctctctcttccccccacctttcttaattaatagactttgttttttagagaagttttaggcttacagaaaaattgtgcacaaagtacagagagctcccatagactctttctcactccctcctcacccccaagtttcctctcttattaacaccttacattggtgtggtatgcttgttacaatagatgaaccaatattgatacattgaagagagtccagtttacattagaactcactcattgttgagtagttctacgggtcttaacaaatgaaaaatgtcatgtgtctatcattgcagtatcgtctaggacagtttcactgctctgagccacttcagtgctccgcttactcaccagttcatcccctccctgttcccctaccccccgccccaactggtaaccactgatcattttactgtctttctatagttttactcttcgtcattttaggtcacattactatttgcgatcctggcttacttttctaactgttttatctttacttctctattcaccttctgtattcaacttcatggctagtagttacactagcatatgtttcaggaatgaattattaaactcgtttacccttagaataaagacttaggttgaatttaggcacttcttcctgatggaataggcatttggcttttgcacaggcccaggggctcaagggacaagagatcctgtttgattgaagctggatgtcacttctctagtccgcatatgtaagagagcttccacccatggcacgtgtatttgaggcctaaaaaggaacaatgcaaagcaaaacaaacaagtaataaaacacaaaactatcatataaatccagaccaaagagggacatgaattagctctctaaagcactgacttggctttaatctgtactggactttatactctggtcctgagctacagatttctcaagcagcttgtataaaatggtaatagctgccttgtatttgtactgtaatttggatttgattttaacagtacatcgatattacaagagcagtagaatagaagttgtagcaaggtggtaggagcagtagtaatatgtgtaatacctaccacttaggagtcttttttttttttttgagacggagttttgctctgtcaccaggctggagtgcagtggtgcaatctcagctcactgcaacctctgactccctggttcaagcgattctcctgcctcagcctcctgagtagctgggattacagggatgccaccacgcccagttaatttttgtatttttagtagagacggggtttcaccatgttggccaggatggtctcgatctcctgacctcgtgatccgcccgccttggccgcccagagtgctgggattacaggcgtgagccactgcgcctggccaggagtcttttgtgagtaccaaccctgcatcatgtctttaactctcacagtagccctgtgaggtaagcattattatctatactttacagatatataaatgtacctttttagaaagatttaccttcactcagctgaagaagctgaggcacaaagaagcatcaagttagttgcctaaaaatcacagaataacttaatggcagagatgctaatgtagccctggcttctggactccctcagttgctacctacagttctgggggtagcttcaaaaactgctattaggctggttttcttcccaggcaggaacctttctattttttccaaccaaaagcccagttaaagatttgccatatgtcttcacttacccatatctggtttcctgttttctgataaggcatctttgttcctacacctgaccctaccccaccctgcctctttccccatccacccaagcttcggacccagagcatggtccccagtaatctcatccttctactgtactgcctgatgtgggtggtccccgtcactctactttgagtcctactcttgcttctcacaggcccatgtggacacatatggacctatacttcaatagcagagatggttccagctgtttcataagatcattttagggggttgtggaagaaggcattaaataacatggaatcacataatgacaaattttgtcccttttctagttctttttcaaatcttctgagtagatcaaggaaaaagtctccgtttactactagtttctcattaacatctccctgatccgtgataatcttcctttttaacaaaataacagatccaagatcatcctttagagccctctcgaaggcagcagaatgtagacaaaatttagtgatgtttttattgtattcattcctaggttcactgtttagttttggcaagtaatactagtttagaatttatgagactaagatagtgttttcttttaaaatacatttatataaggataatattaagcaaataacagcacagtttattgcaggctgtgtcagatatcatgcaggtagtgcacaaatgactgaggtttgagctacacagacccagctgacctttctcgttgagaatggaatctctctagggctcctcttgtccagtgctgtccctctcctccacattctcttgcttctggcgtgttatctatttgtacttatctgtgtctggaacgctgttgaagattaacagaccattatcgggagctaggattagggtgctccccacagtccattcccccatccactgtgacccagggcaggccacatcacttgtcaggccctttgataatgacatctttaaaatggttaacatgaagttctggggagggaagaatgcacatagctggctttgattctccagttcagacaacagagcagccactctgccctgattaatgctgccctgggctactgctgcctccacattgctgtttttcctaccttgtgtctgtccgtctagggctaaaccaaagataataaagaaagtgaagacagtgctttccatgtgttatgtattctgcttcgtgggttgcattttgaagggagtgccccaggttgacctacttccagcacacctcagtggtcattaagtatgtttaggtgatgaggaaagggaggagtgtttgagactctcatctgtagcagttcagaggtttggaatagccaaccctggtaaactatgcccaatttcaatgaagactcggagccaagaaactgcattgctcctcaagatgtctatcttctcccaggcctttctgtttgtctcaatggcatgcttgtcatcgagggtcctagaaacacacccatgtactggagggagcgtgggtgggaggcagctttaagaccttactgccctctctacagtcctgctggaagagtgtagattgttatctcctcacaagggcttatttccagaggaaaaatgacctggaggggccatgggaacttgccctgtggggttgggtttaaaaggggaagtcttggctgaccttggctgctggtggcaggagctgagaacagttgctgaggcttagctggggactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctctctttttacttccttcctttattcatttctgtgttcctctctctttcattctccttctcccgcactgagttttttatggttagttttcctaatcagtatcataccctagtgaaggaaaagatgttagacttatatcacactttaaagtcctgtgccaagctggattgcaaagtagatccctttataaactacattaacacattcaggccattaaggggcaggtgtattgcactgattttatcagtagtggcttgaaagttactgaattcctaaagctacctacctgagagaactggacgcagtttggacactggaacgaattcagtatcaaatagagaagagagccctgtcagaaagagctgcttgtcataaggtttaaagacacttggtacggtgtcctaggagaaatcagtgatgtgccaggagatgggagacatgggtttacttcaaattggaactaatctactctgtcatttggagaaggtcactcacctctctgtatatatctccccatttggaaaatagaaatagtctctcaccaacatacttaaggcttaaaaacattcaaagtattataaataatattaatggaataaatgtaatatttattagctatttacttgtgtgctagattatacacgcacacacacacgcacactggcagccaccctgtgatgtgagctaagtattactatccactctgggctgatgaaaaaaaacgatgctctgagaggttaagtcccaactcaagatcacacacgtagttaagtggtgtgtctgattctcccagcagtggcaaaacctagctggacccaaacttgccagctggtatgcctagaaccctgctgggctgcaagacagtgacacacgtagctcttggtagctgtgcagggcctaaggcaggtcagtggcgggttgcttcaggctctgaatacgttcattttgggttccagatacccttcagattaccacagcatgccctagtggtatcatcattctttatatatatacataattacattagaaagattgctaactttgtagacaagaccatttaacctcctcagacatcagctcatggacgcttggcagtcttggctgccaggaacagaaggtgaagaggcccactgagccatattcatcactgagggaacttttattttattttattttaagttctgggatacatgtacgggatgcacaggtttgttacataggtaaacatgtgccatggtggtttgctgcatctatcaacccatcacctaggtattaagcccagcatgcattagctatttatcctgatgctctccctcctccccgcaccccacccaccgtgacgggccccagtgtgtgttgttttcctccctgtgtccatgtgttctcattgtatgtagtgtttgattttctattcctgtgttagtttgctaaggataatggcttccagctccatccatgtccctgccaaggagagagcaacttttaatcagagatgttgggtttgttcattttgttggcttttgatcttagcatgtgttaatctatcaggctcatccatgaattcatagacaaacacttttttgtgtccagtggggtttgattttatgtgacctgggggtggtcagtggttatgtcataccccacgctcacattccccagtgccaagcctaagaattgcctttcagattcctctttgttgatgactgatttgcctaggccgccatttatagtggatcccccttccatggaaagagttaaaattggggaggatagcagggcaagctgaagacccatagaggaagcatttatttgagctctttaagttcaggttttgatatttttgctctgcatggtgaaaacaaattaataatgttaatatttgtagcccatggagaaaactcttcttaatctcttctctgaaacctacaccaggcctatgattcatctttgggctctgtttagattcctgattattgagccagaaagattttatttaattactatttgaaaagtttccaatgacaccatctcaatggtgttaattccacttggatcagtgcttactatccccctgatgttcacaggtctggatatagcatttgcccctttgctgacatttcatgcttgttgaagggagtgatgatcacaccagtggctcagggctgcgtgtccttaggctggtcatatttcataactggtctcagttcagacagaaactggcccctttccaaaacccagtttagttcagttctttgctgggaagatgaagaaaatcaggaaagcattgagttatgagagggagggtactcttacagttaccaagattgttattattatgaagttcctgttgaagatgttctgtcaccttcctggacacacatagaactgtggggtggggttgggggcaggcaggagggcagtggttccttgtgctggtctgtgacttggtactgggctgcctgatggctgcataaggagcttataaaatgcagatttggtgatgtagagcacagcctgggaatatgtatttttctaatgtgtacacactagtttggaagcacagacctaggactgcctcatataattttgcagtactgttaaaatagtatatcacaaagccatcatttattttctcaaaactctaatttttggccgcttcccacaatattctgacccagacacctttacatcatgtggatataatacaacctcctgtgtcccacccttcacctattcattcaaccaatatggaatagctgtctaggatgagctccaggaactaaggtagaaatatcaaaagatacattgttccaggactaaaggagtctttggtttagtcaggagatagcttgagtaataaataaatcagctacagtagaacattgttatttttccaactaacttgcagtgggagcaggtgaaatttgctggaaggtcaggtcacacatcgtggaggaaaagccctttggagccttgacaaaggagatgactgctagatgccaggtgattatatgagaaggcagagagaacatttttgtaaatgcctagtggacagagagcctgataatgtgacaagaactgcatgttctgtcattttaaaatataggccacacatgatagaaatgagggtggacatattaacagaccagatcatgaggggcttgtatatcatgtgtggtggacctttgtatttgacctcataggcatatcttccttgccacatatgtagtttgttttggaacacttcattgatctgtatctttaaaaaaataatttcccctgacaatatgatatgatgaaatttcttcttatgcaataccttagaagagcagaggaagctaggtggtaattttctgtatcccagatggggcctaccttcaaatctcattctctggccctttcatttctgaagccagaagtcagctggttttggggctccgtcctccataaactttatatcctctttgaaagctgacgttctcaaacaggggctacagaatcagcatcaagggaatgatgaccatggttggccctgcatatgatgtctccctgcccttgaccccttaatcagtgactcttaatcctcatagtcaaatagccatggagaacattggccctgagcagtgcattctagagctgacttctcaacacaggtcttcacccctctgcttgcaatcctgacatatgtctcagtgtattttcattcaaactcaaactcttaccaaacccagcatgagtagcctgcctacctccccaacctgatttaatgccactttcttccttgaaccctaagctccttccacattgagctttttcaggttttcagagaaacaaaacttagtcctacctccaggcttgtgcacatgctattccttctacctagagaagttcttcacctccacctccatctaaattgctcttccctgaaaagacattttccagcctctaaacaagcccactcccctgtattttgtgacacgtaatataattttagattgcttgatttgttttgtttactttatttctctattgccagactttccctttaagctccataaaatcaatgacctgggaatgaatggatggatgaatggatggatggatggatggatggatggatggatggatggatggttggagttgaaatatctttgtgaagctgaattcttcacaaagtccaccctctcattctttattcatgctgtagctacactcagccagactcctgggaattgttttctcctccatgaacccaacaaagcttaatccatccctcatactccagcctaagctccattcatttaatgaaacttgtgatctgtcaggttgacactgatttgtccctctcctgacttatatataaagtatatatttactttgttaataacttcattaactttgttaataacttgcattgtttcctgtcgggtaactcaaatttcatctaagttatagtttttaaaaaggctttatttttctcataattaaagcaataaagaaatgcactcagaaaatgtgaggaatattgagtataatgagataaatataaatcctgcataatttctccactgtaagttaaatactatagatactttgccttttccccttctagcggttttattacacattttacaacattgtgtgtacttgtgcatacatttgtaagtatcctgaattttagacataaccatgatctgagcatgccctcgtgtaattgcaaatacttctaaaagcttctttccttgtacgcctaaccataagttctatttttgagaatcaccattgagtgtcaacagagtactagagagtgcactagccactgaggcatatgttatcccactttaaatatttagtgcctactgaatcagaaaatataatataaaggatgtctcccttacttgagtagatatgtttccaggtggctataatattaatacattgcagaagcaagaggtgaaaccctagaataatttgaattaagggcaaacaagaaagaccggatccccaacaaatacacctactttaaatgttgagtgcattgagcacacatatgtctttggtaaatgtgtttctactagacatctagaacaatgaattgggaaaaccttggcagatcactcttctctgaaatcatacctgtgataacaactcatgttttccttcttttctagagtgaccgtctccttatcaagggaggcagaatcgtcaatgatgatcagtccttttatgctgatatttacatggaagatggcttaataaagtatgtatatggaattcttctctttattgttttgcacttcctccttcattaatggctcataaaggaggttggattacatgaatgtagtgaaaaaaatcttaatttaatcaacagaatgaagtgagatactgagggcaaatttgggcagaaagtattgatgagcattctacgggtcatggaaaagtggaagatgtggccatcatccttaaggatactggaaaatgtgcacaaattacagcaccctaaaaatataaggctttgtgcaataggtatcaaaggagttgaagtcgggataagtgatttagaagtacaaagaagaagaaatttatttagaagtaatgctttggggtagagagagtatttaatctgaaccttgacttaaggataggacttagatgggcagagcacagataggacatagatttcatgcaagatttgcaaataaattcattagggatgtataattacattctaaaatgtatactattggatgcctgtaagtggcacagccaggtaagttttatgtgtaggtttcctacatagtgaactttaaaagaagatttgatttacatagtgtttcatcacaaaaaacaaagtacactaccctgcaaagatgttgtaaaagactgggtgtatccaacccattctattagccctgtctggcctcttttagttttatttttatatgacttaacttcattgactagttaaagattttggttacaagagatctcttgcttctctttgaaaaattggcttacatatagttttctgcaggcaaactttttttaccagcccccaagtctaggctagctttcccttctgtgtgctttcaaaacagcttgcggtcggccgggcatggcggctgtaattaagtgcctgtaatcccagcactttgggaggccgaggcggacagatcacttgagctcaggagtatgagatcagcctgggcaacatggtgaaaccctgtctttactaatacaaaaattacccgggtgtgctggtgtatgcctgcagtcccagctactcagggacctgaggcaagggaatcacttgaacccaggaggtagaggttgcagtgagccaagatggcgccactgcactccagcactccaccctgggtgacagagctaggctctgtctcaaaaacaaacaaacaaacaaacaaacaaaaccagcttgtgctttcatcaatcatagcaattctgacactgttagtctcctttgagagtaaggagacttacttactctcatatcttacatatcttgtttattccacatcccaattcttaacccaggacttagcacaaaaaattttgataagagctactttttattgagtgtgtagtatgtgccaggcacaatgttaaatgttttgcatgctttctctcaatcagccagcagccctctgaagtaagtactgtactattattattctgtttcctgagatgaggagaaagcagcacatagagtgtaaataacttgctaaaagttaatgtattagtcaaataacattgaatgaatgagtgagtgaatgaatgaatgaatgaacaaatccaagaaccaaaaatatttgttcatagttaccttgccaatttacattattactttcttatattggaagtaagaaaaatggaaacaatgggaaaaccaaaatatatgacaataatttcttcaaaatataagccacaattgattttatgtttttctattaactaaaaaattattatatatagttggctctattcagaggtagcaagctctctcatttggagagaatgggaaaaatttgttaccaaatgcttcctcatttcagagctcatcataggcagcactaattgttcacagaacttttttattattattattattatactttaagttctgggatacatgtgcagaacgtgcaggtttgttacataggtatacatgtgccatggtggtttgctgcacccatcagcctgtcatctacattaggtatttctcctaatgctatccctcccctttcccccacccccaacaggccctggtgtttgatgttcgcctccccgtgcccatatgttctcattgttcaagtcccacttataagtgtgaacatgcggtgtttggtttcctgttcctgtgttagtttactaagaatgatggtttccagcttcatccatgtccctgcaaaggacatgaactcattctttttttttatggctgcatagtatttcatgatgtatatgtgccacattttccttatccagtctgtcatcaatgggcatttgggttggttctaagtctttgctgttgtgaatagtggtgcaataaacatacgtgtgcatgtgtctttatagtagaatgatttatattcctctgggtatatacccagtaatgggattgctgggccaaatgctatttctggttctagatccctgaggaattgccacactgtcttccacaatggttgaactagtttacactcccaccaacagtgtaaaagcattcctatttctccaaatcctctccagcatctgttgtttcctgacttcttaatgatcgccattctaactggcgtgagatggtatctcattatggttttgatttgcatttctctagtgaccagtaatgatgagctttttttcatatgttttttggccacatgaatgtcttcttttaagaagtgtctgttcatatcctttgcccatttttttgatggggttgtttgtttttttcttgtaaagttgtttaagttccttgtagattctgggtattacccctttgtcagatggatagattgcaaaaattttctcccatgcctgttcactctgatgatagtttcttttgctgtgcagaagctctttagtttaattagatcctgtttgtctattttggcttttgttgccattgcttttggtgttttagtcatgaagtctttgcccatgcctatgccctgagtggtattgcctaggttttcttctagggtttttatggttttacgtcttacatttaagtctttaatccatcttgagttaattttgtacaaggtgtaaggaaggggtccagttcctgttttctgcatatggctagccagttttcccaacaccgtttattcaataggaaatccttttcccgttgcttacttttgtcgggtttgtcaaggatcaaatagttgtagatgtgtggtgttatttctgtggcctctgctctgttccattggtctatgtatctgttttgctaccagtaccatgctgttttggttactgtgaaattatagtgtagtttgaagtcaggtagtatgatgcctccagctttgttctttttacttaggattgtcttggatatacaagctgtttttcagttccatatgaaatttaaagtagttttttctaattctgtgaagaaaatcaatggtagcttgatgggaatagcattgaatctataaattacttggggcaatatggccattttcattatattgattcttcctatctgtgagcatggatttttttcccatttgtttgtgtcttatttccttgagcagtggattatagttctccttgaagaggtccttcacatcccttgtaagttgtattcctaggtattttattctctttgtagtaattgtgaatgggagtttgctcatgatttggctctctatttgtccattactggtgtataggaatgcttgtgatttttgcacattgatttttatcctgagactttgctgaagttgcttatcagcttaaggagtttttgggctgagatgatggggttttctaaatatacaattatgtcatctgcaaacagagactatttgacttcctctcttcctatttgaatacgctttatttctttctcttgtctgatttccctggccagaacttccaatacgatgttgaataggagtggcgctacggccataccaccctgaacatgcctgatcttgtctgatcacagaactttttacaattgagccttaaatacaggtttagaatccatcttcacatggtgcttcagggatctacaaccagggttgaaggtgtaagatgattccttttcgccatttctattagaaagactgaaaggccacttgccaaggatgttgtaggaggaatttaaccatcagatgtgtgtgttggtggtggagagaaggttgagttaaatgatcataattcaatcctgaaattttgtatgtctccaacaacattcttaactcacagagcataagaacagaaataacctcctctaactatcacatagttgtttgtctgtctgtgaatatttgtggaatacttgttatgtgccaggcaattttttgagatattggactcatgctatgtcacacggtatggtactcattatcaaggcccaaatcatcatgctgtcttcccccgggaccttttagtcttttaggggaactgagatatctgtatatatgcaaaggacctagcattaccaaggagtggcatatcaagtattatattcatagaacaggtgagattcagagaagggagtggactgattattaattatagtagctgacatttattgaattcttagttacctaacagtgttttatgggcttaacatatattcacatttaatctgcagcacaaccctatggaggaggcatctttattacattttacagaggaaagaattgaagcatggtaaggtaatttggccaaggttatacagctagtagctagcagagccaggattgtgaatccagatagcccacatccagtctcactcattattagacttggattttgctagaaacttgatgaaggagggaagatggaagctgagccttgagggattaatgcggccttcgttggtggagcagtgacgaagggggaagccatttctatttcaggcttggtattaaactagttgtcaaaatggatgaaaacacacacacaagccaggcaactcttcatgcccttggttctcaattttccttaaaggagaacctgtgagagagaaaaatgagaacagaattggccagtatctgaactagaatggacttaggatcagaggctgcattttaccagtatattttgaattatggtggctctggaatggcccagtggtgatgtggtaaagttgaactcttagagatgtcaggaatactttattttagtcgcagaacttggagtttgagaggccagtggtagacttcttactgccccaagagagtgtctttcttggctgtccgtggataaaaggggaaaatattcatgcaatggacagtgaggtacagatatcccaaggtaggagatttttaatggtcatatagaggcttatgaatcataggtctccctgttatccatagtggacatgtttaaccagctattttaatcaaaaatgtgataccacgtataagccaagcaatactggctgatctataagcagcattgtgtggggactagttgtatttgtcactttccttggaggcttgcctttgagatactcattggcttccttctgcctgagtctcccccctattcctccctaagatgctctgaagcttcctgggcgaagccgtgtctagtggcggttctcataatcactcagctcggctaaaagcttctactgggacactgaccatgtcataaaggcagctggtgctggaggcatctgcatctttgacttcctcctggtgaatctgccatcagctgtgattggctgataaatggtcaggaaagggtggaattgggagtgaagacttaggtgggaaataacccagacagaatcttttgttaggagcaaagatgaccccacttaaaagatagctgagttcccatacctgttctttaaatgatttactattatcttcttcagtctcttctaacagtgcactattttatactctttagattcttctccaaatgttatttctcaccttaacttaaagaacaaaatgaaaggaataataaaaatatttatatgaaaaaagtattacacacactatattctagacactatcagacccctggggttatagtactaaaccaggacacgtggtcccaccgaatggcatatcagatcattctgtgactataaacattgttttctgtgtatatctatctttgtttatagattgctaagcttgtgagtcacttgcaaagtttaatttgataaatacaagtaacactgtttaaaatccttataccactatatttgtcttggaaattgcacttttaaatgaccaagtgtttgatcatttttttgtttgtttgtttcaccagacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcagtaagtcttcatattttacacactcctgtttctcagaagtgtgtgtttaatgaatgtgttatctccagaactctcttactataacttgtatacttgtcccagttcagtttatagatgtgttgcctgatgggacctgagaaaagcagattgagctgaggaaatgggcagctccctgtaactaaagaggagattcatgaggctcttggtcatggcagcacctgccctcttgtctaccttagcagcaggcgctggctcctgcaatgagtggagaataggaaatagcatctctgggctagtaagaggtgaaagtagacttaaaaagttatggatagaagatgaaacattatttcaaaactgcccacttgggtctgagaaaggagggcagagcagcgtgaatggagctaaggagtatcacggagagagggattatggagaattacatttctcggaaattttgtaaacttcagtgggtaaagctgtgtctggtggaggttttcaaaatcgctgagcttggtttaaagcttctactgggacgctggtcatgtcataaaagcaactggcgctggaggcatctgcatctttgacttccacttgcatttagtgcttatggtctgcgctgtattttgaccaattcatatctttaacatttggcaagctgtaggagtggtttctcttgtttttaaattttgttttgttttgttttttctattgcaattccaaaaaaaatctagggagttgcatgccattggattactgaaccaatagcattccagggcagtccttcctgtcccaaaggaatcctgatgaattgggccccatcccagtgctggccccaaacttggtcaggcagagagcactgtttattttaacaccatatacatcccctgagaacacaggacagcctgagctgtagaattattcactgtcttttacttccttttgacaggagcataagcagggttcagcttcagctagttgggtgtggaagcccagaaaaattgcaccaaagccataaaaggtgcaattcagggtgcaattctccagctgaagggtggaagcctgctgacttctcagcagctgcctgctgatgaaagtcctggtgttgccccagacattagtaatgtagctccacgcatttgctttccgataagtgcactcaggctgcttttgatagaagactacgggaatgagtgatcttggcttggctttctgccatctgggcaaggagttggacctgtttggcatccttgagatttgtattatgcttggccatctgcattagggaagtcagattccccgtgacgagagtaaaacttacaaagaaccacaaaagcaattgtgtccttcatagataaattaggaaacctagagatgcaaaaagaaaataaacctcctaatcccacatcgctgttagagtttggctgtatattgtacacatttttaaaatcctatttggccaaactaggatcacagtatatgtattatattttaaccttccatttttgctaaataatatgtcatgggtatctttgcattcatttttgttctaccccaacatttaaagtggattcctagtcatccattttataaagcatttatgtatttaacctaacttctctattgttaacaatttcaattgtttccaatttttcacttagataaataagtagcaaacatccttggaaccaaaattttgtatacagcctcatttatttccctaggaataattcgtaggtgtgggaataaatgttgggttaaggtttgaaaaatgtccgggttttttatgtatatttcagagctgctctctggaaagttgtccttagctgtactttgtccttacttgtactttgcctcagctgttcaggggaactatgaaagtgtaacttttgccttttcttcatcaactgtagatgccattgtttaaaaaaaatgtatccatggttgtgggtgaaagagtagatttgggcctcaaagaaaccagattcttgacaagaagtttccatggaaataagatctgcgggcccagtatcaggtttatgtaactgacaccagctttgtcctatagcagagagcctcaatgtcttatgccctaacttagctttaaacctcgctttcgcccttggaagagagtctgacctttttcactagcagtgacctccccacagtactagtaataatgacacatagtaggcactcattgatggctaacatttattgagcacttaccatgagccaggcattagatgaagtactttacatgcattttcccatttaatcttataaattcagaagaaaggcactagtaacaccctgactcccaccccacttggcaccaacttaaaggaaagaaaactgagatttagggaagctagtaatttgccccaaatcacatagctttgtgacatttaagtgatcagcattcttgaaactatcagggaaccccttcaaaagttaattccatgctcaggaaatagagattctgcagtcacagctaagcaagcaggagcaggcctgggcagaggggagcaaaggctgtgtctgagagtgactcatctggggtctctgtcattcagttgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggtgagcccggacatgccgtcctccctcctctcttagcttcttcttgccagtccttccaacaccatccactcatttcagtcactgtcttttacttggagcctggaaccttgagtgtgagcactggatgtagggataacacaatgttccaggcactttatttacttcttacaggatccccatgagatagtgattgttttccccactttgcagatggagaaactgaggctcagaataagcagcccaagatcatagcattagtaagcagtaggtgtatccaaattctatgctcttcacctccatgcaatattgcccattctgaagaggaagaaactgaggttaggagaggctaactaatcttacataaggttgtatggctagtatgacctatgagattagggatttttaacctgtatcatttttgctgtagagatcaaacccttactatcatataacaatggcatccttagacaaggctaaggcatttctaggagcaaggatgtattggtactcaggctgggagcttagggtgtgaaaacatgttcatgtatatgtatatatgtttctgtgtgtttgccagcgtgtgtcctctcagtgagtacatgatttaggttccactgtcttcttagattcctccattctctgcttctttttgatcaacagatattgcaaacccctcccccccacatacaggcacacatatgcacaatgtgctcagcattgtaaggcggcctgggggtcttagagaagtgtaagtaatggcctttgctgaacacccaaggcaaaagaaaacaggctcatgaagaacaacagaataaatgtcatagtgtgcaagaaccattaccaaaggagtagtctagacacaaatgctaggagtccactggaagagtgtgccctgggatggcagggaaaggatgaccccctcagaggatgatattttctttccatcccctccttaccccacaagccctgcaaaatctttggtgacacagaatgtgagattaactccttctttctgtatttgcgtttatactgggcatctcaaccggcgtagaaaatcgaacggctttaacactcacttctttatcaaagagcctggatcattccatggataatgtagaggcttttgggaagggtagtgtttgggaagactgccctgagttgaaccactctgggtagggaagttctcaaattacaacccagttttggcccagaatactgtgggctgagaaggctctaatggttagagaccaaaattatccccctttcctcaaaatgattctcagttccccagtcccacctatttctgtaaatcactgtattagtagtttatttggggagagatctaaatagatctttacatataaaccttacaacttaagatatttaagcacaaggtaaaacctgcccattagttccctaagggtaggatctgtatcttagttctcctttctgatccaacaccctgcacagtaaaatgaactgatcccaggagatccattaattggaaaccaaatatgtgccaagcctggtgctaagagctctgtatgtattctctcctttaatattcacaaccactttatgaagtagggtattgttatttttccatttaacaggtgaggaaaccgaggtctggagaggttaagtatcccaagctcactgaactagtatgtggtggatttcagtggtgcagcccccagggtatgaacacaactggtgtgctagagtgattcttaatgccacctactactgccttgagcaataacaaagtttattgaccttctgggctaggggatgctggacaggggagtttagaaagaggcacagaagaagagaccattctgctatgacatctgttaggaattgttgattttatggggcaagggtgggcagagcaaaatgctcttgaagaatataaatatctgctttatgttggacaggagcccgggtaatgcagctgggtgctatggtcgatggaagtgggagcaaaggatggaggacagtcatgataatgttgtctttctcttgtttttcctcctgtccctcttttgcaggggttaactccttcatggtttatatggcttataaggatttgtatcaagtatctaacacagaggtaacaacccatttgctatgtggtttggggtatctggatgggtttcctattgttgttgatgaccttggcccttgtaacatgaatcactgtggtcactgtgggagaccactgggccagaatgcttcttgaagcctttgcagtccacgctacattttaaataaggtaacaggcagggtgcccatggcaagacagacagggagctagagtttccactggcagcagctttcttaaacggcaagaggaggaacatgcctaaatttccatctaccaaacaagctccaaacccctcataagcccagtgaaagtgtgaggctcttcgcctgcaggaccaggagggccttctgctgattggaataatcctactgccttgcctctgactctccccctaagaaattcatgacatgcgtttgctttagacagaggctatgttttcagaggaaatacaagaaatgaattcccatgcctcctgcttagaggtgaaggtatgtctgccttcacaggttaagagataagggtttcagtttttgtgtttgtttctggcctggctgtagtggttttctagagcatttgttgagaagaattctgagactgtctctcagctcaatgggaaaataattccattaaaaatgtgtgctagaggcagaggagaggagttggtggtactttattatatatttgctctgccagcctagggaacatggtaggttctttatatagtcagagtttcctgggatttctttggactagcactcctctttggtcatgcctatgtaatatatatttctgccctagtgacttatttcctctgctttatcccatctgttttagcttgggctctggtaattggcccttctgtggggctgctaaaagtgcttgcaagagtgacaaagactcatttctatttcagctctatgagatcttcacctgcctgggagagctgggggccattgctcaagttcatgctgagaatggggatatcattgcccaggtaacaccgtgcagctccctggagcgtgctttgggtctgcattccattttcttcttcatttcttcagtgctgcttgagctctcaatatgtgcaaggcaccatcataagtaccttgctaaagacagaacctgctccaaggtacctcacaatttaggtggaagaaacagaggggaatgtagacaagcaatgaaactagaagatgaggtaaaacagaaagagggctggccattgttggagaatcagaaaaggcatcctggaagaggaggatttcaaattggaacatttaatgggagagcatttgctgattctcttctgaaaatgtgtcaaagctacaagacattctctgtcataaagaaagaccgtaaggcagcatttctcagaagccagagattggatccaagtctgtggaactcatagccttagataatagagaatttaggtctcatgaggagcaaaggtctcactggattcctagaaatcatattgagaaacttgaggaaagagtgacgaaagtgagggccccaaggcccaaattgatcatttgtaaggaagaaggaagcagttatctctccatctcctgggctgcttaatggaatagatggacagatgtgtcttaggaagggttttgtttctcagaaacatctcaagattggcctttgctaggaggagacagcccgaaaaaaaaagagtgagctttcttcatccatttgataatgttggcaacaagaaaccgttattcattccttcaaagagtatttcctgagcactttgtgccaggcagtagctattgaagtgagccaaaacagatgcattccatagctcactaatacttgggctgtgcttttattttagaagttgaccagaacttggtgaatgtggtcagcaggggtgtaggaacaatgtctaggcctcccctcatctcggaccattagtttcctgatagcaggtgccgtttggtgagcactgactactgtgtgccaggaactagtaaattttctggtgtattctcatttaattttcacccaaccctttaaagatgctatcatcctccctattttatacatgagaccatccaggctcagaaagattacgtcactggcccaaggatcacagcaaataactaggaaaacgaaatctttgcccctaaggtgatatacctcagtgggtatctttactcagagatggcatatctgggatcccttgcctcccaagcccagctgcaggcttgtgggcaggcagtaccccagccatgcagggctccagctgttgtgatttcagactctccatgttgtcttgctggtgggggaggtgaggtaagtgtacagtttcctctcaccatgaccaaggaggctaattagtcaggaccctgacagcactttcgcccacttccaccacacacccaaagataatgaaatcattttctttagagagcccaaatgccttggtcccgtgggaggcaacccagtgatattagaactgtactcctccctttatccaagttttcagggcagcagccagaggtcccagccctgctttcagcttccctggaaaccaaactctctggcagttaattctagcccctgaggaggcagatggacttcaatccaaagtctgcgttctcagtttatttcctcttgtgaatccttagagtggaagtttctctggtttcccctcccgctgctatttccctaccttgggaagatctgttctcagtcaggaaaagagtaggggcatttttccatttggatgagtttattgtgtgtgtttattaaattcagcttgagcagaaagatttttatcacattgtttaaatgaaggcagctgctatactcagaatttcttgctgcacttattcaaaagtgagtatatgagagaggaatctttgcctttgggtacaaacaaggatgattttcaagaatttcaagttggcaaaacagtctaagacgacagcatctttagccattcgttcaacaaatatttgttgagcatctactatacgccaagccttggacggggaagatgtaaaagacagggttcctttcctcatggaccaagctacagttgtgtcatgacccaaactgtgatgtaactgtagctgtgatgaatgccacaacaggcccactgctatccccatgtaaggtagcatcagtggggctttactgctgttcttaatctctcagctatagggacatcatggcttcagaataggacttcctagcctgaacagtgcattagaatcaccaaatttttctaattccaggtattctggaattaggaaaagtcagtagcagagttcaggcaagtgtattttgaaaataatcccctggtgatttaaatgtgcttggaagccacctcttgagcttagctttgtcctgtgcattatcctggtgcactcaaacaagacagaagcacaagtgtcacctaagacagagattctttagttggagaccttaacccttgtgtgactggaggcaatttagagtagaaactcactagactttagaagaaatttaattcagttcaagtttcaataagtgagaatggtaagaatgaaaagtggaggtgcttttctggaaaaataagcctgtaacctttctttgttttctgtagagctggagatagtgaccatttcacttctcatggttgcttttagtatgtgcattttcctttctactcctcttttagagatttctattactaaaaacaaaaaacagaacgttcttttccaggtggtaagaatccttacctttctaaatgcctcacagtttcaaagtgagactaggcttgttgcattcaccatttttcctatgtgtctcacacattaccagagtactcccaggtcactaggccaggactgctggtgcagaggttcatagggaccagtcttaataatttcagagtgaatgccagtaacgctgaagaaatggtggcttgggatttctgccagttccaatcagttcatgtgtgtgtgctcactgcccagctacctgcttcttccataaagaggctagaagtctgaggaattttgccatcaaccacaagggacatgcacttcttctgccatgtccacaacttggttaaacagaatttcaccaagacactaacttaggtaatgctgtttggaggcactattttgtttcgttaaattttgaatccattcatttaagccatagatttaaaacatcaaaactcctgagtggcttattaaaatatgcatttctaggattcaacctgacatcttctgatatgttaggctaggatgggtgagaaatctgcatttctacaaaaacaattcaggcaattctgatgtaagtgatgagtggcccacacttcgggaaacatagcactaaattataagccccgtgaggtcaggggctaacattgctttaatgcaggtacttacccagagcctaggaggaagcagttgctcaatacattttgttgagtgaaatggcttaaagagcatgagtgaataaacaaatgagataagcaagtatagtttcagaggcagctgagactgagagagatgaacaataagtgacctggtatgattcttgaagggcagtatagacaaaaaatagtctaacagacaactatctttcttctaataaaaacaaatcacccttgaatgttttttctttttatccttttagttgagtctaccctatattgcaactccaaatataggattaatacatctgttcaacatacgcatatttattctttagatctttagatcagaacataccagcgtaatttttccaaatctcacttgagcttattgaagaactattttcttttttcatttcaggagcaaacccgcatgttggaaatggggataactggcccagaaggccatgtactgagcaggccagaagaggtaagttacaggggatgaaggtgcacacacaacgcatgaataaacattgttaaaaggcgacgagaatgtgagtaccaggttgcagtattggaacatttcttccaaagaccacttctgattgactctaactcaggagcccgtgagaaaattagaaaggaatgtaagagacatgcttatttctgacccctaatctccctacagataacacaagttggagtgtccttcacagctattcaggagtgttaaatttctaatccctttcttaaggaaatctcagtgtgaatctcatagacatttccacttattcccttatttcgagtcctgcaaaatattggcatatagataagatgttgaatgggttttttatatacattatactcatcaatttgtataaggtgatgattatgtccaggtatggaagtttctcatatataaaatgaatgcttatttatgtctgtacttagcagccaaacaacaaatcaaaggtgactagaggctggttccatgtctccgagatgtcagcagcttcacctactggcacggagcacagagctgggaattggctgcccatgtacctgaaagcacattggctttggaagggcagcctgggtctagcacctagagcaaagtcaaggccctccatatcagtgaagcgagtcctgtttctgtcctgtcattccaaaccctacaacagggagaagaaggaatcataaccagaaatgattcccatatcctgtctcttttagagtcttatttaaaatataaatagaacacatatagaaaaaaatgtttctatcctaaggaggcaatgaattttcacaaaccagatacacttagctagtgttacactagttatactagtataactagcacccatagaaggaaacagattatcagcacctcagaaactcctttgtatctagtgatatttttattgccatttaaataatttataattttgtgattagggttccagtcacatacagcatccctgaagtctgtctccttaataatactaggtcacttctatggaatgcattcatctggtatgtgctgattgcatacgttatctcagttctcgctgccgctgctctgtgtggttggcattgttgcgcaggtaaagaagctgaagctcagagaggttaagcccctggctgatcacacttgaaggactggaaaatggtttactcatcgtgaagagaccagggtaatcagcattgtttttgaagtttttcttaaatgctggtcactgtggagatgtgctggcaagacggatttccagcagcagccaggggatttcagagcaaagtctatttttgttccttggtttgttttttcaacctccccttagccttaccaccccaccctcctccttattcctgtctcctttttagtaaaaaagcctctcagccgcaaacctctatagccgtggaaggccatttgggtgaagttggagggtgatgtaaccttccaaagatagtcatgttgtcaaagtgctgaaaaacctgtagtgcttgggaggaatgagatcaaagggaccaggacagaggtcctgggggagctgaagtggtcagcatgggtgtgaagtgggaggagtgatcataggaggagccagcccctgttcaattcaagcatacccagacaccacctcaagtgatgctgttcagagagctgggaccccaggcatagagacagccgctccagagtacaaaattctgggtgcttcaggaaggtgtccatattcacatatgaccaggggcctccaaggtcccatccacatgcaataaagtgcagcttgggggaggccagctcagccagccaagttcttaggtctgtctgctgagctacacccacaatggacagtgactggtttgcattatacagccattgggcatctgcaagctatttttggtattttttttaagtgttgggctccacaggctaaccagaatgtcatatccataaaaaaatgaagtgttgccaattgaatggaagaatgtcaaagtctctgctctgtgctgaattggactaacttacacaagttgagagtagaccacttgagagtaacacagaccctcaactggttagaaaatattatcaacaataatatcagtagccaaccctcaaggggcacttaccttgtttccccattaggaatgagctaactgctttataaggatgaactcatttaatcctcaccacagcccaacatgtcagatcctattatcctcaatttacagacaaggaaactgaggctttgggaggttgtgcaatgtacccgaggtcacctagcttataagtgtcagaaccaggactcagaaccaggccatctgagagagcctcagctctcagaccctgctttgttaataaaataagggaaaacttctaatttcttaataaatgccactgggttggttagcatatttgaaaacatgaattctacattagggtaagatgggagagatcaataataaaacaagtctttgtgttgagaaacctgggaattattttcgtaagaaatgcctcctaaaattaaccctttgctgaccacttactgctgcaggaaaggatttgaggaaccatgatgcctaactgccttggctggttattttagacataatggtttgctattgtgtttgcccagagattctgtcctgagaagattgaggagcaaaggctttcattcagatgtcacctttgtgataaccacagaggctaaggaaaaagtacttaccctctgccagacattgctctcagatgacaatgctgtgctatactattttactagtgagggatagaggcactgggaagctgagtaaagtgacacagttaggaagtggtagatctgagatgtggatataggctatctaattccagatcctgccaaaattatccataacctttgtgcagcactgcatcctcacagttcgtggaggtgggagccaccagtttgagaggttcatgtttctattgactcctggagactttttcttgcagctggaagctgaggctgtgttccgtgccatcaccattgccagccaaaccaattgccctctctacgtcacaaaggtcatgagcaagagtgcagctgacctcatctcacaagccaggaaaaaaggtgatttgtgtttccaagatctcggagcccctgatggcactgtgtggctccttccctctctggttgtcctgtgtaatataaatggtgcctactttgctcattgccttgctccctaggaagccgctctccacatcctgtgtggatgggaggatcctgggatttctcccacttggcatttaagtaaactgaggctcaggaaggttagatgagttgtccaagatgacacagcttgaaccagttcttctgagactttgtgcatcttacttctccccttgatctttgattttcagttcaccttgtctgagttttataaacggacatatcagtcaggattaaattgggtgcaaaattcaaagatcctgctcaaactggcttaaacaaacacaagtgaataaccgattgtaggtgtttcaggtatggctagattgaggggcctcaacaatggtattaggtgtttgtcacgcttactcctttcttggctctctttcctctgtttggtttatgttcagtatgaacagttacagaatagatgctgagaggcccctgttgtcctcaatttttggcagagagcatgatgggaaagtaaaatacaccttttccagcaggtcaagcaaaagtccctaggagcactgtgactggtctggcttgggtcatgtgctcatccctggaccagtaaacaccccggggatgatataatctggccaggattgaggccacagtgcagatgcaggtcacacctcctgagccactgagactaacacaagttattttagagaaggggttgagtgggtctccaaagcatattggccaccatggccttcatgaccctggctgtgtccctgctccctgttgacttctgcttcttttctccactggtgttaacttgggcttcctttgcttgccttgtgcttagctaaagttttcagagctttcttttctgtttctggttctcatcctcagtgtcagactcgtgggctcagttgtgaggctgggtaagggacgagtgcaggtgagaagctgcagatgtgtggctctgtgttgggttgtgagaggatttaccaggcccagtgatgtggttgctactgctgcgtgccagtggccattctggtagtagagaggcccaacatgggtgattcatctaccaaactggcctgtgaaactccacgtgtgagtgattgcagtagctaaaaatagtctcagctgacgctgatggctgagtgttcagatgcctggccttctggcacagggtgaccctatttttcttacaagaggggaggctttcacattgtctagacactcttcctagctgacagattctggggcacctccttccttcctctgttcttcgtaggcctgctgttttctccttagcttttagaagtttcaactgacatggagtggttgctccactgggtatgagtcattgggcgagaaccaggaaagcagcccagtgctcctcactcattcttggagaaaagcaaagaaaagaaaaagaagaagtgtgtaggaactccttctgccctcacccagtgccgcacacacacacccctgccaactgtgaccacccaccgccctcatgccctctgctgaggctgcattctgcccgggacccattcttagggtgacctagggccgctcgggacagggtgttttagttatatgctggtcttattttaaacttcatggacaaaaattcctaaccctgagccttttggcacataattctctggcgagcagaactagtacagctgtgtctccggggtggaatgggggtattatttcagggatgaaaaactggctgctgagattgaagtcagtaaacaactcatggaccgtcattctcagggaaacacccaagagcattctttgcaagacaaagtgtagcagggtttgcacttccctcctgagcaggatatggttgaagtctcagtgtgtttagtcaccaatcatcagggctctttaactatatggctgctcagaattaatattagaaagctacaatttaatgaggaacagctatgtgccctgcactgacataaatactttaatttttttattgtgtagaattctcaaagaactctgagaaataggcatttctcagaaatgccttttttcagatgaaattgcagcacaacttgtccaggatctcccagctgggagagctggtattcaaatctaggtgtaattactatcttagcttcttttactcttccatgctaaacatagtccagagggagatttcttccacttttaagattctatttctttcaatagtagttgagtgcttgctgtgactttcatttcttcatatctttatggtcctgtatcctttagtgtgtaagtatttttggagagcccttgaattctcatcacttggatttttttttactctcacccccaaaagcagggctgtccaatgtgaatcattgccatcgcttccttcttttgcctatggcagacattactaattaatcatgagtcttttctactgagaccccgcgcattattagaatttttcccttcatggaattctaggcaactattaccagttgaatggagttgaaacaaggcaaaatctatttgtgatcctggccatagagtgcaaacttgtggagaatttaactgtggaagttggaggaccaaagttaaagaagtgcagggctgtatagggtagctttggccccagattttggcatagagaaacttggtaccaaccacctagctatgagctagcatttgctttctatatcactattccttcttcttaaagaagctaaacagcttagatcagtgtatattccaatagcctttatcccctctccatggtttgggtagttaggcctctaatttttgaggcagaatccaagaagctagtctcatatttgatgtgtcctaggttattgggtgacttttaccaagtcatcatgttaggagtaacaaacatgataaaaaaaaaagtcataggccgggcgcggtggctcacgcctgtaatcccagcactttgggaggccgaggcgggcggatcacgaggtcaggagatcaagaccatcctggctaacacggtgaaaccccgtctctactaaaaatacaaaaaattagccgggcgtggtggcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaagaaaaaaaaaaaagtcatgagagtctctaatccacaggaatggattttactttgtggaaccaaagcatatcattataatgggagcatctagcaattcccagtggtgggtgcacatttgggactttgggcccctactgtgggaaggcataacaggtaaagaaagcgatatttaccaaacatcctctaggtgccagatgcttcacgtatgccatatcttttcattttcacaagcctaagaagtagacatcatcttgtttcatcaatttcagaatatatctatttcagccttggtatacatggaacccattactagagcaagaactggagcattttagtatttctgaaatgaggatgaatcttgaaatcaatatgtatattttattttcttttgcctcaaattttaatttgcctcaaaatttgagaattaacactgcatctaacaaccaatggcttcttttaatctagagaatacaaacttggtcacatttagcagataggaaagcaggggctttaaaaaggtgggaacatggacttgaacccaggtcagtctgactctgagacacagtcctgggtaggcttaggagctaaattaaataggcttggcccagtgcagcatatactttatgctaaccccttgtctgtttcctgccccttctaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccaggttggtgcaggaatgcccagcagcaggcgttttgtgaaaacatctcttgagtccagctgggggttgaggacaggagcagtcccatctataaacttgaccagagtctgcagtgtgaacagtgtattgggaattcttttacagtcttgagcgtagaaagcaggctcttccccatcctgttttaaacattaatacagtcataatattaataatggtaatagtagttaaaacctattatgtaccaagctctatggtaagactacactcacaatctcatttatttctcctaacaactttatgagtgaggcactcttatcagcatttacatattaagcaactgaaggtcagagaagctaaatcatttgcctaagttcaaatagttggtcatgatgacaatcaaaattatagggagactcctttgttgctgccctctgcagacatataggatcatgacattgctcatttgagtacattttattttgctacaaaagagatgagctaatcccaccccctcactttctagatggggtaactgagcccagggaggggaagaaactcatccaagctcatatatctagtaagagatagaggaggcattccaaacccaaatagtcagagtgcaaaccctcacagtaaacacaagactctaagctcccagtgtgcctccagccatctcccctgttcatgtggagcttttctcctttgccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggtaaggcatggaggtcatgggagggtggccagagccaaaacatccatgggccagatcagaacctcctgccaccagttgggctggtgacactgcgagtgcagatgggatctcgtacttgctgagatgtctctggaaccatgtggctctggcagtgtggaaaatttccttctagtgtgatgaatcctaaggcctagcattctgaaggaggcttccttatctagactgttaggactaggaaccagacatgcaactccttcatctgagtgtacgaatagcctgtacttaaaataatagtgagttaattctttttgtttggatagttttatgacttcttttgaaagaactggatataatcctttgaaatgataagcaatgagtctgtgtctagaccaaagtcatcttgcttatcaaggacgccctgtactgagggcatgtggtcattcaggcgatacaagtgattgtctctaaatgtcttctggcaagtggcctgttttattttccttgttcacatcacaaggactgacgaaagaaatagccattcaaattaagactctttcaaagattttagtaaaatcaataattatctcattattaagttgattactgctctatgtttcatttcaaaaatcctaaaaacattcttatcaaagttatgtatactaaagcctcattaatctacacagtgtaatttcactgagttttctttttcttctttgctcccaggaagctcagagctaggttttaaactcaattctttccgtaaagaggctttttggtttgaaaagagggaaaatataaatattgttgtctgttctctcacatagtgtttcctttttcatatactgcagagcagtacgtatgtatttatcctggcactatttggaatagttccaagataatatatatttttaaattaccaacatgacacatgctcagtaaagaatatttggaaactacagacaagcacacacttgaaagaaaacaaaaatatctcaattccacaacccagggaacccattgttatcatttgggtgaggttcttttgtatttattctatgcatacaacatatgcaaacacaaatacatatctaaaggatgggattataatcacatttgtttttactgtgaactctccataatcctttttgaaattagaagaagaaaatgagtaagtaaatgtaagaacatatagaaaaaaatgcatacttcggggcagtaacttctatcttaaaccatgtgtttgaccattttacctgagtagtcacaacagcccagctaattcgagcttgctgagtgaggttctgtagctcaccagcttttcaggtggctcctttttgtatttctatgcctttgtgggttgtctttctctgagttcagaagccctgaattgatatatatgtagctatagatatagatataatttcttatatttcaataggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgtaaggcccgctctggtgggagtggagtagaatggagaatgcatgcaaggaacttggtcaggagaaatgtgtttatgtggtgtgccagggtagttagactaggacgggttgcaataataatccatcccctaaatctcagtggctcaaaacctcaactgtgtttctcctgctttccaaagcagatgggctctgcccattccagtcactcagggacagaggccaatagaggcttcctctctacatatgttttcatgattgctgagacaggggaacatgacctggtgaatggtctactggctctgaaagcttcccctagacgtggtgtacgtcactgcctctcacatggcactagtcttagccagtcctgtggctatacctaacttccggaagtcagggcgtgcaatgatcctttgtgcctggaaagggaaagaataggaaataactggtaaacagcagtgatgacttcttcacgatgagtttcacatggaggatgataattaaagtgcagtacctaacagaaacgggctcgacactgttgttaaaaatagttaatatttttaagcacttatgtttcaggcactgtgctttgaattcactggatttccatagtagtcttctacaggtagggactattatcctccgttttatagattaaaaattggaggtacagaaaaattaaataatttgtgcagcaagcgaatggtgaagctagcattgaaacccagacaagctgactctaaactgatgttcttaattattggcagtacagtaatgcctcttgctggttgagtaaatgaaggaggtagggagaaatcccatttttggtggcaatggcctttgcttaaatattgtgtcatctcatgttatttaatttggagctagagggacctaaaggccacataacctctctgcccacctgctcaatacaagacagtgatgtacagcatcctggatagttatccagcttctctttgaacactacccaagacaaaagttgacttccacttgaggaccttattaaagaccggacacttctgtttgctaggaagtttagtcttgtcttagtaaatctgtctccggtgccttctacccactggatgcttgcagatgcatggtgagcttttcctggcttacctggtgaatcagcagcaaatgacactgaaggtctcaaggagagaaggtacgttcctctttctcctctttctatacccttactgtggctttgcttctcacccctgcctctaggcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaaggtaaaaagcattggagctctgaggtggtgcaggagctttgtgttccactcacgctcagagatagtaaccatgaacacagggcactgtgatctctagactctcacagagaaattcagtgacagtcttgtccccaagaacaactacacagacttaatgtactattaaagagggtgttgaaaatttttgttcaaagagagctttttttcccaaatgacttttcccacatttttatagtactttattaaaaataatttaaattcgaataattcaaaataaggccagtgtatttttttaaaaaataaatgactcttcaagtctgaaggtgagaaccgagaatccacaccgacacatccctgtgtcattctgtccagtgctgctccacaggggcaaacacttataacattttagctactgtattttcaataaaactttatttctctgattttatatataaacacacacagagatatgtgtgtatatatatatatataggtctatagatacatacatgtgtgcaaatgtatgcatgcgtataaaaaatggaggtgcagagaaattaaatatatatttacaatatatgtattatatttatatatacttaatatataaatatagaataatatataaatatataaataaacatttatatatttatattgtattgtgtattgtattataacaatacaataaatataattaaaaacaaaaatgcgtataaataaatatattcacatatttatatttattgtatttattgtattatactttctatacacacactatatatatatatatatatacacacatatacagatatacgtatatatatgtgtttgtatatatatgtgtattagccctaccctaggattgtggaatttgagctccacactccagtttgggcctaatagagaaggagacttccccaatattgaccctttatttctatgagtgtgatttagattctgaaaccagggaagtgttgatgatgtagagttcttggttttggggagtacagatacagtcatcacatcactagaatcattagcatctgcacatttgatgggctcggcttctgtgctggcatttgagtcactaacagggaaggaggctctgacaggacttcttgtgatgatccatcctgcacggtcaggctcctctggcagcgcgtcctcattgcctcccctctggccaaagttaagaaatgggtggaggttgtgtgccgctgccatgggtggtcttgcagtgtttgtccagttgactgtaagcccctttgcaggaggtaccgtgtttcccatggccaaaggccctagtgcctggcacaaggcctagcagagcatgtgctgggtggaagttgctggctggctccacagtcccagggcaagttcacagccacagacagaggtcagtgggtcagaccacagacactcacttcaaggcctgcccaccctggtgtgtgctgaagagtgtgagggtggagctcccatgtgatcccatcctggccaggacctgcgacctcgtgtcatgacctacccttcctatccctctgctccagctgtactgctgttcttctatttcataatcactcccacttcagctgtctgcccttgctcttctctttgctggcttctctgtcatccacaccactccccggtatccctccaacctcctccctctggcaaccccaaccccatagcaacgtcctttgatccttctgatcgaagctcatctatttagaagggccttcactgaccacatccattgtcactctatcatcacatcctcctttatttattttatactacttctcccttcctcaaattatctttattattgttaattcctagctcccaccacacactgtattcactaatatatttatgatacctagaacagaccctaaaatgctgaatgaatgaatggtgacatgctcttctctggctgcagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggtgagtgggacaggctcatcaaaagataagagaagggggaaggggaagatcaatgttctgaggccacagggtgttcctcagaactcaacctgaaggagttttccagcctagcactggtgtcaactttagggagaaggttactggggcaagcaggaagggtccctgaattgacaaggggtcctggtaagaaagtaagacaaggcagtcaggccgaagaccaggtttaagtggtaactgattctgcctagagatcagccctggttgggggcagggtcggggagctggtcccctctatgaattgatagtgatttccagcattagcctatgagcgctatgcaacatagtatgttttctttatttgtccagattaaaagatagcttaaattatttttatgctcaaattgcagtagcgtcttctaacctaggatttttattatattctcccattcctagtaattataataatgctaacactagctaccactgattgaacatctactatgtgttagccatgtgattagtcttacctattctttacgaactctctgatataattagaaaataatcattcagttgctccataaccagtagtcttaaaatggagaaaaataaatgtagattcgcattcctataatgaataatttaaatgtgaaggaagtaagataacaagaaaagaaagacatttaaaggtaaaattacagcatatgaggaaagggtatggaatgggagaaacagaaacatgggagaaagaggtaagggagacctaggggaagaaagacaaaggaaaagagtttaaagtttggaggtaactttgccagaggtcacattctgctagtcataagcaatttttttcaaagtttttgcctttttttttttgttgttgttgttctctggctaccttaattcttaagcttttagaggctcctttctgaatagacccaagcacacattgaaatttctttttgtgctgttgtcacaaagacctgaccatcactgctttgcactgtgggatcttgggcaagtgacctaacctttcagaacctcagttatctcctctgtaaaacagataagggcacctctctcaaaccatggtggtgaggattaaaggagataatggttaagcacggaaaacattgcctgccacaatgagtgtcacgtctttgtcattgttcttcttcccagtattattatcatgctctgggtcagatgaaatctagataagaacttggcttttcctaccagaggctagttttcggggccataagaaaagtctagaagacctgatagactggaatggaagtttcttgggaggtgaggccagcaaggcacttcatatcttgcactcttaaaattaacccagtttctctcttgcccacatccccctacccgccactctgttttttttttccccctgggaatttatttccaactgtaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaacattgttctccagtcttcttctttgtgtgatgtgcattttcacctataatattaaaattgcccagtagaactgaaagggttagtaagaggggcaggcagatctgctgataacagagttgtctggagaaaaattgggggcttctatttttgaaattgagttgttagttttgaccaccaagcttgatggccattttgaaactttggagaatgagtaagtttttttcttctgtggatcatcaaatttagtattatatgccatttgggataaatctagctaagtccagaacagagccataaagctttttgttttgggttttttttttttttttggtctttcccctaaagccttgctatttgattgttttggaagcattttctgcttctttttaatagcctagacttgaagaaaaactcaaattacacccataccaaagtatattctttatcaaatggatcccaaggagtaaaatcagtgtacggaagcattatttgctatatctgctcttcttagagctttcaggtacatatcggcaacttgaagactctgagaaatcccgtgataaaggtctttcaaagtttgcctaattcagggttctcaagcttttgactactgaacccttctatcccatcccatcttttagcatcccaccaaacctattatactacacccttttgagggaaacactgctgaatccagttgtaatttgttgtgcagatcatattttcattgcaaaagttaaactagtttaccagggggaaattggaaagtggaattttaaagtctggtgcaactataaagttcagtcaggcagactcaagtgtagttggatctaagtgctagaccctgacatcagagcgttgcttctttccacttcggccctgtgtgccttcagtaagtgcttccttcttaggaaagctctttttttattattttatttgagatgagtgtccctctgttgcccaggctggagtgcagtggcaccatctcagctcactacaacctccacttcctgggttgaagcgattctcctgtctcagtctcctgagtagctgggactacaggcacgcgccaccacaacccggctaattttttgtattttcagtagagacagggtttcaccatgttggccaggctggtcttgaactcctgacctcaagtaatccacccgcctcggcctctcaaagtgctgggattacacctggccaggaaagctctttttatgtgggacaaagttggttgtcagcatctccaggttttcatttcacctgcttagtaacctcagaagagggagagagtccctcaatagttcccgctaaaaagactgattcagtctggcttggggcatgtactcatcattgacctagtcactgtggccagaagagcacgtgggaccaattggccacaccggataacatacctggcccctgagccacctgaaccacatggactcccaataactccacaaagaaaatcaatttgtgataactgaagagggatggatgcaaggaaggcaaaaagagccgtggctgtggcaccattcgcaagcttgcagggcatgaatgttttgcctggtgatgtggaagttgggacgggtggggaggagatgggataccaggggatggccatttctgattaattgcttttatatgtgatgaccccctgttggtctgatagaacaatgcccttgatacaggagcatagagtgattataccttttaacacagaagctcagaatcccagtcacaagctactctaagtgcataaagaattaattattttacagttgaagttcgagttttgatgtttaataagctttggtttatagccccattttatggctctaactcaggattggtgaagtgcctctccctgctcatgaccgaggcagcagctgagctctgtttaggatttgagtgggtttaaaggcaatagtcagcacttaaactcaggatgcagcagtctgaaaggcatgaagtggttttcttcttaaatggtg

SEQ ID NO: 11943 - DNA, 16157 bp, Human
agctagagactgccatcccaggagcaacccagatgagcttgggatatggaatgctaactacctgattcaccagcatcctctcttcaacctctccaagtccaccccatccctccagccccgctccaggaggctgccctgcctattctgtctccacggacttctagagagggaggggcccttagtccagcctcctggctcctatctgcctcagtgccttcctcctgtccttagctgttccttaaggaacacctataccagctgctggagagtatgcgagagcatgtcctgaatctggcagccctcactctgcagcgctgcctccgtggcttcttcattaagcggcgattccgctctctgcgccacaagatcatcctgctgcaaagccgggcccgtggctaccttgccaggtgaggcacagaaaaggcaggattcctaggagacctatggtcaggctcgggagaggtcacgcctgaacttaggtggtgagctccctatccctggaggcatgcaagctgagggtggaggcctctgcaggagaatgatcagattctctgtgtctctgcttttgaatgcccttcccagccaaccccaggcccttgtgactggtgggtgggaatccattcagccaagaggggccttaccctgcatttcagggacctgagattataagctgttgggaaataaattattcaggcaggtttaatccaggccttgctacttaatatgctgtgtgaccttggcaaagtcactgcccctctctgagctccagtttccctttgagccaaaggaccccaaaagtgagatgtgggcactggctcccaggccaggctggcaagggcctctctaccttttggtcaccctgtcaccctgtggccccaatccctgacctccccactcccccaacccaggcaacgctatcagcagatgaggaggagtctggtgaagttccggtccctggtacacgcatacgtgagccgccgacgctatctcaaggtataggccctaccctatctgggtccaaggggacagcagagaaggggaaagggcacttagcacccaagaggagactactggcctcaggcagtcttgggttcaaattctgcctctgccacccactagctctttaactttggccattgtctatcctcgattttcccatctaccccttgggattgtggagagggttaaatgagatgttgcattgaaggatttggcctggtgctgggttcacagtggggtcttcgggaattgagggccattagaatttggtgacctgaatgtcactgggtatggttttgctcttaccttcatgtcttgacccactgtcatgcaaactagccaccagaaagacaaatgcagttcccaaagcaatgaagcagtaggtagcctttactgaaggtggcgctacagaggagggcttcccatgacacagtgctcagccacctcccagaaatcctccttgtgtgtctctttccccagcgtttttctccctccgcttgcctctgtttctctcttgctctctccttttccctccccttttctctggccaacctcagcctcccgccccacctgtggagtggggcagtcacctccacacaacaggcaagctgccccccttgcttgagtgtggccgccttgcgtaagctggcctggcctgcctgggtgccggtcgtcacctctgcctgccactccccaacctgacatcttctcttctgaagctgagggcagagtggaggcgccaggtggagggggcgctgctgtgggagcaggaggtgggtgtgggtctgggtggcagcagggccaaggagggaggctggcaggtggggatgtggcaggcctgtccctgtcccatgcactgtccctctaggagctgagcaagcgggaggtagtcgctgtggggcacctggaggtaccggctgagctggctgggctcttgcaagcagtggcaggtgggtcagcaccaggcggggggagggcccaggcagatcagagcaggcaccgcattccctcctctttccacaggcctcgggctggcccaggtgcctcaggtggcccctgtgaggactcctcgactccaggctgagccccgtgtcacactgcccctggacatcaacaactatcctatggccaagtttgtccagtgccacttcaaggtaagggctagctgaagtccaaggctccctggctgataggcgctgaccaattagaatggacattgtccttgccctggggcaggctcctggctgtgccctgtggtgttgggtatgagccttttagttgctggatcatagggaatctgggagatccctgaggtctggatagcagtggagagccctcaggggctcgggcagggctgtttaccaccaaccagtctggaaatatttcagaaattgaacaactggtggagccatagcatgtcagcccagctctgatttcctccccttgagatgaaggtttatcctgtccctaccaccgacttgctgagggccactgtggtggcccctcaccagccctcagtttccccatccatacactgaggaccaaagcccctgcctcataggccttggagccccatgtggcacagagcagtgggtccagatgtgcctgtcagtcccagctctgtctgctcatgtgcctgccctgtgtcttaggaacctgcctttgggatgctgacagtgcccctgaggacacccctcacgcagctgccagccgagcaccatgcagaagccgtgagcatcttcaagctggtatggggtctgccccagcccaccttctaattcttagcccctggccctgaaactgggccatgaggctcccagtcttcccagccctccccaagcccaacccatgagccccacacctcttccccaaaggacagacttttatgtcagagggggaaatctggcttcctctctgaggactggtggcttttcttctcccagccatcttcctggcaaaaaaaaaaaaaaaaaaaattctgccttggagcctctcaaggacaccaagaagagacccagatctccttaaggacttctcagtctgaagggggaggcagagttgacccagccagtgaccaccagtatggacagagggaagcaccaagtctggggagtctgatggggccactaattcagccctgggcagggccagagagggcttcctggaggagaaggcatttgagctggaggggaatttgccaggcagggagagtggagaaagtacacagagaagaggaaattggtgtggtcagaacagagtcaagagggcaagggtgagactggccagtgaggccttgattacagtacccagagcttagatttcatcccaaggcacctagggagccaaggcaggtgcttccatgggagggttgtggtcatatctgaatgttaaaaagaaccctctgcggcctagatagagcaggaggtgggggctggctggagggccaggggcgcagggagggggctagggctgcatggggagctctagaaggttcatgaacaggaaagatgacacatactttggatctttagttttcccatagttgaggtaaactgcctggtcattcggcatagaatatggcagttgtaggccaagcacggtggcgcacacttgtaatcccagcactttgggaggccaaggcaggcagatcccttgagtccaggagtttgagaccagcctgggcaacatggtgaaacgctgtctctactaaaaatacaaaaattagctgggtgtggctgcatgtgcctgtaatcctagctacctgaggggctgaggtgggaggatcacttaggcccggggaagttgaggctgcagtgagctgagatcccaccactgcactccagtctgggtgacagagactccatctcaaaaaaatattctatatatatagcagttatattgtaatataagggacatttatatgggcaggggcacacatgggagggacatgagagggatgcatgttgtggggtggggactggaaggaacaactttctgagatgcccaggagactctgttcgtggcccagatcctgcgcttcatgggcgacccccacctgcatggtgcccgggagaacatcttcgggaactacatcgtgcagaaggggctggcggtgcctgagctgcgggatgagatcctggcacagctggccaatcaggtgtggcacaatcacaatgcccacaatgctgagcggggctggctgctgctggccgcctgcctcagtggctttgcaccttccccgtgcttcaacaagtaccttctcaagtgagtgggactggataggggctgggacacgagggacggtggcaccagcagtggagcccaaggcagggtcttaaaggtcaggccaggagtcagatctctatgctgggaagctcaggcatggaggctggccagggctgctctgcatttctactgggctcagagcaagaaaggagggcaggccttcactgcaggggctaggagttaggtcagactggatgagggacttccagaactcagagtgggacaagaccagcatgtggagaatttggaaaagagcattgacctctcacagcatgagagtttaatggggtggttaggagcatggatacgggactcagacaatcagggttcaaatcccagctcagccatatatgagctgtgtgaccttgggtaagttacttaacctctctgggctttagtttccttacatatcaaatgggggttattcttttatagtttataagtgtgatgattgagttttcatgctcaggcatgagatgtgtcaccctcaaaccttgctaaaacatcagcacaagaccagacgcagtggctcaggcctgtaatcccagcactttgggaggccaagatgggaggatcgcttgagcccaggagttgaagaccagcctggacaatgtattgagaccttgtctctgcaaaaaatttaaaaattagctaggcatagtggcacacgcatgtagtcccagctactcaagaggttgaggcaagagcattgcttgaacccaggaggttgaggatgcagtgagccaagatcatgccacttacacttcagcctgggcaacagagcaagaccctgtctgatgttaaaaaaaaatggcataatgataatacctacttcataggctcttgtgtggataaaatatataaacacacgtaaagtgcttagaacagagaggggcacatggtaggtgctatgtgggtataaccatcacaatgatgtcaccctgctgggtgagaaggatgatttgcaaggaaatcgctcaggcaggccctgggtgtgaatctcagctctgatacttacctgctgtgtggcctgagacaagtcactgtccctctctgaacctgtttcttccctataatttggggatggcaacagaacccacctaacagggtggctgtgagttagagtatacagaatcttgcttaggccagcatgcagcaaatggacatcacctggccagtcttgtgactctgtggcagctgacagcagggtaaggccgttgctggtctgcctgcctggggctttcctgagggcatggtgctaggttccctctctagctactgtgggcctgcaccagtgctgctcttggccaggcttagctgcaggagatgtaggatgtgggggtgagggaagcatgaggaatggctggtagggattgggctcattgggcctgggttgagttgaaccctcagctgtcccttttataggtgaaaacttggaggagaggttcagagagggcagataatcatccaaggttgccctgtgagagaatggagacagagttctggttgttgcccacacccagctgcagaccccagcctgtcaatgacattttgttccaacaagctggtacctctttggcctatccttggacctctgggctggcctgagatacttctggactagcctgggaccctttcagtttagccgtgggactctaaactaccctgagatcttttgtaggctagcctgggaccccttaagtgcagtcccagagcactggactctagcctgggacccttgtgaaccagcctggagcctttttagcctcaccttggagctctggagtagcctgggcctttctcagactagcctcagaatttcctacccccaccccgcagccctcagccccaagctagcttcagatccttcttgatcctggctccaactcctacccatcaggtttgtgtctgattatgggcggaatggcttccaggctgtgtgtcagcaccgcctcatgcaggccatgggccgggcccaacagcagggctcgggggctgcccgcaccttacccccgacccagctcgagtggacagcgacctatgagaaggccagcatggcgctggacgtgggctgcttcaatggtaagctgccttcccccacctcagtgagggcagtgggagtcagcagggcccagtgagccccggggatggcagaagccactggatgttctggagctggggaggggccttctcagatgtggctctgcgtgaaagtctgtgtgtgggggtgggacctggcccaggaaaggggagccagggaagtgaggctacagatacaggaagcctgaaaggaagaagcaagcagggaggcacagccaaactggactcagatgctccaacctgagcccggcacctgctgcgccccaggtgaccagttctcctgcccggtgcactcctggagtacgggggaagaggtggctggagacattctgaggcacaggttggctcctaggatgccctcccagcacactcttatgtacctggaatgttgtggggggaggtcagatcccccagagggtcccatagggtccactctgttcatgtttagggtctggcttataacccaggatctccccaggtagtgcctgatgactctgtccctcatttccattcctgtgcatgccatcaccagggggctggcagatggctggcgcggctggaccgtggccatgaagaatggtgtccagtgggcagagctggctggccacgactacgtgttagacctggtgtcggacctggagctgctcagggacttccctcgacagaagtcctacttcattgtgggcacagaggggcctgcagccagcaggggaggccccaaagtgtaggtagctatgggggaccccctcacagatggccactcccaggcagaaggccggccactcccaggcagaaggcctgcccctcccagctgctgggacaggctgagccctgaacttagacttcaggttcttaaggaggtagagttcaccaaaggatcctgcttttaaatggagaaagccactgaataccagggtgcagaagaaaatttgggggattctgggatctctctgggggtcagtagctccatgttccttttctccacagggtgtttgggaacagctgggactcggatgaggacatgtccactagaccccagccccaggagcacatgcccaaagtacttgactctgatgggtacagcagccacaatcaggacggtacaaatggggagactgaggcccaaagagggacagcaacccaccaaggtcaaccaacaatggctgctgtctctggtggggagggagccttagaggctgtgtggggtggaaatcatcaagaaaaaagaacttgacatttttgtgccttcccctccagagtcagacagtcttggagagcctgctgtgccccacaaggggctggactgctacctggatagcctcttcgaccctgtgctgtcctacggggatgcggtagggatggtgtggggtgggtcatttgcagacagcaggcacagcatgtacacccaagtcacacacttgtacagggtgacctgagagcttctcacagccagggtcatggggtggtgtgtcccatctggatgtctgctggaggctggacaaaggatgagggtctcttcacagctagagatgctcttggctgatcctggaaggacccacagttagaagtgcacctctagcaaggtgtggtggcatgcctctgtagtcccaactacttaggaggctgagatgggaggatcacttgagcccaggagtctgaggctgcagtgagctgtgattgcaccactgtgctccagcctgggcaacaacaagaccctgtctcaaaaaaaaaaaaaaaaaaaaagaaagggaagaagtgcacctttggtggcagccagccccccggggccactaaaatatctctatctggatggagttgaatgaccttggtccccgggtcttctagccccagatctcacgagacccctcaggtacccttactcactctggaaactccagaacccaccccacccccactgcccctggcatgatatgcagccctgagcagggcacaacccctccttgagcctcagtttactcctctggggaagaggggatgggttgggagctcatatggttatggatacgactgattgggatgccataggggtaaaggctgagcatacagcagacactgagccagtgggaggctgccccctcccacgagagggtggggaagaggccagtgtcaggtgcctgttgccatggaaccttgggagtacaataatgagatggtcacttgagccacccactgcccccaggacctggagaagccaacagccattgcctaccgcatgaaagggggaggccagcccggtggaggcagcagtagtggtactgaagacacccccaggagacccccagagccaaagccaagtcagtgcctccccagggtggttccagggttgggcagggccagagccacttgctggtgtgctagaatggaggcagccacagcatgatgggggctgagaggacagggaggagggcatctccggtgccatctgtgccttctgccccctcccctcagtcccaggcctggatgcctccacattggctctgcagcaagccttcatccacaaacaggccgtgctgctggtgagtgagggagggactgctggggggtggagaatggacctgcctggtcaccactgccacctctccccaggcccgggagatgaccctgcaggccacggcactccagcagcagcccctgagtgctgccctgagatccttgcccgcagaggtgagcctggcctgcccagggtgcaggggttgcttggagacacaagctgtaaagaggaatgctgtgctgctccagggcactattgtgcctctttgagcccaggagctccacaacccatctctgacagagatctggagtcccagagagcagcctggtatatcccaggcagcccaccctcacgtcctgttctccacagaaacccccagcaccagaggcacagccgacgtctgtaggcaccggtccccctgccaaacccgtgctcctgcgtgccactccaaagcccttggccccagcccctctggccaaggctccaaggctccccatcaagcctgtggctgcccctgttctagctcaggatcaggcttctccagaaaccagtgagtgccctatcccagcctctggggcttcccaggacaggcctggtggtgtggttgtgccccttgtggcctcaccctgttcccaccgcgccccttgcccacagcttcaccctccccagagctggtccggtactctacgctcaactctgagcacttcccacagcccacacagcagatcaagaatattgtcaggcagtaccagcagccgttccggggaggccggcctgaggccctcaggtcagcactgcccctgcccccagccctccagccccctcactgtacctgagtgtccatcatggcccaccagcttaccgggttgaagcgccctgcccagctcctgttagggagggagtttctttatactgatgagtccagatgaggccctgctgttgtctaggttgtgctgtaggacttcaggccagtctctgcttctccctggattctcatttataatgatagggggtggtggaggaggaggaagtttcctactgtcaaactatgtgatgggaaagggagactcagtgtcaacccaccacagtactccaatgcccacaggaaggatggcgggaaagtgttcatgaagcggccagaccctcatgaggaggccctgatgatcctgaaaggacagatgacccacctggcagctgcacctggcacccaggtgaggggggaaggtggggctgagcccaggtggaacagaagacaaagaggggcctcagggatcctcagaaaccagctacccctataagctgtggccctgccactgcccctccacagggcctgcctgttgccccctgagcagtctctttggggtgggacaggtgtccagagaggccgtggccctggtgaagccggtgaccagtgcaccaaggccatccatggcacccacttcaggtgagagggccaggagggagggaggggagggtgtccaagtatatgaggaagtctgtgggcacaggtgagtgtgtcggtggagtgtgtgtgtctatgtccctgagcccctgtgtacatcttgtgagcacattggtgtaattataatgtcaatacttaagtagcacagatctcaggccaggcccatcctggcctcatgtaatcctaccagaacccttcaaggtagcactgttgttcctacatgttgcagatggggaaatggaggcacagataggttaactggcttgcctaaggtcacacagctcaaaagtgtcagaccagggatatcagctcaggcctcctggcatcacagttgaagccctaacctctacaccctttgtctctcagcagctgcagtgatcttaacagctataaagcagttcccatcctgcccctgataaaaaccctctgatggctcctacaataagctccaaactcctcaccgtggcctatgagacgcgacatgatgtgcccacctccccagcctcatctcctctcttcctccccttggcacattctgttcctctctgttctcggaacactccaagcccactcctgccttgcatgttccctgtgcctagaatgctcttccccaagacctttgcatgcctggctccttctcaccattcatgtcacagctcaaatgtcacctctgtcacctcggcaaggtctgcctagattgctaggagtgaaggacctcacagaccagctctccaggatccatcctaaaccaccctgctttactgccaccccagcctcgggcagtgagagctttgtttctgaatgatctgtgccacccacacctgccatgggcactaaactccagggcaggggcattgtttaccttatttgcggggccatctcagcctttagcccaggcctgtatacaataggtgttttggctgggtgtagtggctcacgcctgtaatcccagcactttgggagtccgaggcgggcggatcacaaggtcaagagatcaagaccatcctggccaatatggtgaaaccccttctctgctaaaaacacaaaaattagctgggcgtggtggtgggcacatccaataggtgtttttatgtgttgaatgaaaggctgggtcatatgtgacccttgtgagcagctgtttccgtggactgctcctgggtcccctcctccacccgccctgcctctcccatttcatcctaggaggtgcctgtggccgggcgcagtagctcatgcctgtaatcccagcactttgggaggccgaggcgggcggaccacctgaggtcaggaatttgagactagccggcccaacatggcgaaaccccatctctactaaacatacaaaaaattagccaggcgtcgtggcgggcgcctgtaatcccagctactcaggaggctgaggcaggagaatcgcttgaacccaggaggcggagcttgcagtgggccgagattgcgccactgcactctagcctgggggacaacagcgaaactccgtctcaaaaatatatatatatattaattaaataaaaaaacgaggtgccttctcctgactccctgatccccgcgctctccagctctgccctcgcgatcgctggagccccctgaggaactcacgcagacgcggctgcaccgcctcatcaatcccaacttcttcggctatcaggacgccccctggaagatcttcctgcgcaaagaggtgccgagcacagccgtagccaggggaggggctgaagcggggcaggggaggggctgaagcgggcagaggagggtctaggacttggggagggagcccaggaggacagaaaaaggccgggctgaaaccaggggtggggttacagccggggcggaactgcatttagggggcggggccgggtgtgaagcaaggccagggggcagtcggacagtacccactgaagccccgcccctgcaggtgttttaccccaaggacagctacagccatcctgtgcagcttgacctcctgttccggcaggtgaggtcctgtctcccctttctgcctcagtgaactcagcagggctgtgtggacgcaaagatgagctagctgcaaagcctgcctctgcatgttgggatttggggtccttgacaggggtgaggatgggcagctgttttattgaatctccccctcccatgggcagggtcagtgagcccacagttcaacccaatcagagccatagtctgtctgagctagacatggcccagagatcaaatgtaaaccctgtaaacccccctatatagagtaggaaacggtggcctaggaagggtggcctggattgtggggctgaggagaaaggagagggccctgtaagtgggatctgatttacacagatgacccagcttacagatgaccccactgctgcaaaatgggacccctcccacattgccactcaccctagtatagtccagcctgggtcccagctgggggagtcccatgtgctgcctgcatcacagcctgttcccacagatcctgcacgacacgctctccgaggcctgccttcgcatctctgaggatgagaggctcaggatgaaggccttgtttggtatctcgggggagaggaggggtactgatggggcaaccagtcagaggcacagccagccctgtcccagagggagactgaggctgacaagcccaggcccaccatctcccagacatgtgcctccttgctctgcttctctggcctctcgcatggccgggctgcatgtttggggttggcaatgcctgacacactgtgtgtcctggccatctcatccatttctgggtttcagttttctagtatagacactggtcagataccttcttgctgggtatcagccacctccctccctgacatccccgagatgggggttgccaggggagtggggagagggtcctgaccagacctggcctcccatagcccagaaccagctggacacacagaagcctctggtaacggaaagcgtgaagcgggccgtggtcagcactgcacgagacacctgggaggtctacttctctcgcatcttccccgccacggtgcgagcccctcacttgccccctacctgtccagaggattcagggatgagacaagaggatcctcacacgcccttcatctctgccccagggcagcgtgggcactggtgtgcagctcctagctgtgtcccacgtgggcatcaaactcctgaggatggtcaagggtggccaggaggccggcgggcagctgcgggtcctgcgtgcatacaggtgaccagcaggggtgaagtggggctggctggagactgggatacagactggcatcggcatttccttcccctccacagccacttaccaagtacccatgatgcgccaggctctgtgccaagccattgaagcaaacccattttagagctggggaaactgaggctcagagagagaagttgtttgtctcaggtcacacagccaggaagggattgagctaggcacccactcccctgccctccccccaacctgcacagcagcagcactgtgcagaggggcagctgtgctggaaatgaccaaatcctgatgcagctggggagggaaccactgccagcagtgacaccttactgagtactcagactccctcccctgctagaagtcccttttgtcctttttaacacgaggatgggaatggaaccttgctaactggttaggtaaaacctgcatgctttgaaagatggagagaatttggtcaatgggtgaaagagagatttgggtaggtgcaaatctagatttagagcttggaccaagggacaaagggtggagaggggccggagtgtcagcccaaagggtggtaggaactgagctgaagccacagcctgggtcagagaggggaagcaggaagcttagggttctgtgggagctggcacaatggggccaaggtggggctgggcttcaaatggggcaggacaggatcagaagcagcacaataggtggaaggagggcatccctctggcaggggagtcatgccactggcccatcctccagctttgcagatatcctgtttgtgaccatgccctcccagaacatgctggagttcaacctggccagtgagaaggtcatcctcttctcagcccgagcgcaccaggtcaagaccctggtagatgacttcatcttggagctgaagaaggtcaggatcttctcacagatcttccctccacccaggctgagggccagcaacagggatctccctgttccagggaaatatgactgtgtccatagatttctgtctaccttaaggcctttgcactggctgtgccttccacttggaataccctttctcccttttgcctgctccttcagaaaacctttgccagtgccccctgccgggtggcacagcacctcctctgaggtctgcagcaattgtactccttaccctcctgccttggctgcatggcccgcccactgcatcacaatctctttccatcccctctgcccactcctgactggcagcccccaggcctagggcaggtcatctctgtgccccaggcccgaggaagacttcagcaggaaagtctgtgagggattgagtggggaaggcctatgtgtgtgccctaaagtccatctgtgtccctcagactcaccctccagccctttcttccacccagaatgcccttccctcttctcacctaatgaaggctcccttccctgatgagtcaggaaggatgtgaggagcaggggtggccctaggcctctgggagtggggtgatagggctgttgccctcaccctgcctctggctgacccaggactctgactacgtggtcgctgtgaggaacttcctgcctgaggaccctgcgctgctggctttccacaagggtgacatcatacacctgcagcccctagagccacctcgagtgggtcagtgccactggggtgggctgggggcaggagggggaggctggccaagggggcctccctggcagatgctgacccgagcctggcccataggctacagtgctggctgcgtggttcgcaggaaggtggtgtacctggaggagctgcgacgtagaggccccgactttggtgtgtgccccagaacctggaaccccatacggggcgcatcctagtttcacccactcgtggtgcagatgcacagtgagggtttcttggtgcccgaaagtggcctgggctggtcaggtctcctaaggtccagccgtggcctgtcagtatctgttggtggccagacagcccagccctctgctttgcctgaggggtctccgtgggcatttccatgtttgtggcctgaatctctctttatgtctccacatgacctgagagtccacaaaccctgctttgcctttttgcttcacttcccctttatggtcctgtggccctgagaaaatccctttctttccctgagcctgtttcctcatctgtaaaatgggtttgatggcctggcctgcctcatagagttccagagaagggttaagaatgttcccaaatctccctaaaggacccccttagtcacaagacaagaccctcctgtttgcctcagaccttttacccacccctaggctggaggttcgggaccatccacgggcgcgtgggccgcttcccttcggagctggtgcagcccgctgctgcccccgacttcctgcagctgccaacggagccaggccgcggccgagcagccgccgtggccgctgctgtggcctctgcagccgctgcacaggaggtgggccgcaggagagaggtgagaccagtgtgggtggggtggggcggggtagaccagggggaaggggccgctgcagaaggggtgaggcgagtggggataaggtgggccaagggcctggcc

SEQ ID NO: 11944 - DNA, 44653 bp, Human
cccccaaaaaacaatgtatgtatttcaaatcaggccatgatttttgattagcagtggtcttcaagcttgattgagcattggcattatttgggtaatttttctacccccaaagttttgtcagcaacatctcactatggtagtgaaaaaataaccttcctgttttaatttacttttcttgactgttactgagattgagaaatcttcctcttctgttttattgaccactgacatttcctcttctatgaactgcctgtttaatggtgtttgctcatttgtactcatctttttcttttcttttcttttcttttttgagatgtagtctcgctctgttgcccaggctggagtgcaatggcacaatcttggctcactgcaacctccgcctcctaggttcaagtgattctcctacctcagcctcctgagtagctgggactacaggcatgtgctaccatactcggctaatttttgtactgttagtagagacggggtttcacatgttggccaggctggtctcaaactcctaacctcaggtgatccacctgtctctgcctcccaaagtgctgggattacaggtgtgagccactgcactcagctagttttacatttttaaaaatagatatcattttccttatttttaggaagttgagtggcttatgtatttagtcccttatcttgattcagtctatctaggtcattttacaaaatcctgattcagtctaaccacgtcatttaaacaaatatttagctcctctttgccaaatgatttggacccctgaaataacgatataagaatttcaggccaggtgcggtggctcatgcctgtaatcccagcactttggaaggccgaggtgggtggatctcatgaggtcaagagttcgagaccagcctggccaacatggtgaaaccccatctctactaaaaaaaaaaatacaaaaattaatctggcatggtggcaggcgcctttaagcccacctactcgggaagctgaggcaggagaatcccttgaacctgggaggcggaggtttcagtgtgctgagatcacgacattgcactctagcctgggaaacagagcaaaaactcccgtctcaaaaaaaaaaaaaaaaatttaaaaaatagttgtaaaattacctagtctaggataggcactgagttaggaccttcatatctgttattccttttattttcagaaaaatttgaaaggtatcaccctagttttacagaagagtgaactttggtcagaaacattaagtaacttactcaaggtccctcataaacagcagggttgcgcttggaatcctgatctgtctctaacttctcatttgcagataaagaaactgaggccaaagtacacaactaatttgccagcgtaacaggtaattaggagccacacagctccctttcacattttctttctattatttcatggttagaagttacataatttccactgatattaatacgtaaccatttttttgttgttgtcgttttgttagtattgtgtgtgagatcgaggtgggtgggcagatgagttaaatattattaatccaatttaaaatagattccagatatacacagcctttagctgacgagaatatcatccctataatctgataaagctcaagtgacatcatcctggctagtataaactttaacatttttaatgcgaatagtctatgaaaaccacagatttcttaatcaagctcatttttgtgtttccaactctgccttttcagcctgcaaacaaaatgctcttcccccacacccactgctgttttctacttttcttatgattaaaaaaaatatttcccttggtaaccattttccctggttactttcttggctgattttctgcacaaagaactgaaaggcatttatccccaagggaggcagttattttagattttactaagaagttcagcaaatacttttcaacattcccttctgtcctttctttgtttttaaagaaagctctgattttgtttcattttcagctggagacttaaatgacaccaagcaaagcctacttagtttagatctccaggtaaaaaagttttaaattttaagtttctacttagcatgtggaatggttttaatatttgggtattttatttcacaactgtttaactcttgagtaaattagctcgttactaatagatttttaaagttcaaagtatgcattattctgtttgtttttttcacgatgtacttcccaagtatttcagaccttgtatacttagtattaaattatttttatatgtttaggtggaattatgtgttcaatagaagtataaattggtttgaaaatattattaatttttaagtcctaaaagaacataaataattcaaaatatttttcattttaaatctgttgaatgaagtgaaaatagataatagacatctcatgacttcatgtagaattttaaaattctaaattaatatttttaaagtttacttaagataactggtaagaaattttaaatgaagaaaaataagttaatcaaggtttataaataatatttaatgttgggataaacacagtaagtgctagaaggaaaaaaattacttgataaaaatgatactatgattggaatcccagaaaatttacctctaggaggcaaacactcaattacgaagttgtttatgaaagcaaatattaagtgcaaagcaaaattctgtatatcaatgaaaataatgagggcctaagcattaatagtaaaattagtattgagagaccatttcctaaaatgtatttaaacactgtagtgagactgtttagatactgattttgtcaaaattcaaatagctctgtaagtttatttctgtgcctatctatttagatttctgggtaagtaaaagtgagtcaatttgggggaaaaaaagaaagagaggtagtttccagaatgaggatactgggagagaggggtgtgctcagaatggccacagctggcacattcacactcctaagcactcaatcaggcaatgccccataagtgagtgctttcaggatgcctcaggacagcaggatgcctgagaccctcatgagagtttaactctagagcctcgaggtctaggccctgactcctcacaacaggatggaaggtctgcacatacaattgttaatgcaagaaaatttcaatgtatacatttcatgcattgcagagcacttatgatatccatcggagcacacttgccatgccactcagcaaattctagtttcactttgtctctcagttcaggttttcatattgctttcccctgctgttgttgttattcccttccaacatactactttgctctctgaattgacttttatgatttcaggtgccaatcagctaatggatttggtccttctttacatgctgcatgttaatttttctaaaactaaagtagattgcaaaaagttgttcaaaaagttgttccagtaacctatgaaatataggtcatttcaataacctatagtaatggttttcaaatgactgtggcaattaatgtatatatacgctgaagaaaggtttgtatgctggcatgaagatactttagagactgccgtttgttgaacaaaggtgatgtggcaagtcagactatgaactaactaagtgaaacctgactagaggaagatgattctggcagatgaagttataaaaagaagtactgagattcaagaggggaaactgagctgaccttgtgccctcttcccctctcaccaactcccttgaaataatacaagatatattacagacaaataaatgcacgaatatacagctacactaggaaataaaaaggggagctcctggtgggacagacactctgaggagtccttcacagacaaagagaagacagaaatgaatttaaagaggaaaaatgtacccttgaacagtcatgggagaaaacagagtgaagagagcttgtataggaaaaaaagaagtttttagtttaaaagatcccaagaaggatacattaaacagcaaaaacaacctataccaaggtacattccattcttttaccaaggtaaaacttccaaatatcaaagatatgttgaaaatttgaaaaaaatttctatagaaagaaaaaaaatttcttacaaagggatgagaatcagattcaagtcaaatttctcatcagcaacactaaatataagaaataatggacaaatatctataaggtattaaagaaaaatgattagaatgattttgaaaccgtaattctgtttccaattaaacaatgacattttcagatctttaataagagcacagaattttacaacttacaacattctctgagaaaaagaggatatatttctgcaagaaataaaaggaatctgagggagcttctccttctgataatggcagacaaggcaagtcagatcattagacctgctgagaataactagaaagggtgagaaaaacaacagggccaatatttgggatgggactgaaacccagagaggtttagaacagtttttcttctagaagcatctggattccagaagaggtggttgagaagattaatagagttttaaaacagcctcaggaggacagagagaaacaaacaaacaaacaaaatggaggcaagcaagcagtgggggatggtaggaaaagtgaagtggacccaaagcatatatatatatatatatatatatatatattttttttttttttttttttttttttgtttgagaccgagtctcactctatcgcccaggctggggtgcagtggtgtgatctcggctcactgcaacctccacctcccgggttcaagtgattctcctgcctcagcttcctgagtatctgggactacacgcgcgtgccaccacacccagctaattttttttgtatttttaatagagacggggtttcaccatattggccaggctggtctcaaactcctgaccttgtgatccgctagccttggcctcccaaagtgctgtcattacagacttgagccaccgcacccagcccaaagcataattattaattcgatatggtgaagcccagcttcaaatcactcaatattctattcataatgtacttaaccttatgcctgaaacagacgcaaattctcaagtattttcatatacaatatctggcactccatcaaaggtcatcaggtatatgaagagacaaaacatggctaaaaacctaaagaaataagagacaaccgaaatagacacatagaggatccagaaaacctagtcttcagacacagactttaaaacaaatatttttaatatgtttaaaaaaataaaagatgagattaaaatttttaacaaagaattggaaacaaaaagaacatactgaaaacctgaaaactagaaaatacaataaaagaacaaggaagtcaatggatagatttaatagcagataaatcacagatgaagagagtatcaatgaactggaagatcagttcagagaataaccaggatgaatcactgaagagatagacaaacaaaaaatacaaatgaggggaaagtgacattaaagacacaatgagaaagctgatatgcaagtacctgtagttatagaaagaatgaaaaaagggaaaagagaatgtactatttgtatagttaagggctgagaagtttccaaatgtgatgaataacatcaggccacaaattcaagaagtgccaaataggataaaaacaagaaaattatatctttgtatacagagtgaaacagctgaaaaccaaagacaatgagaacatcttaaaaacagtgagagaaaaaaaattacttttaaaagtgaaaaaattagattgagagatgatttctcaaaacaaacaatggaaaaaagaagacatagaaattgtatcttcgagccgggtgtggtagttcgtgcctgtagtcccagctactcgaaaggttgagtcaggtggatcgctttagcctagggattcaaggccagcccaggcaacatagtgagacctcatctcaaaaaaaaaataaaataaaaaaaaaaaaacattaaataaaaaaagaaaaagaaaagtaggtgggaagaaggcaacaataaaatactggaagctaggaaggaaatgaaagtgtagggggaaaaaatcaaccgtatcttcacaatgctgaaagaaaacacttgtcaaccccagaatgtatatctaacaaatacatcctttcaggtaaacaaaaataactgatcaacacatctgcacaaaaggaattattagaaggtgatcttcagtcaagaagaaaataatcctaatagaagaaagtagatataggaaggaacgaaggaaaatgataaatgtttaggtaaacctaaacaagtggttctcaattgaggggcgggttacatttggtaatgcctggaaacattctttggttgtcacaactaggaggaaggtactaatggcatctagtgggtagaggccacggattgctgataaatagcctataatatacagggcatctccccataaaaaaagaattatctggcgcaaaacgttaatagtgatgaggatgaaaaatctgatctaaataaactttgacaaaataaaaataatcttttgagggtttaaaaatacatatataattaaaacacagaactgaaacagaatatatactgggatagggtaaatggagttgaagttcatcctggttcttctattgtccaggaagaggtaaaggtactaatttatattaagactttgataagtcaaggatgtatgtggtaatctctacaaagaaaagaatggtaaaaagtgtataattactaatgaaataataaaaaccaagcaacaagttaaaaagaaagaaaacagaaaaaggaacatagaacatgtaggacaaataaaaagcaaatagaaagtatatttcaattcaaacattaaattttacattaaatataaacagcctaaatgttccaattaaaagacaaaaattgttaaactgcattaaaaaactccacaatatgccactaataggaagtatactgaaaatataaaaatatagaaagacagcaaaacatatattttgcagacattaatcaaaagaaagcaattacatgcaggagcagaaaaccaaagaccacatgttctcccttataagtaagagctaaacattgggtactcatgggcataaagatggcaacaatagacatgggaagaaggcagggagaggaacaaggattggaaaactgttgggtactatgctcagtacctgggtgatgggatcattcatatcccaaacttcagtaccacataatatactcagttaacaaacctgcatacaaccctcctgaatctaaaaagtcaaaaaagaaaaaaaatgcaactacattaatattagacaaagtagatcttatagcaaaagcactcccggagacactgaaagtatccacctaatgataaatgcaccagaaagatataacgactaaatttgtacatacctacaatcattaggacaaacaaggcaaattattaggacaatttgaacaaataggttaatagtattaaagtctttaaaatccttattgatattctgtctactaattaaaaaatattaattactttttattggcataaaatgactactaattttttaacagactttttttcaaagcagttttagattcagagcaaactgagtggaaagtacagagttctcatatgtgcttttcccctactatcaaaatctcacaccatggataaatctatgctgacatatcattatcacccaatgtccatagtttacattagggttcactcttgttactctgtattcttgggttttgacaaatttttaatgacatgtacccacctttatagtactgtcgtcccttggtacccttgggggactggttccaggatccctcaaggacaccaaaatctgaggctgctcaagttccttatataaaatggtgtagtatttgcatataatacacatatcctcctgtatactttaaataatctctagattacttacacctaatacactgtataggctatgtaagtagttgttatactgtatcatttaggggacaatgacaagaaaaaaaagtctgcatatgttcagcacaaaagctacataggccaaactacatttttcgctcatggttggttgaatccacagatgcagaacctgtgatataaagggctgactatactgtatcagaagagtttcactgccctaagaatcctctgtgttccacctattcatccctctccgccccaaattcactattcttttatagcttgcatagttttgccctttctagaatgtcatagagttgaaatcatacatatgccatctcaggttggcttatttcatttagttatatattatatgcatttaaggttcttccatgtattttcatggcttgatggctcatttctttttggtgttgaataatattccattgtctgaatataccatagttttttttccattcacctattgaagaacatgttggttgcttctaagttttggcaattatgaataaagctcctatacatatctgcgtgcaggtttttgtgtggacatagattttcatcttatttgggtaaataccaaggggcacgattgctgggttgtatggcaacagtatgttaagttttaaaagaaactgccaaagtgtcttccaaagtggctgtaccattttgcattcccaccagcaccgaatgagacttacagttgctccacacactcaccagcactgggtgttgtcagtgttttgggttttagacatttggtaggtatgtagaggcatctcattttaatttgtaatctgtctactatttttgaaactaatatttaggattgaagtgttgaaattttggatgacaattgtggatttgtctatttctttttgcagtttttgaaaacaagtttaccaattatttttggtaatgtctaatctgctattcatcccttgtcatgtattttttctctctcacattgtagttttcatctttaaaagtttgatttgggtttttaaaaatatcttctatgtttctacattacatggttaatccttcttctcacttcttgaacatatagaatataggtataatgatttttaaacacctactttattagtatatcagcactgtcatttctgaactggtttcaataaactgatttttcccattatgggtcaacttttcctgtttctttgtgtacctggtaaatttacattggatcctaaaacatttgttgggttatctgagacactgtcaagttattgtacgcagtttaattctttcagaaaggcttgcttttaagctttattaaatgggatcacagcagcctttagcctagggctaattattttcctctactgagctaatgctcttctgagtactctaccagatgccctgtgaattgtaaggttttccactctgactggtggaacacaaactcttcctggtcttttttaagctccagagacctgttttttttgttttgttttgctttgttttcccctttgtcctttaggttagttcttttcccagtctcaagtattaatagtttacttacatacatgtgctatccagtactcagtggaagacttcacatctctggaagggttcctctgggctagctctcacctctctgtactctgccctaggaacactagtctctttggtgtcctcagatttccagctgtatcttttcaacttatggagactgctggactctgcctgtgttcccctcactgcaactcccttgagggagtaagcaggtcaatcacaggtctctccgggcatttgatttgcatcccctttcagggatcactggcctggactgctctttgtttaatgtttggaaaatgcttcagatatatgttgttctatttttaagttgtttcaggtgggaaggtatacgtagtccctattactccatgttggctgggagtcagatttgataagttttgtcataatactggtgtaatggctgaatgattctctaggaagcgaccatgatgtaacttcacagactctccaaaagtctgaagttacatcatggtcgcttcctagagtatcattctacttcatggagccactctggttactagttgtcaaactagtaggaatgttgttatggcaatacagggaaggtgatctccacaaaaccatgctcattttcttggccttcaggtgatatactgtatgcagaatgtaaaaaataggtcagttagtgacatctgtacttaggccaaggacccaggatggcagccatatgtttgctactaccattgtaggtttctactaagaaacaatcacaatatttgccaagacttagcactgatcaccctgcatttcctaaacatttgggtggtagacactgtggcttgaggaaggcattcattaccctgagctcatgctcatggttttcagtttagatacccttggaatttcccacagcttgtcttaggttgtgaagcagacttctaagaatctggatatcaacaaattacagtcatatgtcacttagcgacaaggatacattctgagaaatgtgatgttacatgattttgttgtcatacatcataaagtgtacttacacgaacctagatgggacaacctactatacacctaggctatatggtagagcctattgctcctaggctacaaacctgtacagcccatgactgtactgaaaactgtaggcaactggaacagaatggtatttgtgtatctaaacatatctaaagccaggtgtgggggctcatgcctgtaatcctagcactttgtgaggctgaggtgggtgaaacacttgagctcaggagtttgagacctgcctgggcaacatagtgaaatcctgtctctacaaaaaaaatataaaaatcagctgggcatggtggcacgggtctgtagtcccagctactcgggaggctgaggtgtgagattggctcgagcccaggaagcggaggttgcagtgagctgagatggtgccactgcactccagcctgggtggcagagccagaccctgtctctaaataaataaataaataaataataaacatatctacacataggaaaggtatggtaagaatatggtctaaaataatttaaaaaatggtacactatctagggtacttaccatgaatggagcttggaagactggaagtcactccggtgagtcagtgagtgagtgtgaaggcctaggacattactatacactactgtaaattttataaacactgtacactaagagtctactaaatttataaaaaagtttttttatttcttcaataatgaattaaccttagcttactgtaatttaactttatatactttttattttttaaaaaattttgactcttttgtaatagcattcctcttttttttctttgtctaaaggcttcttgatttttttaatcgtttcagaaaacttttcatttcattcctcttttctatagtttttttggtttctattctgatctttattatttctttttttccactaattttgggtttggtttgctgttgcttttctagttctttacgatgtattattaggttgtttatatgaagtttttctacttgttgatgtaggtgtttattgctgtaaacttccctcttagtactgcttttgctgtatcccataggttttggtgtgctgtgttttcatcttcatttgtttcaagaatttaaaaaaattccttcttaataacacttggcttaaaacacaaatacattgtacagttgtacaaaaatattttctttctttatagcgtaattttgtaagcttttttctatttttattttttaacttttcaaacatttttgttaaaaactgagacaaacacgcattagcctaggccttcattgggtctggatcatcaatatcactgtcttccccctccatatcttgtcccactggaaggtcttcatgggtaataacactcatgataagaatgccttcttctgaaatacctcctgaaggaaccacctcaggctgttgcgcagttaatgtttgtttaaatagatagaaggcatgtactctaaaacaatgataaaaagtatagtatagtaaatacataaaccagtaatatagttgtatatgaaagtattatgtactgtactgtacataattgtatgtgcttttttttttttttttttttttggagatagagtctctctgcactctgggcatggtggtgcatacctgtagtcctagctactcagtgcaacctccgcctcccgggtttaagcgattcttctgtctcagcctcccgagttgctgggattacaggcgtgcaccaccacacacagctaattttatatttttagtagagatggggtttcaccatgttgggcaggctggtctcgaactcctgacctcaggtgatccacccaccttggcctcccaaagtgctgggattataggcttgagccaccgcgcccagcctgtgctgtatttttatatgactggaagtgcagtaggtttgtttataccagcatcaccacaaacattatgagtaatgcgttatgctatgatgctgtgacgtctctaggcaataagagattttcagctccattataattttatgggaccatcatggtatatgcaatttgtcactgacaaaaaagtcattatgtggtacatgactgtactttctttggtcaaatggtcagacagaaagattgagtcaaatgcttgcagggtctttcaggttttttcttttctttttttttttttgagacagagtctcgctctgttacccaggctggagtacagtgctgcaatcattgctcactgcaaccttgaacttctgggctcaagtgagcctcctgcctcagcctcctgagtagctaggactacaggtatgcaccaccatgcccagctaattttttatgttttagttgagacaaggtcttgctatgttccttactctggtcttaaactcctggcctcaagcaatcctcccaccttggtttcggcctcctatagggctgggattacaggcatgagccacagtgcctggcctctcaggtattttctgaggttccaacaagatgactgggttagcagtctatggccacttatcccttaatccttcaatgcctctcctttgcagtttagggtattcatctctgtatgtaacatcaccttgaatgttttaccattccttcctatcatagatttgttctggttggcaaaggagaccaaggtatgcctgtgagaattgaaataaatttcatcactgagcaagttagttactttaaccttctagaatcaccaaataccttaaattcccattaaaaagataacagcggcaaatctgttgtgatctgggttcttatgatccctggggttttagtttctcctccatactggctgtgtaaggaaggcttttcatctcaggaaacactgacagtgagtggacctgaggcaagagcaggaggaaagctgcaaggggtataggtgtgtgtatgtgagtatgtgtgtgtttctcagctgtagaattctgagaggcagtcaaaactgccaaccttcctttgtaggactaactttaggccaagagagattggctgagtgaatcctttgatgacagctgctgcaacaccttgatggaggtttctcttgtccctggccaccagacttcacagggattgcgccagtctgtctgaccataatgctactactgtaccaagagtgcctaaatattcatttcttaaatgtttttcagctttaccatgtgcaaggccctatactaaccctgagaccagctaattaaagagttactcttcctgactcttacctccttataactgatgctattgactgttatttttatatggcaccatcacgcccttccccccagacaattataaagctagagaataaaagcacaaaacagaaaacggctgggaaaatgggttgtggattacatcagtcacagaacgtcttagcaaacaggtggagagaaatctcccaagtaatctttgaaaacctgcagaacagtagggcccagagagggggccatgtctgatccaccacctttactggtaatgagtttccctggaacacatccatgctcatttgtttacaaattgttgttggggaaaaggcttatggagtgcctgcataaactggccataaaaatatgggacaataagttgtggaaagccacaagaggtctctgaggaggaaagccttcttatcgccgttatgttcccatgctctgagtgcaacctgctctcttatctataaacactgtgctcaaggagaaagacactcctctgaaacactgaaatgtggacagacgtacaggctcctagttaagcccgctcctactagctactctccaataagttaaagatatgctgtttaagcacaaaggagattcatttaaaccgctactgctatagattacgcctatgacatgctgcctccctttcactgtttcgccctaaacatctgcttcttagatctaagtgattgtactcaataaatcgtgtggagaccagaactctgggccttttgcagcctccattgtgcaactggccccctggctcccatctttatgaactcttaacctgtctcttctcttcctttgttgccaccgggctttgggtaccctatgggtggtgttgaggctggtccccaacatattgtctatggctgctttcatgctacaatgacagagctgaataggtatgacagagaaggtgtagcctatgacgcctcaaatatttactatctggccctttatagaaaaaggtttctaattcctggtctaaagataaaggtaagatacaaaaaagttctgaacaggcatggtgactcatgctgtaatcccagcactttgggaggccaatgcaggaggactgcttgagcccaggagttcaaggctgcagtgagtcatgactgaaccactgcactccagcctgggcgatggagcaagaccccatctctatttaaaaaaaaaaaaaagttttttgattctgatagaagaattccaaattatgatttggcaataatactatagcatatagtccatatatcataagtgtaatttctcaaagacttgcctactgaggcatacaagcaaatatataagccaattttcagaagtaaaaatttagtcaccactaactttgaaatattgtttcattctagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggtaagagaacactatgagagagagacagaaagagggaggagggtgagagatggtatggggaaagagaaggagagagggagagagggagaacatctccatgaagataattttctaaagaaaaatccaggttattatattactttttggtttaatctacaaacatacattttaaaataatttaaaaaatagggccaggcgcggtggctcacacctgtaatcccagcactttgggaggcagaggtgggcagatcacgaggtcaggagtttaagaccagcctggccaacatgttgaaaccccgtctctactaaaaatacaaaaaattagccgggtgtggtggcatgtacctgtaatcccagctactcgggaggctgaggcaggagaatcacttgaacctgggaggtggaggttgcagtgagcagagatcacaccactgcactccagcctgggcgacagagcaagactccgtctcgagattaaaaacaaaacaaaacaaaacaaaacaaaacaacccccaaaaaaccaaaaacaacttaaggaacacatttataattattagacaaaaattacttatcctaccactatatttacaaaatcatagttatcattttggtttctttccagtatgtttactatgcatatattttaaatagttgtaatcctaacatagataatatacataaacatttataaactacctttccatttataacaatagatcatctagaatacagaaataaattattcagatgattctgtgaacatatggctattacatattttcaaccaaaaattttcaaccacaaatagaattaaagccactgaattgattttatataggttaaaccactgactttttaaagatttaaaagactaaaaattctgctaaagatttcaattaggcatttttaaaaacgtattaaatggtttacatttttccaaatttggaaggaaaaagtatattatagacatgttaccactaaataaaactttcaaaagaataacagaaaatatcaccatataatgttctgtggccagtatttcatatattgtctcaatacagctaaatgcttcttcgttaattatttccatgtatttaacagaaataatatacaattatcctgaaaataggcaatttaggccacacttacaacatgattgggaaaagaaaggaagagaaatcaacttaaaaacattgtaataataatgtactcataactgctaaagaaagatgaggtcaatttttttagttaagtggaaagatggctaagctataataatggaaaacaaaaaggctgaaaaagaagtattcataatgtgatctcaaacttgtttaaaaaaaagtttttatatgtactaaagggtggtatgcataaaagtacagaagatatatactaagtatttccaagttgtccgaaaatattttccagtgatcttacagtactttttgattgtatcaccacacataacacaaaatttaccatttcatccattttaaagtgtacaattcaatagcatttagtacattcacagtattgtgcaaccatcaccactatcttgtttctgcacattttcgtcccaccaaaaggaaactctgtacctaaactccccatttctccccactcccagcccttggcaaccactaatctgttctgtctctatgaatttgcctattctggaaatttcatgtaaatggaatcacataatatgtggccttgtgtatttgacttctttacttagtataatgtttttaaagttcatctattattagcctgtatcagaacttcattcctttttatggctgaataatattccattgtatggctataccatatttgtttatccatattgtctaccagttgatgaacatctgggctgtttccaccttttggctatcatgaataacacagctatgaacattaatataagttttctttcaacacctattttcaattcttttgggtatatacttaggaggggaactgttgggccatttggtaattctatatttaatttattgatgaactgccaaatgttttccaaagtggctatgctgttatatgcccaccagcaatggaagaggactccagtttctctacattcctgccaacaattgttatttatttttaattatagctgttcttgtatgaagtggtatctcattgtgcttttgatttgcatttccctaacaactaatgatgttaagcatctttttatgtgcatgttgtctatctgcatatcttccttggagaaatatctattcaacccctatgcctatttctttctttttttaagagatggggtcttgctctgctgtccaggctggaatacggtggtacaatcatagctcactgcagtcttgaactcctgggcttcagtgatcctctgcctcagcctcccaagtagctgggactacaagaatgcaccaccacacctggctaactttttaactttttctgtagagacagcatcccattatgttgtccaagccgttctcaaattcctggcctcaagaaatcttccctccttggcctcccaaagtgctggaattacaagcgagagccactgtattgggcaagttttgcccatttttttattgcattgcctttctgtagttgagttgtaagagttctttatgaatattctggatatcaggaccttatcagatatatgatttcacatattctctcccattgtgtacaccatcctttcactttcttaacaatgtcctttgatgcaacaaatttttaattttgataaagtctaatttatcttttactttaggtgtcacatctaagaatccactgccaaatatgaggtcataaagattttcccctatggatttttctaagagtgttgtagtcttagctcttatatttacagcaaaggtctaaatataagatatattaggtctttgatccattttgagctaatgtttgtatttggtgaaaggtagggattcagcttcattctcttgctggtgttgtcccagcactagttgttgaagattgttctttcctccactgaatggtcttgacacccttcttgaaaatcaattgttcataaatgtatgtctgactttcagtgttccattggcctatacgtctatgcttatactagtatcacactgacaaaagctgattatcatatctttatagtgagctttttgaaatctgaaagtgtgagatctccaactttgttcttttttctcaagattgctttggttatgtgggatcaacttttccatttgaatttaaggatcagcttttccatttctgcaaaaaaaggccatggaaattttgatagagtgtagtgcttttgataacctggaagaaactcatatgtgtatttttgttcagaggaggaattgggtaggtgggattagcctattgcaagtatccgaatgagagatgggtagggcctgaattgggctgagttagtggtcggggaaaggaggggactaatgtgagaggctcatttgggggtggaacttggggacagtggctcagatggaggaaagttatctggaatgacaccagggttggaagaaaaacatcccctctaatattctcctcagctttctaatggcctgcttagctgatacacttatccacatatctacaatcttgtatgtagggaaatgaatatatgcactgcatcatgaactttatttgtttatttatttatttagggacagtcttgctctgtcatccagactggagtacagtggaacgatcttggctcactgcaacctccacctcctgggttcaagcgattcttatgcctcagctttctgagtagctgggacttcaggcatgtgccaccatactcggctaatttttgtatttttagaggagatggggtttcaccatgttgcccaggctggtctcaaactcttggtctcaagtgacctcagactcccaaagtgctgggattacaggcatgagccaccgtgcccagacagtattatacacttcaaaagggtgaatattatagtatgtgaatcatatttcaatagcataataaaccataaaagacatagctcagtgtctcattgagaagcaccacggaagcatgctgtctggtttcacctattcccatgtgcatatcaagggtgggctgtgagctcatcattagtgctagctcagctctctggtcacatgagggaactggattggctggcggcttgggaagtctggtgtggccatacgatttgctttggtcagtataattagacactttaagagctcatgtgtgatttgtaacctcacatttccactaccgcagtgatcaggacagcctgcttatagatgaatcctgagtgaatatgatgagctgagcccctgtgtccccacattagacacaaagtataaatgaaaaataactgagatttggggattgtttgttgatgttgtataatttaatctatcctgatggatacaaaatggaagcgcagttcagccccaagttaccatgaggagttcactcttagagcctacgtgaaagggctgagaggagagcctgtgaaaagcatttcagcatttcttatgtctatacgacatctttaccctatacatgaatgcacatagaattctattcttgtgtggttagagcagtttgacttcacattgtgtttacttccattcacagttactgataatcacataagaaatttaaatttgtgcttttgttttcttctaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactggtacagagatttagctaagcaaaatatcagtgtgtgattaatctttaacttccatttgtttttgttactaattttagattaaaattatgatacattagtcagatctgagtacttaaaatattggcaaaatgctgattaacatagaaaatatctgggaaaatgtatggtaggggatataaataatagactgtggctttatagttctagctctatcagattcagtaaacttggatgagattacattccacatttgactctcagctttagagatatggtaacagaatttctacaacagatcctgaattcttattgcattaagggctctgctttggtctatatgtgcattatcccacttaatccagtgcaacgtgcctttatcaccttgaagccagggtaaacaaaggaagagtgatttgcatctaaagagaacaaagccccaaccctctggctatacccaaccactcaaaggcagcacaggaacccacatcactgcttggataatcccaggaaaatgcagaaaaagtgtagcctgaagcatgattttctcatgtggcacttctgtgtgcaggagatcacagcgcgggttttgttggctgctcatggaccccttctccaatgaggctcatacctgactgaatgaaggacccttgggagggaggcccagtctcctctgagaaaagcctaaccaacaccttatgaaaataagcaaataaatacttgttaaataattggctgggaagggatagggacatcttctcttgtctataaccaaggtagattgctcccatgcacacagatgatcacagggtaggtgtctacaaaagtctccttgccaggaaaaacttttgactatttagaaattgtgttttgcgttatactaccaaatatttcactaatatttaaaaagagttaggaaaaaagtgttcaatgaaatggattccttggagtgaaataaatacaaggtttacaaagtaagagtcacaaattctcagaaattttttcagaagacttggagtattcttgaaatgtagttattttggaaaaataaacttggatatacaggaaggattttaaatgtttcaatatgatagctttagtttccttttactaactttttcctattcttctgcatgttttgctagagatgtgaaaaaataattcacagactttataatacatactgaattgatatctcaagtaatttctccaaataattatatttcctgagttctttttgggagtagtttatatatagtgttaaataaaagtaggcagatgattaagtaaatttttaaatcttgatggaagaaaacgtatgcactctggctgggcacggtagctcacacctgtaatcccagcactttgggaggctgaggcgggaggatcacaaggtcaggtgttcgagaccagcctggtcaacatggtgaaaccccatctctactaaaaatacaaaaattagcctggcatggtggtggggtgcctgtaatcccagctacttgggaggctgaggcaggagaatcgcttgaacccgggaggcggagggtgcagtgagccgagatcatgccactgcattccagcctgggcgacagagcaagactccgtctcgggggggggaaaaaaaagtatgcactgtgaaatcagttcttcctagaactgtttacccagagagtgaatttgaatctagtctttgtcatgtcttccccactttctgccaaagacttaacagctaaatataaatgtagattaactgtctactatcatctattctactcccaccatcatggaaggataaacagcactcctgggcatatgtctaagttaaagcaacatcacttaagtccagaatgtcatttgtaagtctcaggtagtaaagatgatttaagtatagagtctgggacagagaaggaggaaaactctctctctataattctgaatttcagaggatgatgttatgatgccatggacaaaaataatgacaaatctataagcaaaagttggtttcactgctataagcaagtaaaatatacacctgtttcacttttctaatgtctggtaaacagtctgcaaattctcacattagcaatagccccagtgaacagaacagtatctattataaaggtatcacaactgattataacacaatctcacaacaggattgcttaccattttgcctcatgtggcaatattattccctccttagtcaccaggtatcatgatatgttagcaaaaataagcattaagttatttaatataaaaattagtattaaggcccacaggtgaataaaatgtaacagatattacaaaatagaaataaagtgactattaaaactttttaagcaagaatttcaaggtgcatttcatctttaaattgcactcaaatacttggagggaataatatttactaacctcattttcattatggttttttcttttattaatatcatcaacttatctctgctacctcatccttgcgtggtcattagtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggtaagagatgttgacttctgctttattttgtgctttaaaagtaaatgactcttagcagctgggcacggtggctcacgcctataatctcagcactttgaaaggctgaggtggccagatcacctgaggtcaggggtttgagaccagcctggacaatatggtgaaaccccatctctaccaaaaatacaaaaattagccgggcgtggtggggcatgcctgtaatcccagctactcagaaggccgaggcaggagaatcgtttgaatccaggaggcggaggttgcagtgagctgagattgagccactgttctctagcctgggcacttgagcaagactccatctcaaaaaaaaaaaaaaaaaagtaaatgactctaagccacatgcagttgtatacacttgtagtcccagctactcaggaggctgaggtgggggaatggcttcagcccagtagtttcagactagtctaggcaacagagcgagatcctgtctcttaaaaaaaaaaaaaaaaaagtgaacgattctcattgctctgtgaagactgtattttaatttcatcctaaaaattgatcctgaatagactaatttcataatcttcaaatatataaactttgcagaagagatagctgtttactgcagaatagcagttaggtataaagcaaactcctccaaatcaaatgatgatttcctactgatgtttcttaaaaatcagctttaatgaggtataatttatatgtagtaaaacttatttttagtatatagttctgagttttgacaaatgcacatagtcatgtaaccaccaccaaaattaagatataggacattctatcactccccaaaattccttgtttccccctccaccagtcactggccaccacagaacactgatctgttttctgtctctacagttttgccttttccagagtgtcacataagtggaatcatacaatacatagccctttcagactggcttctaatgtttttgaaagccacccattttgttttgtgtatcagtagttcattcctctcttctgccaagtagtgttccatcatgtggatggggcagggtttcctatcagttaaacgtcatctgagttgtttccagtttggggtgattatgtataaagttgctataaatatccacgtacagatgtttgtgtggacctaagtgttcatttctctagggcaatgcccaggagtgggactgcggatatggtaaatacatgtttaagtttataagaaaatgccccacagttctctaaagtggctgttcctttcccacctgcatgctggggagctcctgcctctctgcagcctgcccgcacttggtactgtcagttgttttttcccttcctttttgacattctagagggaatgtggtcatctagaccttctgcccatgtttccataggaccaccagggagggctctgagtggaacaacagcaggaccaggtgtgagaggctggctggtggggacactttgggtgctgggagcagcaggagcattcgtctgggtaatgaggcccccatgccacgggtgtccctggagatgctggggtgagggaagctgaaaaggtcaacacatttgtgcagagatggccatctgtgacagcacactgccagtgtcaaacataatagaagcttccatggcctctctgacaaaggatttcatcctactttcatatgatcacctaaggaactcctctcatgctcaggaaagtcccttcctcctgtggcctatacaccaggtatgctctgccctaagaaaaccccatttgtgaaagtctaaagccttggaaaagataaatgacccatgctgagctacactgttatggttttataagaaggtcaccacgtggcttttatggtatgtactactggtatgctcactttctgggtttaaaaattgactactgaacttaactaaatgttaaaacaaaaacctataaaattaaagcatacaggaacctttgtagattgaagccgtagaggcataacattagatctgagagagtctgggagatgatctccccaagcttcttatgcagagatggagacaggctcagaggaggtgagtgattggcatgagcattcatggacaaaaacagaggcatgtttctagtccaggaaaatggctatgggaaaatatgaagaataaaaatcagtttctgtgtaaccttccacacctttgttgtaaatgtacaatgttaccagtactctccagcagaccacattctggctgtgttaagcaccttcatctaaaccatgatatatttacagcttgatgaatccttagagagaaaatgtcaactatgttaaaccatctatttccagcttgttacttttctgaacatgctttggttatataatatatattctgtccttgttctgagtattgctttctcctccagacaaagctctctcttgatatctatgcacacatgcccatacatgtgtgtacatgtatgtatatgcacacatgcctaaaacataaccgctgtgtgtcctaggcaattccatcgcctccatcccagatgaagcatttaatggattaccaaatttggaaaggcttgatctgagtaaaaataatatcacttcttcaggcataggtccaaaagcattcaaggtaaatacatgctctgatttgtctatttggacgaatggcttcactatgacttgcattggttggagatggggaagggaggaaaaggaaaatgcttctaattggtagtcttcttctaagaaagtttcctctctgatgtccctaatttgaattcaagttttcccttgaatatagtttactattttacatacttttagctttgctgtaaggacaccaacaatagcatcagtgacaaaagtaatgattttaatttatggagtagtttcttcccaagtaactgaaaacatgctaaaatctggtcttttagcatctgaagtattttctggaaacaaattgagcctatctggaacctctgttaacatttttcaggccagcaagacactgcttcctttttttgtgtgtgcaatcaacaaaacctgatggaggatactttggcagaagggggttctggaaaaacaaataggctcatataaaaattagggatagcttggggaagaagagggaaagagagagaacaggaaacagcacagagtaaacctttgaaagatacagattggactaattatatatttaaaaaaaaaaaaaaacaggccaggcacagtggctcatgcctgtaatcccggcactttgggaggccaagatgggcggatcatgaggtcaggagtttgagaccagcctggccaacatggtgaaaccccgtctctactaaaaatacaaaaaattagccgagcgtggtggcatgcacctgtagtcccagctactcgggaggctgaggcaggagaatcgcttgaattcgggaggcggaggttgcagtgagccgagatcgcgccattgcactccagcctgggcgacagaggaagaccctgtctcaaacaacaaaaaggagaaaagaagagagaattcaaggaatttcagagccaagagaaaaggggtttatgtttgtaaacaaaaactcataaatgtgtatgtttgaaaagccaaaaataaagcacactatattccactaagtgaaactgttactcccttgggcagtcttctgggtcttccacccactcttcagacaaatcactggtctcttctattctcatttcctgtttcttatctggagtctggcagataaaagggttctacattcacaccctagatctacttcatgctatccatccttcttctagaaaatggctagcattagggggtccttttcctatttgtccaagagaaaaatttgtaagagattacctccttttcttgctttggaattctctgtcccattccgaaactgttgaaatttgaatatgatcactggagaagtgaatcattccatgggactttactaaaacctacccaaccacaggtccccacttgtgggggtacaggctaggtttgaccaatgaacacacaactacaaatgtgaaaaagacacttttccagacagtcaactggatgccatattggaatggcttgtgatatctgtagtccttggttttgaaaaatttccacagtaattagtgttattttatgacctttctggagtagataaaaaactgaggtttacaagtatgtttaaaggattgattgctatcttaattgttagcatccatgacagcttcagattactgcatgatttcataaaatttctgtctattgctgtaaaggtggaaacctaagatctagcaagaatgaccaatccagtagttatggcagctttctctcactttctaaagctgcaatataaacgtggtgagtaagctacaaaataatcaaatgtagtctgctgaaaatccctgagaatcaatgctattaccaggatcaatatcaacctggcagggggaataaggggtttgctgtgtggcctggacattactgtctaagcctaaggaaggataggtttgtgagacttttagtcacgaccattatatgaaatgtgactgcacagctgtgactagataaaaaagtaactttgagatttgctttttaagcttctgaagaagttaatgcgtttgaatatggatggaaataatttgatacagattccttcacaattgccatctacattagaagaacttaaagtcaatgagaacaatcttcaggctatcgatgaagaaagtttatcaggtatttaatatttgtttttcaatgatatgcttccttataatctttcctatatagtcctgtagaaattttatttactgtattgccaaatgaataaatagtaaatatttttaggtcacttaaccatttgagttgataaaacttcttttaactattgactggtaaaacgtaaaatgaattttaaactgcctattgtctttgtaccttacccatgaataacattgtttctcaatgattccaggttcttattattcacaaggcaataaatttactacaaatccaaaatatctgaagaattacgctaaatattccctgcactgccgtgtgttttgtgttatggatcgacaattttgtcggttctttgtagcgactaaccagtgccatgtttgttgattggatctcctttatcactctgatggtcaacagaccccacccacaactcttgctgcctccatacaccttgctattttcatttatcatgtgttggaacctaaaaacaaaactaagcacatgggaattatgcatggaatatgaataaatgggcactgcatatgcggctgagatgctgtcctacaaagaaagcacatgctcttcatggtattaactttgactttggcaattttctgcctgagagggcttgggctggaacttctgtactcatatgtcactgaagtcctgctaactccacaccccacggcatgtggatgcaaggctcccaccatggcctagctttctgacagcctttagtgagcgtgccccatgttctgtgcactcgacattgctggaaatggcccctcttctgcttgtttcgggactgtgctagacagctgaagttgtcatattgtgactctgtatagaagaggctttatcacattttacttttcatgaattctagctaatgcctttgattgtactgtgtacttttttgagacaaggactgcctaccttttctttttatcttcctaatagtctagcatagctcttgaggtacagtgctcaacactgtctgtttccttgctttgaaacatattatgtttttatttattatgttatttattaaacaaagcctttaaaggaataaaacaattcaattatttcctgtagctcccaaaaaacttcacaggaacaaaacacttctggtattgagaaaagaacaataataatgagaattgccaaatctgaggattagttatggaaatactcaatttccagatggatttcaggacacacagaaaaacattaataaacacaaattttgatgcagactgccaaatgggaaagacattagaaaattcagtttctaactgctgaagaccaaagggtgtcagcaatttagaacaactgtactaacaggctgtatatgaactataagtcagtcacacttttagttgggttatcaaaatgagatgttataaaacatgcactcctgattgtgaacgtgctttcacacacccctggaactgccttccagagtactcttctcctccctcactcacaaatgcttctagattcccagagtgttgacaggaagccagggtgaacgggctgtctgcctgcctttcttagcccacctttctccacagtccgagcacccgaggagcctcggccccatgccggcagtgcttctgtcctccggctcagatacccccggctgcactccctgggtgggctgagttctaagagctactgcagtactggcccctcgggtgctgggctccccctggctgggagtcctgatgctgtggatggtcaggctggctgccaggagtgctgtgagggcaccctgcttctgtgtggaagcaggtggcccactgctctcccgtcatctctcttggggtggctcctcactcatgacctttcagattatagctccagagagggggaaggagggcactccagggagagaaaacagcacaaagatgcaaataaatgagacaatttgggatactgtgggagctgcaagcaggcacggtgaaggtgaaaggcaagcaaagagcagcacaaggggctgcacacaccttgctgaagggcagggaatttacctgcaggaggagcagagtccacctgagatgtgcacacgtgttatggagaaagggaaggacttacaattgagagagaggtgtgaaaggtggagggagggacagctgaggaaaaccaggcacgctttaaaagcatttttgttgtcactaatgactgaaacaactaaatcaggagccctggaggctgctctagtggatgaccatgtgatgctgcctgccaggaacatcgaggcacctgccatgtccacagcctgtcatggtaccacccaccatggaagacttcctgtttcctgtccatgaatcctttcaacatccacctcaagtctcacctacaagaaacgttctctagctccatcctatttcctgttacctcctatttcctatatataccagagaataattgcaaaagaaaacacagtgtcctgaatttgcactgtttctctctttttctctcagtcatgtaatggccactagttcatttctgttatctatttttcaatgaaaaacttccactgcatttcaaaacttcacctatgtactagagaaagatgtcagattctcagtacctttagttttggaaatgaaagagaatatgaggaaatataaccacttatcccaatttactggctggcctggctacttcctgttgctcagcacttccattaatcctgagcaccaccaccaggttaacctttgtaaaatgtggcccttgtcctgccatccccatcttgctgcctagagaatgagagccagacgttgttgtccagggtgcaaaggccctcccagaattagctgagtgtggtggtgggggcctgcaatgccagctactcgggaggctgaggcaggagaattgcttgaacccgggaggcggaggttgcagtgagccaagaccacgctattgcactccagcctgggtgacagagcaagactctgtctctaaataaaataaaataaaatttaaaaaatgtaaaaaaaggccctcccagtgtacttctctctgagcaccaaccttcactccactgtgcacagccactccagggctagtctcctctctccctgagcaaacccacatggtctttcacctacatgtgctcagctggctatttcagcttggaagttcctcctacttctatctaaatctttctgtctgtaggagcctggcactttcataccactcacatctacactgctttttcttcttttaatcttccagcatttattatttctattcctgatgcaaccgtctttgctgttgcctaagagcagaacggagtcccacatggcattcggtgcaatgcccatgaagggggttgaatagaaaacatcccctaatctgggaattttggccacaccctgagcctctgactcagatgcctttgggtattatcattgctgagctgtccattttgcagcacagaacttccatttgacctggatcataccactcctgagactagtagaaacaaagtagaaaaaatttgtttgtataaaggcctttcttgctagttcaatctgaatgcatggagaatttttgatcatcattctttcaaagcttccatttggctgcactctgtgccaacaagtgagtaactatgatgggaattcactgttctggtttacttctgactcccttgttcagagactgagggtgagccagggaaagtgttcttttctgtgtcctagaaaaagaaatcattcattgcattaaacttctacccaccccattgcctattatgctgccacttcatacatctatgtctttgcaatgtttccaatgactgtccacaactttctattcctttcctacctgaattccaaatccctgttcagccaccacaatttctatggaaactcctctgcctctctttcctatctccctccctctcttctctcttgcttctgttccttacacatattgttagcacctagcatttcaatgatttttttcaggtctgcctcactactggaccatgcatttagttctggttgaattgagcatctgggatgtacaaagtacttaagaaaaggttttataggaggatacaaaggtttaaaaaaaactgtatttgccctccaaataaaccggccatttcacatgacatttcaaaaggctacaaaaatttgcatggtttttcaattatcctaatattctaatacttttattttttatagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggtaacaatatatttttttagtgttttaaatgtattatatttgaaatatggtacactacaacaaaatatattttaagactattgtgatgtaaattaaactctagtttcatgctgtatacagaatttcctgtaatttaagcattgttttttcttcaagcaatacaaaattctgaatcgaaattataattactagtagagacacctgatacagtgaaaaatggtacttctgatagctcttgggggaaatgggagaaatgaattgagaatttaaatgaaaccacaacttccatgaggtactctgactctcaagacagtgtaaactgccccaatctagaaatgtgacgcttatcacagaagctcaaacaggtattaaccgtaacagagtgtccactcacaaattccaggcaaaaccacagacactctgacctaacagtaacttgcatggatacaagtgttgtacaaagaaggcctctgactgtttcagcaactctgtagcttacaagttttcacccagttcctaccaaaactgtcctgtgactaactccaggccccaaaccccagccttgcttcattatcctctagagatgccccacaggtccccagatgtgtggtctccttgctgcaggatgtgctcctgggggtctttggctgatgaatgtcaacacccctcatttcctgcgttaaaaacactgaggtggaccgtgcagtggctcacgccagtaatcccagcactctgggaggctgaggcaggaagatggcttgaggccaggagtttgagagtagcctgggcaacatagtgagaccttgtctctaaaagatatattaaaaaaaaatagccagtcatggtggtgcacacctgtagtcgtagctgctcaggaggctgaggtggaggatcacttgagcccaggagtttgaggctgcagtaagctaggatcgtaccactacactccagcctgggcaacacagagagaccctgtctctacaaaccacaccccaccctgcctgccaaaaagaacactgaggtccagagagtctatacatactggcagaccccgtgggaacccaggtttccttactaagctccgtttctcctagaccacatgatcatccagccagaagtcaggatggagcattctccggctgcagccccagcaagccagaaaagagggtcatctattgtgatcttatgtggctgtcatggctaccacccttcctcttcttcctatttccagattaagtgacagagttatgtaacactgacatttatcagtaggctggctttccatcagaatctcctgggttcttaagaaatacagactcttggacctaccccagatatgctaagtcagattctttgtgggacagggccagaaatgaataattaaaaaattaaaatttaaatagataatgcatacacatgttaaaacacatacatacacaatgaggataatacaaaagagcaatctgccccactgtgagcctgagcttcccatactgacttctctctctccagagggatccactcctaccagtctggaaagcactgggcatacaagcgcacaaatgcgtggcacatactacaaatccttctaaagccactgctgtacacctgcctcacttaaccatgcagcctcaaggctgtctcatgtcattctttcctacagctgcagagttttcaacatatggacaggtgtgccaggatttatttgactagtctcttactgatctagctcacctcctaaatacatatgcaggtaaaagcaaaaagttgaaaattgttttactaatttctaacaaataccaaaattaacaaagagggaaattctcacaggtggaatagaaggtgacactaaagatatatgccagttttacctctgaattctaacaagagaacaaggagaatttttataatgcagatcctttagtgaaaaactccctctaatgccaactaaacttaacttgaaggcagctagctattaaaaacttattaacagttctagaaaacttctccttggttgtaaattaaggctgttaattaactttaattaattataacaaaagcaaatctaaaaacatgagcctaaaatattatagaccacatgaaatagtaggaaacaggcagcctgggagctggaggctcggctaggacaagcccctctcagcattagtcatgtaaccacgggtgggcttccctgtctctccaggcccaacttaactccactggtaagtagagattaaaatatctgtctacttttcagagtttttaagcccaaatgagataatttatgtgaataagttttataaaatagagagccttgtataattattttggtatgccatttcttgcaacatattatagctaatacattttaaataaaattcatttgattccataaccatggcagtgtgttttattttactaattagttataaaatttgacaactttcctgtaattccagcactttgggaggccgaggcgggtagatcacttgagcttaggagttcgagaccagcctgagcaacatggtgagaccctgtctctacaaaaaatacaaaaattagccaggcttcatggcgcatacctgtagtctcagtcacttgtgggactgaggtggtaggatcacttgagcctgggaggtcaaggctgcagtgagccatgtttgtgccactgcactccatcctgcgtgacaaagtgagaccctgtctcaaaaaaaaaaaaaaaaaaaaagacaacttaaaaatatgagcttacttgaaagagcagtaagactctttagataatactaatgataatagtctatgtcactattttagtctccatgaaattgaacgtatcaactaacacaaaagaaaaataatagtcttctctcttaattataggaattatacctagaaaataaccaaattgaagaaataactgaaatttgtttcaatcataccagaaagatcaatgtcattgtactacgttataacaaaattgaagaaaataggattgctcctttagcctggataaatcaagagtaagtacatgctacaatttaaattttattgaactatttcttcctctcgctattattaaacagagtatggaaactgggaatgggataagtgagggaggtgacgatactgaagggctcggagacagaatcgtttcttagtgaacccttaccctatccccaaagtgggctacttcatgcagtttccaacctgtgcgctgcatgactggtgttaggattattgcagtaactactgttgttgtcaccatactgcatactggacaccctatcatatgccaagtgctgagctagcaagaactgagccccagctgtctgacttcgaggtctgcccactagtggtcaaatgccactctagctctgtctacctcacaggttgtcaggaggtttgaatgaaggattattcccctgcacacagtgagaaagaaatctgccatactccttctcctcatcatcattaggtggaagcaccaggctccagagcccaggcctgttctcctacactacacagccttcttttctccaaactatttcttcacctcaactcttacaaaatagactgaagaatgcttggcctaacagtgcaggccaaaagtagactctgtcttcctggacaagaatcagcagcctctggctatagctttcagtgaagggggagggagtcagaagcaagccctgcagcaaatccagcagacaactgggatctgggattgcgtgtcctggaactatgtgcctaagtagcacagcctgggacacgtgtcattcagaagcaggatggagaggccaattgggctcagcagcatgtggcactgagcccactgtaggcagagaagtcttcatcaggtgaaaagagggcgtggggcagaagccttaggagactcaggtggggttcctgaaacaagccagtgagttcaccacgttccccagatcttctagatgattaacagcattttctagattccctcaggctcgcctcaagtcccaggtgtgccaggtcatcaaatcaaatgtggaatgaaaatgtaggggaaggggaaccaaaacaagccaaaacaaaccaaacttccttgctggaaccagagacaactttacagataggcatttagatgcatgctgggattcacgggatttcattttggattcaacgcatcaaccgtacagatattttagtctttgggcctcagtattgcctctagggatatgagtttttccctcctagtctttgatgctcctctcgcatggactcacatagctgggaggcagtatggcaccctggtaaggacatgcagcttggtgcaagagactagggctggctatacctggaaaagttcctatttggaatcatcactacaaactgggtgcttataggaaaatggaccagcatcgagactggccttatcaaaatttagagctgatgatcaccatcctgatgtccctaccctgtttacttttttctttgctgcagaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggtaaattttggctttttcaagtatctgtttaaattttggttggcaaaatatatgataaaacaaccatgacatgatctctgggatttacgttaagggaaaaaaaaatggtgctaaggggttggattaaacaagattggcaaatgttagtaattaccaaaggtggatgacaggtatgtgaggattcattataagcttttcctacttttgcacatgtttataaatttccatagttaaaacatcttttggtcaggtgcagtggctcacgcctgtaattccagcactttgggacgccaaggcgggcggatcacctgagttcaagagtctgaggccagcctggccaacatggtgaaacctcgtttctactaaaaatacaaaacttagcagggcgtggtggtgcgtgtctgtaatgccagctactcaggaggctgaggtgggagaattgtttgaacctgggaggcagaggttgcagtgagccgggatggtgccactgcactccagcctgggtgacagagtgagactccatctcaaaaaaaagattaacagattattatatataacacttagaactttagagagaggttcaaatgagtcttcaaagcaatagattatgttactactcctacctccatgtataaataaataaaactaatctataaagcataaaacctaaatatatgctaaaattaaaactgcttctatctagttttttctgaagtcagatttctgaatacatttattaagactcactttccctacttttgggaacacatttttctgcatgtgttcagcttatatactgaatcatcactcctgcctagatggcatgagtgtcttgagaattaatccagaatattttgttagtaaggtctttatcattggcagtgagggagacaataaccttgttgttctgtccctgagaattatgcctcttagtctttccccttctctaaaagtccaaataaactaaatgcctacaaagacaaaacaaaaacacagaaaagttcgtgtttttaaaggtactggaggaagagatgggggtttgggaagactttgtaaaattcagtttcaaaattttttggcaaaaatacttcacaggttgtgccatatgcttcatactgcattgcatcagaaggcgtctaatgtttgtcccaccttttttgattctaaaattgatcactggattgaagtggtcacagcctggtatctcctaagacaaatttactcctccatcattgaaccaatggtttcactcacagatgaatgttgtttgaattcttatttcattagaggtaacaaaatgatgaatttctatttttgccatgcttctcatgctcattagctggaattcctctgtaaaaaattttttgctcatcaactagggctgctttgtcactttgaaaggaaagaaaaaagctcagttctttcctttaaaccaccagtgggagtaagaagttggagcctgaatgtttttgctttattttgttttagggttctctctttttctggtgaatcaatatatacttaggctttcatgtaagcagttatgtttcaatcaattgcagtcatctggacaatggtcgccattcaaactggctcttgtgtctgctcacttgcttttgggcacacgtgggcctcaggcttactttctgcattacctactgcagaccttcctccaaagagcttggcctctttctttggggaatagtattgagaagccccaagtgggaacgagacgtggtcctttcaattgtgttgctattgttttgaggcctttcagtggactgccaggaaattccgtattttgaaaagaaagtaagttcagactgacattcccaaatcaaatttaacataattgaatattaattccttttattaaaacttgtttctcttacactgaaaatctaggttcccaacaatattaacttggatgatcttacaatatgtaaacaattgtttcaaaatgacatcattattactgctcataataaaagcttgaagtttattattttttggtagctctatttgtctttaggataagttccactaaagaagtacagctgaaatacagtggtttcctctgtaatatgtcaacaacttaatattcagacatgttatttagtttatttttggtttttagaaattgctcttttctttttgaattaatattatttttgactgtgttaaatatttttaattccaaagtcaaaactgtgtaagaagttgaattaagagaagtcttacttctatgattgtctttttttaatatatatatattttctttttactatacttttagggtacatgtgcacaacgtgcaggtttgttacatatatatacatgtgccatgttggtgtgctgtacccattaactcttcatttaatattaggtatacctcctaatgctatccctcccccaacgtctatgattgtcttttatacactatatgatccttcccataggttaaatttttaaatttctagtttatccttccagtatttatttttgcaaacaaaagcctacatacatatacatatttccccatccccatccataattattatacaaattattacacaaaagggcagttttctctctatatatgtcttagtccaattctgatgctataaagtaatgcccaaggctgggtaatttataaagagaaaaggtttatttggctcatggttcttcaggctgtgcaagtagcacggcactggcatctgcatctggtgagggccttcaggctgcttccactcatggtggaaggggagatggagtgtgtagagattacatggcaagagaggaggcaaaaaagaatggggaggtgccagacttctttttttttttttttttttaaacaaccagctcttatgggaattaatagaacaagaacttactcactcccctgatcctagagaggatatcaatctattcatgagtgacttgccccccatgacccaaacacctcccattaagcaccacctccaacactggggatcaaatttcaacatgagatttggaggggtcaaaaaaaccaaaccttatggggtatgtgtattttttctaccctttttttcttttttctttctttctttttttttttttgagacagagttttgctcttgttgcccaggcagaagtgcaacggcgtgatctcagctcactgcaacctcgacctcccaggttcaagcaattctgttgcctcagcctcccaagtagctgggattacaaggatacgccaccatgcccagctaattttgtattttcagtagagacggggtttctccatgttggtcaggctggtcttgaactcctgacctcaggtgatccacccaccttggcctcccaaagtgctgggatgacaggtgtgagccaccacgcccagcctaccctttactttttaaaagtatcagtatatcactccccatcagtatgtagagaatttcttcattccttttcacaactgaatattatgcagatatactatattttattcaatcagttccgtattgatagacatgtgtttccactcttactactaaaaataatgccacaaaagataagtttgtataaatgtcattttgtttttttccagtttaactttgggataaaatcctaggagtgggaatgcagagtgcaaagggtaaagtgtgtatgtaattttactagatattgccaaattcctctccagaggtggcgcaccattttgcattctcttcagtggtatttgatcggtccaggctcactattagaatatgttaatgagcttctggatttttttttttttttgcaaaccttataaataaaaagtggtatgccagtaaagtttcaatttacatttctcttctgaatgaaactgagcattttccattttcctcctagattcttaggaagcctttgtatctgcgatataagttactttctccttctttgtcatgttgtttaactttgcactttctttttaaaacctgcagtaaattttaaatcttttcattcagtgcttctggttttcaaatcacatacagaaagaatctcccgagtcagagggtgtgaccacagtctgttctagtgcttctatggcttcatctttcacatttgaatctctgacgtagttggaatttattctggtctataaggatccaactttattttaagaacaaaatttttttaacaaatgttaaacttaactcctaaaggcagattattactgggaccatgtgtgacttgcatgtctatttttccttaggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacataatgatttttatctttgtattgctaaagtaatttataagacacatatagaaactatgttgacttcttttgttactctcagttttatgtcttggctaggaacttaagtgccagtgttggcctcattgcataggtttctctaattttttaagctttagttatttaatcatttaatagttctttcaccactctaggaaccttccatccccacttcacaaagctattataagaactagaaaagaatgtaaagcattttggaaagtatggtgtggatgatgaatgcagttattatctcatataaaactgagaggaaccagcatagccaaccacaattgacaatttcatgggtgactttcagtttcatgagtgtgaaaagtttgacttattccataatgttattattattatttttttagacggagtgtcactctgtcgccaggctggagtgcagtggtgcaatctcggctcactgcaacctctgcctcctgggttcaagcgattctcctgcttcagcctcctgagtagctgggactataggcatgcgtcaccactccccgctaatgtttgtatttttaatagagacggggttttaccatgttggccaggatggtctcaatctcttgaccttgtgataagaccgcctcggcctcccaaagtgctgggattatagacatgaatcactgcaccaggcaagacttattccataatgttacttctaagcctactttcttaataggtaggattcagagattataacatgaacaacaataataatatgaagataactgttagactcaagagtcaaagacttatagcaggttgttaggaagaaaactagaattttatggaacaaaagttgagcttcataatcagtttaggaatgaaggtgcattactaattttaaattggccaggttgactttaagagacaggtaaaaacaagaagatagggttacacatccatttaacaacccttgtgcaacacttattgatgtatgaatataaacatattgacataaatggtttaaggcaatctaagctgtaaacaaaattagtattaaagggggctcaaactgaataaggtgagtcagcagaactagcatcttgggatgacacagagacagatactaaacgattcattcattcatttcttactctgactttattcagctgtgtttcagatgctgttctagagacagtgacaaacagatcagatgtggcctttcctctctggtagaggcaataagcaggaaatcaaacagacaagtaagcaggcaagtgctgtgcagtcagaaaaatgggtgacaatgcgacgagcacactggggcctgagggccgccaggagactacggccaccctcaacggcctggattaacagcagatccagaccggtgcctgtggagcagacgcactgtgggcttgctgtgcatgtcgcttctcaactctgctctggctgcagaatcccaagaaaaaaatgaaaatcagaatgactgattgaagcttttttcttaagtggaagttgtacttatttctactgattttataatttttaaaatatggctagcatggaacttgttcagccctgaaatttcatgatgttctagatgggaagttttaattccataaaaaagtgataaatgtccttatagcaaacactcttcacaatataatgtactaaaaaacagatgttctgtttggcttcaaaaattacactataattactaacacacatatacactaaagaagtcctggtctagccatgatctaaaaatattaatggtgtgtcttgtctttgtatatatatacaaggaacagtataattttgagatttggcttattatcaataagaatattataagcagcactaaagaaattatttagtgaaagacatacagaacctggtataatgaaataactacaccaggaaccaagagacttgggagcccatcttgttcttcaataattatgcagtcattttacttctttgggattcatttgattca

SEQ ID NO: 11945 - DNA, 86439 bp, Human
tagctgaagtaagtttcagcactcaaagttatcaagaaaactcttctatccaggatgacttgtagagttgcaaatgattgagattttattgtaaacagcagtttagttttatactattattagtacttagcttatttatattgtgagttaagtaactttctgtgggcttatcaggagaactagccaaactttattatgttgattgtatgagaaaatgcatttttacattccaatcaagtgactcaaaaatactactcagttgaaccatgtgaaattgttgattgatattcaaccatttttgacaaaaatggcagtttattttgaaatgcagtcctgttgacaagatggaaattacctacacattgatttattaattttatatttaatacattcatgtatccttcaagatgctaatcctacaccttaaggatattgggtaaatcacagaattttgaagaaaatttgtgtggaatattggggctttcttgggtccaacccattttttttccacttaatcagagatggagcagacatgaggactctggaattttttattttttgaactgataatagaatgaaaatgcagattcatttgttctattttaggccccaaattaaccattctattttgaagattaagtttaataataatagtaatagcaaacatttattaagtgcatgctacatgctaagtactgttctaactctgcaactgttttatctgcaaagtactattattatccctacttactgatgaggaaactaaagtttaagtaacttgttccaggttatacagctagtaagtggcagagttggcattagaatcactcagtcctactaccgtgtttactgtttacctcaagcacatggttttaccacagtaaagcactcatgctaaaagattatgattcaattcagcaaatatatatttaagctatgattattagtgaagccagacccattcacatatgaaacatattgtattattatcagagaccattataagacagtagaggaccaggtaccaaaattagtcttatagaccacaagtgctataggaatctcagaagaggagaaaataattgtgtactttgtcatgactaactcccagaagagcattgacaaatagtacctcagtattggatgcacagcattttgggaacaaaccaaaattacatcataaatagcaatgtggcaaaatcatgaatgtgtaataatgaagtccaatggggagcagcaaactcaaggttttctttctttctttctttctttctttctttctttctttctctttctctttctctttctctttctttcttcttttttttttttttttttacagagttttgctcttgttgcccaggctggagtgcagtggtgcgacctcagctcactgcaacctctgcctcccaggttcaggcgattctcctacctcagcctccccagtagctgggattataggcaccccccaccaccacacccggctaattttgtatttttagtagagatggggtttcaccatgttggtcaggctggtttcgaactcctgacctcaggtgatccgcccacctcggcctcccaaagtgctgggattacaggcgtgagccactgctcccagccaaattcaaggttttctgttcaattttctgttcaactcaaattctgagtgagcatcctcagtatgtgtgggaagttagaaatttgtggctaggctctctgaatcccagaaatatatgaagaaatgggacctgatggattatttattagatattcagggtggaagaaatgggattcagaaattaaccaaaatgtcatgcctacatgattggaataataatggtatcaaaaataaaatggtttgtacagtggaggggaagatgggctcaggctttagacacatcaaacttaaggtacaggtagactgtctatggaaagctggttttttatgttggctatgactgagtggggtcaacctttgactaatgtacttgtaatttttacagatggccctattgaatttcttcttccctgatgaaaagccatactctgaagaagaaagtaggcgtgttcgccgcaataaaagaagcaaaagcaatgaaggagcagatggtaagtctactcagttgatcctttatcacttctgaattatttgttagtaaaagtatccttttaagaactaccttcttggtagggcatggtggctcacgcctgtaatcctagcactttgggaggcccacgcgggcagatcacttgaggtgaggaattcaaaaccagcctggccaacatggtgaaaccctgtctctactaaaaatacaaaaaaaattagccgggcctagtcccagctgcttgggagactaaggcaggagaatcgcttgaaactgggaggtagaggttgcagtgagctgagactgtgccactgcactccagcctgggtgacagtgcgagactccatctcaaaaaacaaaaacaaacaaaaaaaaacactaccttttcaagtgtgcttcatcatcttatatactgtccaccacagacccaaggtcatagactatttctgcagcctaacctaccaatcagtcctttaacatagaactaactatacaaggatcctccctcctccaactccagataccttcagtcctttctcagtatgtctgagagccatgatagcatttgtatctctcaaaatcaccctctataagggcctcatctctcccggagatgtcccacacctattaaggtcaacaggaggatttggttctattcttggaattgacagtgttgtaccctgctagcacttacatgatgtgttaattccaatgataattttatcaatgttggtatccactaccatgcccaaatctgaactagaccttctagaactagtttataagtttcttgtgggcagagatttcatttctctttgtataagcctagaatctagcctactatctggaacattgttggtgattgttatgtaagttgatgatgttgactgccccttcagctaggcagtgatgtatcaatggaaaccatccctgttctgggtgtaatagctttgagttaactagcaatgcattctgtggggcataacaaaatgttgagctagctcctgggcagggtctttgaattgctctgatatttcagcatcactctgtcaattgacataatgctacccctttgggcacaggggtttgtagaatacatagctctgggctgctgcaaaggcatctggattcaaagacagcatgtgtctggctacatctgccaataatatgtgtctggagggttacaaagcaatatgactttatacagatgaaaatgaaaattttaaactgacatttgttgatgtgagtaagggccactgatggaagcagttttagagggcggaagctattaaagagatggagccaggactttgtcagtaggggcaataagaagtataactggctgaaatctgagaaagagctcagaacaaggaccccataataataccaaaaaaaaaaaaaaaaagagccagagcagtaagatagggttttctagtcagtggaggtggcagcagcattgagcctttgaatggagaactggaccagtggggccattctctagagaagtcattttgcatacaattgatgaccaattcaagcctaagaaatgcagtccatgtagtaaaagttacccattattcacctactacttgtagccagtttcccagaagtcttctggctatgtggaagcagggagctaagaagcatggaccctttcctctcctaatcatctcaccctctgatacatgtaagtctctccaccttcagcttttcccctgaggctactcccacaaccatcaaacttttcataatccctggttgcaaaggaagagaggagacaggtggtaagagcaatatcaccttctatagtgggcgtggtcttccctccctctctgagtggtaagtctaatggcttctaaggtttacctcttcatctaacctcccaagttttctcttaaagaaaataatttcctcctttccctaaaactactttatccaaattcagctaccaacgtctctgataccgatcttccttagaatgtttattctgtcctaatacaaaacagttttctctctggtcaaggtcaaagcctctcattaatttttagcacttcttatatacttccctcctgatctgatactctagtcagtcactagactctagtctcttggtgccaatgccaagtttctcatgcagtccaggcatttttctttaatcagtatagcttggaggaatccaagagtcccttagagttaggagtatagaatgcctgggggtccttgaattttattagatttccaacttttcacctggtggtctgtagaaccatttctttagatgtggcagatgctccaatgagttaaagagtggtaagtcaatccaaatctccttttcctttgaaccattcttgttactctgatgagcgtatactatatttattcaatacactcatcaaatatttactaagtaaatacagcagtttatatagtacttgaataaacattcaataaggattttttttaatattcccactgcctagaaacagacttggcacctagtagaccctcaataaatatgtcctgttgccctcaaagtgatttacttccagcataaagaggcagacaataaataaagttggttaaatttgataagtggtatgaagaaaaatatagctgagcaacagggagagagagtgatggggtatgctgtaagatgatcaaggaaggtatctctgataagggaacatttgggaagagacctgaatgaaatgaagtaagagctatgcaaatgtctggggaaaaaagaagcagaaaattcaaaggctctgaagcagaagaatgtttggtatgttccagaaagatcagtgtggctgggagcagagtaagaagaggaagagggaaggagatgagttaagaaagcaaaatccaatctagagccttgttggccaaggtaaggactctggcttttattctgcatgaaatggaggaccactggaggattttgagcagaggaatgacaggatctgatgtatgttttaacagcattcctctggctgctgtattgaaaataggtgcaggaagaaaggatacaagcaggaagaatctttaggagagtattacaataatccaggcaagagatgatggtggcttagaccaggatggaagcagtgtgggtggggagaagtggtcagattttagagagattttgaaggaatggctgaaggatttttcagattgattagataagggatatgacagacagagaagaggcatcagtgaccccagggttttggacttcaggaactaaacaggtagaattgccatttctgagatgaggaagcaaaggagagaagcagtgtagaggaatatggggaaagagtttagttaggcttgttaaatttgaggtagctattaaacagccaagtggatatataagtctacactaaacatcactgtgtatcatgaaaataagatgactctcttttgtacaaaggacttgtcattgaagaagtgagtcagtctggaaactgctctgaacagaataagaggtaggatgggataggtaaatcatagtggggtgagttatggccaaaaaaaaaatcttatcaggtgttgattataaattcacaaattacttgatatgttataataaaaatttaactatctaagctcaggtttgcctcacaagtgtcaaagaacaagtcatttaccttgaagagttaagaacatggcagaagttcgtgaccagcctgggcaacatggtgaaaccccgtctctaccaaaaatacaaaaaaaaaaaaatagcggggcactgtggcacacacctgtagtcccagctactcaggaggctgaggtaggagaattgcttgagcccaagaggcagaggttgcagtgagccaagatcgtgccactgcacttcagcctaggcaacagagtgaaactccatccaaaaaaagaaaaaaaaagaaagaaagaaagaaagaaaaagaaagtctagaccctacttcatttgtttggtcattcatcatttaacaaatgttttttacaggtgcccgccacaacacccagctaatttttgtatttttagtagagactgggtttcactatgttggccaggctggtctcgaactgctgacgttgagtgatccgcccacctcagcctcccaaagtgctgggattacaggggtaagccactgcatccagcctagactttctttctaggaactatagatattaagcttaatgatctccacaaatccctgtgagagaaaaaaatttttataaacagttcattaactcttggaaacggaagggatgtagtgatccttaggagctgcataggttcaccaagaacaaatcaggctgcagaagcctattttcctgttttcatcagactattaaactagttgattagaggcatagcatacacatagtctatcttgccttttaaaaagaaagtcagtggcaatatccagggtatatacaatctttctgactcaccattcaagaatgactaggttcatctcagtttctccattcaaattactttataaatgaaagcattggctagctaagcaggagtctcaaacacatggttagtttcaactcttagaaaagaagtgaatttcgttttctttactacatttcttccttgaattcactgacttgagttggccagaagtatttcagatcgtttaagtttattcgtactaattatgtgaggcctttggttgttgttcttcttcaaagaaagtatgataccttcactgtgggtgttgagtcacaacagttctagaaatctgtgccaggatttcttgctgtgtcttatctttgtgatgtgtttctgaagtaataatagctccaggtggcttgtttggtcatctcttgcacagcactccagaaatccacagaactttattttctagttagaatgaaatgtagaatgtatttgggaggtcatgaggccttagaatcaggtaaaatgaatccagaattcccaaggaggtagtttccatatttcacaaatattattgtaaaaacatctgttctcttccgataggagcattttcaggagttaataaaaatcttaatatctctccacacctgcctgccttccatgtttccgtcctggtaagagaataaaattgcagcatggtgtaatagaagaggtactagactgagctgcaatttcttgattccaatcttgatgtcactgccaccttaccagccatgtgaacttggagaagtcacgtacttctaagcttcagttttcttgtccttaaaacagggataattagccctgcttacctcatagagttgttgtgtttatcaaaagtgttaatgtctgcaaaagtacctcattttattttattttatttttgagagggaatctcgctctgtcacgcaggctggagtgcagtggtgcaatctcagctcactgcaatctccgcctcctgggttcaagtaattctcctgcctcagcctcccaagtagctgggattacaggcacccgccaccacacctggctaacttttatattttagtagaggcagggtttcaccttgttggccaggctgatctcaaactcctgacctcaaatgatcctcacgcctcggcctcccaaagtgctgggatcacaggcacgagccactgcacctggcctacaaaaatacttcaaaaattattaagtgctattactatgctctctctggaaaatgaacacactagtatggtgtgccaggcatttggggcattcacattccctaatttatggacaacaattataatttcttcagaaatgctctctatcagccaaattgcccatttttgttctcactcatgctatccaagcccataggaagaagactccaagcctcacactatggcctacctcatcacagcaaatgatcacatctgcacattgctctgtggcactatctcactctggctggctggctgtatatatgtatccctttttgttagtatttcagaaatttctcttccttgtagtttacttttggacatatcaaaaaacttagtattcttttctactattataaaagagtagagggaaaaacaagattgaaatatatcctttgtacttcaatttttaaaaataataatggaatggggcatagctactattaaattgatacagatgaacatgagagtctatgatgtcaaagaaaacagactttctgcccgtacaaatgttagctagaattaagaattgccctcattttagtactgctcttgtatttattgctttcagtgagccatcactgtggattatcaaatgagagagtaaaatcattttgagagcgatagagtttcaggggcttgttcacaagacaaaagtaaagcttttgaaggctcaccatgtgtgtggactcgaagaggattgttgatttcacatgtagaatccccaaggttgcctgctggtagtgggtgccaacagcttaagtgcccacagcagaacactctggagagtggctttgtatcaaataagacattaagtaagctaaaatatctagcttgctcatactccaaaatatcctttaaaactgtattttcattgatggaactagccctgcagtaaatgatctcaacaggccatcaccactaacacttggttaacaagcatttttagaataccaactgcttgtaagacgttgtaccaggttctgtaattggtatagctaccaaactcctgtacttagtatgtaaggcctaaattgaattgggtatagaggttaaagattaagatgcttaaaatatttatgggattttttaaattacaaaaatgatacatatattataacaaatatgagcaatacagaatcaggaaaggtataatgtgaacatgccctccccacccactgccccgctacaatactgcttataaagttaagacatctttgaggaatatctcacttgcctaaaggaagtcataggcccacctgacctgatgttctctaaaggtccttcctgtctactcagtctctctaaagttccttctagttatttttttctcaatattagggaaattggtgaactctaagccaggagatctagattctaattccagctctgccattagtagttatagtagcaggatgaccttaggaaagtcttacttcacttctctgatcttagtctcttctaaagggttaaactagaatcagtgattctcaactggattgtaagagatccaaaagcatataaggagtttttttttgaagcatgcatactcctgggaattctgaccactctacaccccattaagaaaactatactgaggaaggtactattactgatgagagcatatcatatccttcagatgtattaggataagaaaagatgttgaactactagaatagatggttgaattgtttccttccaactctgatataacttgttactaactattcctgacttctataatataatgataatagctaggctagttttagccaatcagatgatgtctatgtctagatgattaaatactaagggtttcaatttggatggtcagtgagccttttcattagcatccctgagaacgctcaataaggattaagtgcatgcaaatggtttcatgaagtgaaggctaagaaggttaatctgttggctgagtggtgaactgctagctcacttctgtatggctcctcaaaatatcacaggcagatatagatgtgcggtcagaaggcacctgttggctctgtagtgtattacttacacaaccctgccttaccctagattctactccttgacctgtagggcctcttcagtctcaaagataaggaactactacagcttccttttttaaaaaactcattcattcagtaaatgtttattaagtaccaaactagttgttaaatcaatgtttattgatcacccttccagacactaagggcacagtagtgaacaagataagaccctaccctaatcaaactcactgtggatgatttcaatacagtgtagtgaccatataatggggtaagcacagggtgctatgggacacactggcacctgatctagacttgggaggacagggaatgtctcctaataagtgtaacatctgagctgcaaactgatggatgctatagttagccaaatgaagatttgagggaagtgtgcaccaggcagagagaatatacatgttggaaggcttagagtaaagagggagcatggctcatttaaggaactaaaagaagtttgtaagggtgtaggataaagatctaaagtgaaaatgatcataaatgagctggccaagaggggtcaaatcacgcagggctttggaatccattttatggaatttagaaactatcctaaaggcaatggggaagtacaggatcaatgtcaagaatagattatatggcaaatatcttcaaatgctaaacacacatactgtaatccagcaattccacttctatttatagatatactaacatactggaaatcatttatcaatgaagatattctttgctgtactatttataatagcagagaattagaaatacatgtccattatttaggaactcattaaatatgataaatctgtaactggtcatcatggttgctctgaggaagaaaactgagtgtttggggctgaggtgaggagggagttgactagttgaacatgtgcatgttctaccagtttaaaataaacagataaaatttaattttaaaaatagtctggacacggtggcttacgcctgtaatcccagcactttgggaggccaaggtgagaagatggcttgaggccaggagtttgaaaccagtctggacaacatagtgagactgcatctctacaaaaattttttttattagcgaattgtggtggcatgcacctgtagtcccagctgcatgggaggctaaggtgggaggattgcttgagcctaggagttcaaggctgcagtgagctatgattgagcctctgctctccagcctgggtgacagtacaagaccgtttctcaaaaaaataaaaataaataaaatggtcatgatatgccattttctactcattacctaaatacattagcaacaattttataatacattaacatcctattataattaggggtggaaaaactcatatattgctggaaagaatgtaaattgttataaccattttggattttaatctctctggtaaagttaaacattaggatacctgtgatccagcattcactgtcttgggaatctagcctacaaaaataagaattcagccgggtgcagtggctcacgcctgtaatcccaacactttgggaggccgaggcaggtggatcacctgaggtcaggagttcgagaccagcctggctaacatggtgaaaccccgtctctactaaaaatacaaaaattagccaggtgtggtggcatggcctgtaaccccagctactagggaggctgaggcaggagaattgcttgtacccgggaggtggaggttgcagtgagccaagatcgcaccactgcagcctgggcgaaagagtgagactccatctcaaaaaaaaaaaaaaaaatgagaattctagtatataggtcatacataaaaggatatttattatatcactgttttgttgccaaaaggagggataactctaatatctatgaataagaaaatggtaaaataaactacgacatagacatactattgaatattatgtatattattattcagtgtaataataatggtaatattattactattaaaaggaatgagttctatgtagttctgtgtaatggtctgaagtagccatgttctattgctaggtttaaaaatgcaagttttagagtaatgtgtataatatgatcccattttcatagagaaagattttaacatatattttttattttatatgtaaacatatataaaatattttataaatattataggtgtgtgtgtgtatatatatatatataaacataggaacagatgtgggaaagggaagcatcagtgaatatcgattaccttgggtggaagagggttggatgggaagggaataactattaaatggttctttatgtagttctatatgtttgatttgttacaataacatgtgtaactgtaatttataagaatataaaaagtggttaaagtggatagaaaataatggacgtgagagggcataatgaagacaaagaagggaggagattgctgtaatgatacacaaaaggaatgacagtggctgaattaaagtaacagcaataaagacagaagtagatagatttgagttcctaggtagaaaaaataggacttggtgatttgattgaagggagaaaaagaagagtcaaggaagccacccaggtttctggcaaggtactatactagtcactgatataatgatcggggaagaagatgtgtggttttggacaggttgagtttcaggtaccagtgggaaattcaaggaggagaaacctgtaagcagtccaagatatgcatctgaagctcaagagagatagctggtctgaaaatatagatatggagataattagctacattaggactctctcagttacaagtgacagatagctggcctaaattggcttaagattttagaaaagaaggagggggaggatttattgcctcatttaactgcaaagtccttcatgaagctggcttaaaacatggcttaaccttagggcttaaatgatatcatcaggactttctccgctctgctttcctttgtattggcctcattcttcatgtaggttctcactatgaggtgacaaaaatagctactagaagctctagacttacatcttaccaattcaacaagcccagtggaaagaggatgccttattcagtaagaaagatgttggcaacgctggtgagagcagttttagtacagtagttggggcagaagggttcatgatgaaaccagatgaggaattagaaaacagcaaatataaacaaaagagaggaggagaagagaggaatagctagagattcattaagcatctattatgtggaagacactgtgttatattacacccggggacacaaagatgcataaaatatggggttttttttaagctctggaagcccacagccttcagaaaagagaaaatcttataagtaattcacaaaggtgatagataagtacttacatagaagtatgataagactgtcatgggagcatagaggagggaaccacagaatggtcaaccaaatacattaaatacatctctgaggagaagtgcataatggctggcacatactaggcatgcatatatgacgaattaggtgacaattatgttttggaaggtgaatgggactttgatgaagaaagctagacaacccatttctaacaaagggaacagcaagtacaaagctaaccaatcccctaggtttgctggctttcctctcggcatgaggcttagaataagggctgagagaaagccaaaactgttgggcagagaaaatgtgacaagaggccaaaatagcctaagggggccttcaaatgcccattcaggtacttaataagtggcctttcaatcccaaattatcttagcatcttccctacctcactatttctctccgctagcctccatacacagaaataaatgttagcaaggcaagcacaattcttccttgctaataaatataaaatgtaagccatgtataatggttcttaacactggtagcagttttaatttctctgatcttctactataccaatatctggtgcaaggcagcaaaatacatttagtaccttgatgtaatttagaagcaatgattgatcctaccttccttgtgtaagactcttagctgacttagagaacataagtcctatgtaattaacatgttcacaaatgtagagagagctgtttttgaaatggtgaagtaccaaggacgctttgctgtaagcttatgaatcttggctgcattttaccactgcttccagcatgtagctcctttaatgaacctagtactctggtgcattaagtcacttgtttagggtctagtcacgctgaattctatatactgcgagccagaggtctaatcaacctatgctctttgtcacatggtatactggaaagaagaggtctttgtgcagatctattctccctatagcacaacaagtcgtgggcctggcctgctgccagaaagttagtagtgtcatctgtgtagatgaaattcagcaactcattatcttacattgtgccagaagagtgggaagaagattgacttggtaatttgctatgtttcgatcctaatctgtttagaaatatgatttctttaaaaggaaatggaaaagaatgtgtttctcatgatagcttcacagtatctcctgagaggatgttcagttattgtaaatacagcaatttaattctctccttgaatttcagatgtatttcatctctttaaaaaataaatgtgttgaaatgatcagattataaagtatgaattgtatacttccaaaagtggaattttatatttcagattacacaaaaaaacttttttcatgagtcataaagttattggtttgtatactatgttatttttatacatcatctccaaaactctttaaaaataagtttacattgtaacctatttaaaggagaaaggcatatttgcggtacacatattttatctcagagtcatttcagcattttgagtctaattcattcttcccaccctgtagcatagtatgcaaaatccagaagctatcagaagcaaggcccaaatttagtgtagtaaagcttctagtacatgggtgaaatacacacataagaaagaaaaaagaacaaggccaggtgtggtggctcacacctgtattcccagtactttgggagaccaaggcaggaggatctcttgaggccaggaacttgagaccagccggggaacatagcaagacccccatctcaaaaaaaattttttttaattggccaagctgggtggtacacatgtgtagtcccagctacttgagaggttgaggcaggaggatcacttgagcccaggagtttgaggctgcagtgagctatgactgcaccactgcacttgaacttgggcaacaaagtgatgacctgtctcaaaaagaaaaagaaagaaagaaaaaattcagttgatatcaagtttctgacccttagtttctctctgagacagtttggagtaaggaaagagcataagatttaaaatcacacaaatcctagctctactacttttagctttgtggccttggccaagtcatgtaacctctctcaagctaacttttctcattatataatgatagtaatgatacttcctttgataagactttataaggactagagataaattaaaatgcctaaaccattgcaggcaacataacaggtgctcaataattggtaattattagtatcaactgtaaaatgagaatagtactaatttatttctcaggttatgagtcgaatgaatgagaatgctttttttttcaagcaccttaatctcttagctatttcgtagttgaaaagaagttatcctgcttatctcacaggattgtgatgatcaaaaaggataataaatgctaaaacacctagaaaaacataaagtgctgctcaacattgggaccaagcttccctgtatactgaacatctcactatatggtccagaacgggatcttcatggtgattcttagtcctcaatagacagctgtatctagcgtgataagacagggaagtctcaaaacactttacaaagatttctgtcaggtttcaaagtttgctgtcaacgaagtagaccttaattacccagaaaactcatttctgtggaactccttatatggagccaaggaagcaaggtgttaaactgtgcataactcttattaggtgaggactatatagcattgtaattagaaagaaatctgaggtatagtgttcaagccaactctataaatgccgtcttaaagattatataatgtattctaaaatatttcatatggatttctaaagaattgaataacaatcaaatatgctaaacataaaaatgactcaggacacagtttaataattcctgatgccaaatatatatcagaatctgtaggaccttaacaatattatttatgaatataaattattgatcaaaactgtacaagtaaatgttgaagactggaccaaacctgatctgggttgaagtcctgagctccctcactcactcgtcctctaatttggaactagtcagcctccatgtcatttcactgattgctgtagaaggtcaaatgaattgatgtctgtgcaaatgctatgcaaactgtaaaatgatgtacaaatgtgaagtattatttatcataaaagttgaatacagaaaaatggtttgaaacagtttattaacttgggaatgtcaaataaataagagattatgagaaaaccaaagtcctggttatgtttagtatatcatgcaacattgccatggggtggcaaccatagcaacaaagtaagtaatcttttccaccagacatttctggttacagcctcttgtttgactcaagccagtccccctccttgactgcctttttacctcctcacttttgatccttattcatccttccaagatccagctgtaggcttcatagcctttaagaggccttgataaacctctatccagatagctcatcttagtttacattcttccacgtgcatgcttaagatacttataatttctaggcctttttcatgtgcttctcgcgtcttcacagctatgtaacaagccaaaagaggttagagattccttctatctcggtgtggcaactagcataatgcaaacagttaagtacttaatgaatatttgtagattgaaagaaaacatgctgcaggcccaatgctaaagcatacccttctttcaaaaaagaaaactatatttgaaagagcttaagagatggtcagtagacaatgcagttgtctatgaagccacagtgagttatatatataaaatggcaactaattggtaacttattgggagatcaagggaagaagttgttgtaaatatttgttcatgagggagaagccttcaggctctttccagttctatccctgtaccacagtaatgatactgtgcacaaatggcttcctcaaagggctatactgtgtaatatacataatgttccattttcacatttaaatgtaagttaagaaacaaaattacattgtaatttatcatcacatatttattatctccccttcttctcccaaattttatgatttttctgattgctaaggtatagtgtggcactcttcaccatttattggcataatacagagcttagataacattcacatgcagaacaccctccctggagcccttggggttctgtagatttttctagcacgatggctgtaactaggcccccttttcttcttgctcaagaaagcctatcagaatgtgaataagagtgacactatcatagaaataacatttgttccagtttttatttaagtaaattattaatgaccttcaggacttcgttagtaacaaaatgtttgcagtacacttcaataccacagttgcagtcactggggcagtaaaatggactttggtttcacatttaaggacctgggttcaagttgtaagtctgccacttattttctatgaaactttgaacatgcttcttgatctctcagcctcagttcctataaaatggcaataacagtaatacatcactgggatgatatggggattaaatacaatgttatttgaaaaaccaatttttaaaatgtaaagccctgggcaaatctgagttctgtatccccttatgcacccatgtaattctcctttctgtcattgccatgcccttggtttaggccttccaactacctattgctttgtctccttccttaccttatatgaattcctcatccccttttccttcaaaatcattctcttgtagttgatccaactaacagtcacagattcattttcttttccatttgaattagctataactaactaagctaatctaagctaatctaagctaatctaagccctaactcctagaggttgttcttaattatgaacttgcatgcagtctgggacagaaaaacagaaaactccttacttattttagagttttcaatcttttcctccacccccagataatgtttttatatacaccaaaagtcaagctcttctcttgccttcccaatacctccagtgtatacccacacatagcccagtgctgaaagacagcttagggaatgcagaggaaagggactgaccaccaaaaacaagacaaggatcttgtgggaagacaggacccaagttctctagatggctgaactacaacctcaaatgtcttagcattctcaaaatttgtatgggaaccttcagcagtagggcctggctatacctactgctactgttccaagctctaacaccacgtggtccagtccagtagagcaaacaaagattgtaaaactaggaccagctgccacttacagtgtttcttgggccttcacaagcagctccactccttgcccattgctcctcctactggttctgatccatattggaactccctctaacttgcattgccttctccctcattccctagttgtcccagttggatgagaattgtgagttcctagatctctctcaaaagacattcttccatatatacgacaggagacttatacagcgtcaaaatctaacaacccaaatgcccatcaacagaatagtgtatggataaactacgatatattcatacaatgaaatattaaacagcaaccaaaccaatgaactgtagcaacagttatgaatatgagtgaatcttaccaatataatgttaagcttataaaaagtaaatcccctatgttgaatttgccaacaaaagaaaaaactatgtttgtattaaacgtatttaagaagcaagtcatctcggacctgtaataaagacaaacctaatttaatattgaaaagactaagtcctaaaatattaaatgtagcataataacctttgtaagttacaaacaactaactttaaatatatatatatatattaggaatatatacaaatgtgatataattatatgaaaaggaaattgagggaatgaatgaacacaggattcaggataaagattacttgaaaaaaaaagattacttgagtgggtaaattgtagggagatgagagtgagaaggaaatatatggttgaatgtaagtttttaacaaagtcctagcttttgctttgggtgactgttttacaagtgcttattacattattttattaaagctaaataaatacaaaaataagcaatgggggaaaggagtcactattcaataataatgctgggataactgactgtccaaaataatgaaatatgtagaagaatgaaactggacccctacccatcaccatatacaaaaattaactcaagattgattaaagacttaaatataagacctcagactgtaagaatcctaaacaaaaaccgaggaaacaccattctggacatcagctttgggaaagaatgtatgactaagttatcaaaaacaattgtaacaaaaacaaaaattaagtgggacctaattaaactaaagagcttctgcacagcaaaataaatttcaacagagcaaacagacaacctacaaatatttgcaaactatacatctgacaaaggtctgatatccagaatctataaggaacttaagtttgtctttattacaggtccaagatgacttgcttcttaaatacgtttaatacaaacatagaacaaggaaattgaacaagcagaaaacaaataaccccctttaaaaatgggcaaaagatatgaacagacacttctcaaaagaagatatacaagtggccaagaaacatgaaaaaatgttcggcatcactaatcattagagaaatgcaaatcaaaatcacaatgagaaaccatctcacaccagtcagaatggcttttattaaaaagtcaaaaaataacaaatgctagtgaggttgtggagaaaatggaacacttatgcactgttggtgggaatgtaaactagttcaaccactgtggaaagcagtttggagattgctcaaagaactaaaagtagaactaccatttgacccaacaatcccgttactgggtatatatccaaaagaaaataaaccattctaccaaaaagatgtatgcactcatatgttcatggcagcactcttcacaatagcaaagacatggaatcaacctaggtgcacatcaatggcagattggataaagaaaatgtggttcatatacaccgtggaatataacgcagctataaaaaagaataaaagtatggcctgtacaggtacatggatacagctggaggccattatcctaagcgaattaacacagaaacagaaaaccaaataccacgtgttctcacttgtaagtgggagctaaacatcgggtacatatggacataaagatggcaacaatagacactggggactacacgtggagggagggaaggagggagggagagggcaagggttgaaaaactacattttgggtactatgctcactatctggtgatggaatcaattttgctacaaacctcggcatcacacaacatacccatataacaaacctgcacatgtactccctgaatctaaaataaaagttgaaatttttaaaaaactaaataaataaaagtgggctacacatagaccaatgtgaatgtgctataaatgtaaaatagatttcataatagatttcaaagacttagtaccaaaaaagcaatgtaaaatatctcattaatacacatctatattgattacatgctgaaattaaaatagtttaggtttattgggttacataaaaaaaatctattaaaaattaatttcacctgattctttttacttttttaatatggttaatagaaatttttaaattacctatgtggctcacatttgtgactcacattatgtttctatcagacatagaaacgtgtcatggtggtataagaattctagagcactgctctttatgtgtaaacccagctgttttcaggcttaaagctatttagtttgtctttttaggtttaataattctaatttattttttttcagggcttctgaaaccttaattgaaagttttaataaatacaaaagtaatacatgctccttttaaaacaaaattaaatatcagagaaatttatgatgtaacagaaggaatgtaacaccacaatcttagctcccagatatagacacggttaagaattaagaagactttctaggtatatgtgtttttaaagtattagaatgtgaacatcaaagttatccctattctttctcattttttctgacaccagagaggcaacggaagatcatggctcaatgtttgtgccaagcagagaactaaagtagtggttcccacctctggagttacagtcctctatcgttagctggagtttggaatttttttcctggccaaatctcttcccctcaccccaaaaaagtgccatttggcatatgtttacactaaaagctgaagtgaactaaaattagtgttttgagaatttcctaataccccttgggaaaatatcagagacccaatgggatattgtaagaccagaactaacaatcactatttcagggtattgatttccaacaaagtacctgatcatttctctcagtgggtatgaaccaggcttctgatgggagtgtaatgatttggagaaaacaaggtggatctatttctctataggtttctctctgttcttaggaagaaattcaatggaggtagctgtgacagggggagggggggtggaaaaggggtccaaaggtcagatcttgattatgtgctagatcttgaaacttttcttttcaaattgcctgaggccctataaaaatcattaatatagaaatagctattttttcaagccttggactaagtgccatggaaattacagaagttattttctttgttcacattattgattgacaagttcaaagattttggatacatttcttggaacagacatcaaacagtttgacatttttccttttctattcaatgaaatgaatccttcattcaacatcatatgcttaggaaacacaccaatgaatttttaaatcatattctatattacccctgttcctgcactggttgagacctgtgagagaaaaataatacaaactgctcttttactgctattctgattagaatctctttcctctccttttgcagggaaatggcagacttgaactaggcattccaacgaaggcttttctgaaacactttttaagtcattgttctcagccatcctatctattctaaagtccattatcatttttcttctagcctgaaccccttgacaccacaattctaatgtatttgtctgtttcttttttggtcacatgttcatttgtcttgcttctgccttctcttagattggcagttccttgaggtgagagaccatgtctaggtctaattccaaagtaatataaatctacatggtcagaaaatacttattaacaaaattattacctagaacccatttgccccaaactctacctaggtttattttatgaaattaatgctttcatttaaaaccattaagttcacataacagtaaacttcttcaaagatcacacaaaaagataaattggagctagaaacacaaatgaacagcatggaagagttttggatattaatggcccatgtatatatttttcacatttttagtttgcttttgctatacaaaaatgtgtcctgtttatggagtactgtgtgatcttatttattaaacagaacagtatattagacagatcattcagttggaaatacatctggaattcagatctagttcaaacacgaactagctatgggacttacgtgctcagttttttgggcagaggaaggaaatgacctaacactgatcctgataacctcacaagggtattgacaagatcaatgcatcagaaatatatcagaaagtgttttgtaaactaaataccatataaatatgtgggatgtccttacgtttgcagtttcaacattcaagaagaccattcatttcctgttagcatcccttgtactttgaggatgtggccacaaggtcctttggcctttgtcagtatcatcaaaaatgccagcttttagacacagatgtgatttatttgaaagaattatattagctcacttttatcttttaaaaaattaagacaatattttattaaaataactaaacaggcccagcccagtgaggcacgcctgtaattccagcactttgggagaccaaggtggaaggattgcctgagttcaggagttcgagaccagcctggccaatgtagtgaaactccatctctaaaaaaaaaaaaaaaaaaaaaaaaaaaaaaaaaaaattagctgggtgtggtggtacacgtctgtaatcccagctatttgggtggctgaggcacaagaattgcttgaacccgggaggcggaggttgcagtgagctgaagttgcatcactgcactccatcctgggtgacagagccagaatctgtctcaaaaaaaaaaaaaaaaaagaaagaaagaaaaaaagcagctttctcgagatataattcacatatcatacacttcacccatttatacaattcagtggtttttagaatgttctcagacttgtgcaatcatcaccacaatttattctagaacaatttcatcacctcaaaaagaaaccctttagctattatccctcaattcccctattccctctcccagtcataggcaaccagcaatctactttctatctcaataagtttgcctattcgagacatttcatatcaatggattcatacactacgtggtattttgtgtctggcttctttctcttagcataattttttcaaggtttatccaggttgtaacatatatcaatacttcattccttttttatcatggtaaaatatacataacaaaatttaccattttaaccatttttaagtatacaattcagtggcactgagtatattcataatgttgtgcaaccattgccactgtacatttccagaactttttcctccttccaaaaagaaactctgtgtccatcaaacaataactccccatgaccctgctccctgcagcccctggtcacctctattgtactttctgtatctatgactacctattctagttccctcagataagtggaatcatacaatatttgtccctttgtgtctggcttactttccttagcatataagtcaaggtccatctgcgttatagcatatacagtacttcattcctttttgtggatgaatcatattccatttatgaatatactatattttatccactcatcagttgatgaacacaggttgttcctgctttgggatattatgaataatgctactgtgaacattcatttacaagatttttatggaaatatgtttttatttatcttagctatgtacctagaagtggaattgctgggccaaatgttaactttgtgtcagctttttaaggaaataccagactgttttccaaagtagctacatcattttataatcccaccagtagcagataagggttctaatttgtttgtcttctcatcaacacttgttactatttatctttttgattatatcatagtgggtgtgaagtggtatctcactgtagttttcatttacatttccctgatgaccgatgatgtcaagcatcttttcatgtgattattggccatttgtatattttctttagaggaatgtctatttagatattttgcctagtcttcaagcagattatttgtctttttattattaagttatttatatattctggatcccatctcttataagatatattatttgccaatattttgtctcattctgtggatggccttttcactttattgttggtttcatttgcagcacagagtttttaattttgataaagttcaattcatctattttttttcttttatcacttatatttctcattttttagtgtttctattttctattttttagtgtttctattataacttagaaaagtccaggatctgttttttttactgagaaaacttagaaaaggccagggtatgtttttcactgagattttatatcagtcacaactcaagtggctctgtgatttcactgtgatttcagggctttatagcttctttgaccacaatagtctgcctagctttgccatcttagtttctctcatatttgactctctgaaaaatggtatggtctaatctgggtgacaaggagtcaatatttcttctccctcaccctcctgtaaagaccttccttcccatcttacagttggcagaaatggagtgagactatatcatataggtatgtctgtgccttaacatcgaactaacctgtacatggtctctccaataacagactgcattttgcctacagagatctactatagtaagtattctgtaacacttagctatgatgttggctgttaggccctagcaacctgtgctttttctgaatagcttagttacaaaatactgtagcaaaagaattcgtcggagctgattactataacaatgtgccagaataatacttttacatttaaaaaatctagacctctaagattcctctcagccatgaaattatgttaactttgagcagttaaaattattttataaaaactaacatctgatttacttattctagactaaataagccaagtgctgtaataaagatctcaagctatattctaaaaaattatcattgattacattcctactatgttccaggcactatggtaggcactctaatcctcccatcatctctgcacatgaagtggaagttactctcattttacatatagacacagataacaacctcagatatgttaaataacttgagtagagttacaggtggtgtggaaagataagaacaaaaataaagtcttccttgtcttattttgcccctctgggcaggtgttcattttgtctttttgatgcttccagtatctgtgttgaccttttcttgcctgagccttgggcaggctgggctttctgtagagctacttgactggaagctttttctagccacaagcattccactggggttgtgggggcatctgctcactttactgtctcttggtagaaaagcttaaagtgaatttttaaagtgaaagtttagaatcttagtaaagctataagacatagacccaaccccaaactgctgtctcagtggggttcatctctctttaccgctagatccttttatgtcagtaggataggaccttggacattattgccagtggtatacagtatcactatggtatgactgaaagtttgagtactatttctacactcctgtaccacaaaagcaatctcatactatagaaacaaacctgtactgtagaatagaagagaattgagcaggaaatgtttagtttgcattgcaaacttttttattttttgtttttttctcacttttagcatcttgggcttctattctggggattagagatagtaagtaattataatatcaagatgagatgacaatatcattctttttctgttccaagtgaatgatggctctttggcccataagctgtaacacacataagtaaaggggttaaattgaaggcatgcaagaagcaggaaacaaccactacatggtcacgtgggagaaacattagttgaatacagatataattgttagaagtcagtcacgttctctagaagctttttcagacttactgaataccaactttgtgccctcactttatgtgctttacatcattgaattctcataacaatcctgtgaagttagtattattattctcattttatagacaagaaaactatggctcagaaagattaggtaatttgcccaaagccacacaactagtgagtggcaaatgcagagactgaaccaaagtctttttgactccaaagttctttcaactacactgcctccaaatgacttagcatggtcagatacttgcttttttccttgtagtatccactgttatgatcagcctggtgctagtaatgcagcagcatctgaagcatagtggttggaggagaggggaagggggcgtttaaggaccagaaaatggcatctaagataggacttgtcaagtggagacatgggacctctctcctgaaaccatgaatttaaaattgtattctttacactaagaatcccaacaagtaaaagtcactaatacttacagttgagagtgtgcgtgtggggaaaatgttgctgccgttacttttgagacttagagcagctgctattgcaacctccagggtaccctactcccaccagtcttacttttactttacagtaactgtgaatgtcaaatcttgttttaggcacaaggaacaaagtttccctgccgcttacatctttccccccaagaaacacaaagggctttacaaacccacaaaggagcgttgcatagaaagagaacttggaccataccaagagtgattggtttaacactccacacatttccagtgaaattgggaaaggcatcttgcatgcctttccataaacctactaaatctccatctcttcaagtttccttagactctcttttactatggtttattccctaaattattgctactgtcagaaatcctgttagatatccagaaattcacttttgaggatattgtgtgctctgcagattttttttcttaaaaataaaacagagttcttttacatttgctgaggagagctttacttccaactatgtggtcaattttggaataggtgtggtgtggtgctgaaaaaaatgtatattctgttgatttggggtggagagttctgtagatgtctattaggtccccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgagtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacgtttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcctcagcaaatgtaaaagaacagaaattataacaaactatctctcagaccacagtgcaatcaaactagaactcaggattaagaatctcactcaaagccgctccactacatggaaactgaacaacctgctcctgaatgactactgggtacataacgaaatgaaggcagacataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaacaaactagaaaatctagaagaaatggatacattcctcgacacatacactctcccaagactaaaccaggaagaagttgaatctctgaatagaccaataacaggctctgaaattgtggcaataatcaatagtttaccaaccaaaaagagtccaggaccagatggattcacagccgaattctaccagaggtacaaggaggaactggtaccattccttctgaaactattccaatcaacagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtggacttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattcatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaagcaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctgcaacatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaagtaggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccattattctcagtaaactatcgcaagaacaaaaaaccaaacaccgcatattctcactcataggtgggaattgaacaatgagatcacatggacacaggaaggggaatatcacactctggggactgtggtggggtcgggggagggaggagggatagcattgggagatatacctaatgatagatgacatgttagtgggtgcagcgcaccagcatggcacatgtatacatatgtaactaacctgcacaatgtgcacatgtaccctaaaacttaaagtataataaaaaaaaaaaaattaaaaaaaaaaattttttttttaaaaaataaataaataaaaaaaaaataaaacagagtgacttccatttccaccaaggtggagaaaccccattcctcctatgtcctccctcttacaactaaaataccctgggtataacacaacaaacaaaactgagtggtgggaagaaaaatgaagactgtcttggaacttgaagaacaagtggtcagctccctgggtttcctttttgcctctcacatatcccagacagggcactacagaagcctccaattcataactgccactaagcacagacaaaaaaacactctaagaaaagcctgtttcctgtatccaaaaaaaaaagaggtaaagggtcactttacagcagaaaactttttgaccatacttttcctactccagtgtaacaataacggaaaaagttttaccctccccaccagcctacagcttcagtgggacctacccagaagttaagattctattccatttcttccccccacaaaagcagacagcttgctcttaatccactactagagcattgttggcaggactgagcagacagctcatcgtctctcccccatctgtcagaagcagatggtgctcctattctcctgccagagtagtgtcaacccagtccagtggcaacctaagccaccacacccaccaagcagcaaggagaattaatggctcagtataaggtagggctaattgccagtagatttaaccccccaccatctcatgtcattgctgcccaatgggggtaagaggttgagcttccacccctacctagtatcaaaaagactgaacaaggaactgcatgtcaagactagtaagctcattatgttaagtgaattaagccaggcacagaaagacaaacttcacgtgtcctcacttatttgtgggagctaaaaatcaagacagttgaactaatggagatagagaatagaaggacagttaccagaggctggaaaggataatgaagggctgagaggagagtggggatggttaatgggtacaaaaaatagttagaagaataagacctagtatttaatcatacaacagagggactatagtcaataataatttaactgtacatttttaaataaccaaaagagtataagtggattgtaacacaaaggataaatgcctgaggggatggatacgccatgttccatgacatgattgtttcacattgcgtgcctgtatcaaagtacctcatgtaccccataaatatatacacctactgtgtacccacaaaaattaaaaataaaaattttaaagactagtaagggccagtcgcggtggctcatgcctgtaatcccagcactttgggaggccgaggcgggtggaccacctgaagtcagggattcgagaccagcctggccaacatggtgaaaccccgtctctactaaaaatacaaaaattagccgggcgtggtggcaggcacctgtaatcccagctgttcaggaggctgaggcaggagaattgcttgaacccgggaggtggcggttgcagtgagccaagattgcgccactgcactccagcctgggcaagagagcgagactccatctcaaaaagaaaaaaaattgtttaatttaaaataaaataaaataaaaataaggactttacttttccctcagcccctggtgctagggaggcccggtggaaagctgaacccccacacccacctgacagtaatgagactgaaagaggcagcgtgaagcaaggctagtcaccactcctattcccactgccctgatgtcagcaaggcccagtgaggaactgaaccaccacctccaatcagcatcagtgaggcttaacaaggtggtgaaaggtaaagctaattggcaatccgcttctccccctcccatcccctgatgccagcagggcctggcagggagctgaccttacacctccattcagaggcaacaaaatccagaagccttgtcagtcattgccccactttcacttggatagtatcagtgaggccaagggggtagccgaactttcactccacccatttgcaacaggaaagtgtgagtcagtgccccactttgttgccagggtcatgtcagcagggcacatcaggaagctgaacatacttggccctcacattatacctcacataggggtttcctgctttaaaaagattaaatagaatccagagtttcataatatataataatatccacaatttcaagattaaagttgaaactcactaatcagaaaagacaatccaatggacaccaacaccaagataaatcagattttatctgacaattataaaacagctgtagtaaaatccataataaaaattatctaacaagcaattacaaatcctcctgaaacacagaaatatatatataatctcagcaaagaaatagaagttataaaaataagcaaatagaaattatagaactgaaaattacaataactgcaattttaaaagttggcaaatgagctcaatagtagagtggagatagcagaaaacagaatccataaacttgaggacagatgaatacaattactttatctgaacaacaggaaaaaaaaagatcagagcctcagggaacccgtgggacaataacaaaagatctagtattcgtatcatcagtgtctaaaaggaggggagagagaaagaggttaggctttcttttttttttttttttttcattttttgtgtgttcatagttattcattgaagcattcttatgatggctactttaaaaatatttgtcatataattctatcatctctgtcatctcactgttggctgttggcttctactgattatcttttcttcattcagttcgacatattcttggttcttagtatgatgggtaacattttattgaaaccttaacatttttctattttgttttaatgttctcaatcttatttaaacccgctttagttaaagctttttgtgacactgtctggtaggcgtagaggggctgccacctcattactgcctggtagaagtggaagtgtaggtcccacacttggtctcctctgacacctgaaggataaagagcttctcgttactgctagattggggtaggacttccagctacctgtaactagctatctactgatagctatctactgattgatagctatctactgatagctatctactgattgatagctatctactgatagctagaccagttccaactgccggagtctagttatctgccaggggggatgaaagtgtcagctctcttcttggccttctctgataccacatcagcagggtaccttgttacagcctcatgaaggtggaattctaggctccccactcggcttttgttggttgtttgtgtgaatggggtggggccacaggttttttttctgtagtgtttgactaaagcggatattatcgaaaagttttctctcatgctgggttgctccttttttggtcctttggctcaagagagcaggattttgctagggcttttttttttttttttctgtctgttcttgttggcatttctaggttgctgacttcttcacttccaagtctgggatttatgaggcagaaagaaaaccaggagaacttattaccctgttgctccctgggtcccaatggtcagtccatttttctctgttcttcagattgagtaaactatattcatctgtctttgagtttgttgtttctatattttgtcatctccactctatattttagcccatttagcaagttggcttattttggtcattttaaattttagttatataatttctatttttatttttttaacttctatttttttgttttgtatttgttcattagtttcaagggaattcataattattgaagcagtttttgatgtctattttaaaacttctgtcaaatagctcaaaaatctgattcatccctgtattatatcagttgattttttgattcacattattactcctggttctcattatgatgcgtgatttttttattgtattctggacatttttaatattatgttaggagatttttgaccctacttacatcttctatttaagcactttttaagtacagtgtgtcagctctggcctacttctgtgggctgtaattccaatgacaattttgttttctaagcccttgcaatgcctctattctggtctgcttcatgctctggctctacttgagctcctgcttgactcctactggtgttacctatgggaacagaaggtgcttccatggaccatccagtttcactactagaaggtcaggaatactagacctgcgggacagagaaggttttctcttaactattctccagccacccagagcttgtgggctttccactccatctctgctagtgcctgcagaggaagaaattacctaattgggctcccttctgctgggtagagggacagcaggtacagattctgtatgagtctttgccactaggtggaggttcagaaatctcctagccggagatcattttctgtcattttttgccactctttggagggccaggaggcaccaaggcctgtgttgccttctgccattgggtaaatgtctgttggcagacgcctggcctggattatcttctgttgctaggtaaagggctaggagccactgcatctggggagagagggttgggaagcacctggccagctggcactgctgctgcaagagaagtgcctgccacccactggtgtggggcagaggatgggttagcctgctccggttccactgttgtattaatagttactttaagaagattgggtcccctgccactgggtaagggtttccctgctaagtccttgttgggctttcctttttccaatcctttggccagagacagcaggcttttatttttttcatttttgtctatgcatgttggtgattccaggttgcaggactcgctagcactgggatatatgagagacagagggaaaacccagggaactcaccgccatgtagtttctcaagttgtgatgtccctagccagtccactttctcttttccacttttcaaagcttttgtgattgtccattgaattgtttccagggtatttagttgtagttaaaaggaagaaggcatcttgtcccagaaccagaaccctgacttacatatattttcaattgtaataagtggcatcctattgtctttatgtttcttcaatgtgcttttttcacagaatatcatgtttttgagatccactcattttggtaaacatacatgtataatttattcattttaaatgctataaaatttgctcttatatgaatatgccacaagttatttattcattctcctgttggtggacaatgaggtttccatttctctctattacaaacaatgctgcagtaaatgttctcatacatgtctccttgtgcacatgtgagggagtttatttgggtctatatccagagtgaaattactaggtcccaggatatatacagcatgaactttgtcaaatattgcctaattgctctccaaaatcataccagtctatactcttgccaaaaatgtgtgagatgtttcattttgccacattttcaccaaaatttgtattaatgtagtcaactttattcagctcttttcctatgagtctgcttttgtgtcttctttatgaaatctttccctacactaaagtcataaaaatattcttcaatatgttttcaaatactttaaaaatgttttttctccaatttaggcctttagtctgtgtctgtgacttatttttgtgtgtggtctgataaaagaatcttattctactttttctaatatggatagccaattgctccaacaccattcattgaagagtcctttctttccccatttataatgccacttcaatcatgtttcacgttcccatagagtctaggttgactctgaagtttaaaaaaacccttaaaaaacccttaataaaacaaaaataaataaataatataaaaaagtaaaataataaataaaataaaataaaaataaccccccaaaatgagggttaagtacaatattgagtttaaaatgagaaactttttattacaggtaccccaaataaaaccttaaccttaaactaactttctactagtaaaggaactttgaggatcaggggtagggattaacactgattaagtacctgttaacattgattaagcacctatgatgtatcagatactgctggtcaatttactgccatggtcattttatttatcctttgcaataactttgagaaagaaattatgttattaccattttagaggtaagaatgctaaaactttgaaaggttaagttgcctaggccacacagcaggttggacagagcttaaattcaggtctgtctgattcaaaagagcttgattttgtcagtctactacactgcttccaaggaaagctcacagccctgaactgaggaagatgtgacttgcccactaggagtagaatatgtgttacaatgcactgttgtgcattgaatgaccaagtattctcagaatgactgctttacttgtttgcactcctgactagtgcaaaacatcagtctaagatgagctcctgcttcctctctcatcctcttctagtttatttatatctctatctcatatttcttcaacttgaggtacaaatttggttgtcagagactttcctgctaagctctaggtagcatgggggaagaaaaagtaaacaaggggtggttaagggagggctaaatcacttattcttgttaacaattttggattggatttcatatattaaaggaaccaaatgtaacgctgatgtgatatcagcccttgcattattttatcatgttatcacaattggatattaacttcttattaaactatcattttttcctcctttgaactcggtgctcattgctccctaagactgttatgaagaagttgtagtaagtggcaaaagcaagagatttggtatcagataacataagtttgagtcctaactctgcttttggctctgggatcctacacaagtgatattttcttccttgagcttcaggtttcttctctgtaaaatggacattaacatgagttaatgtgaggattaaataaaataacaattgcaaatttaccttgtaaaataatgtgcaaagggaggttcttattcatctgccattctctataatcatttctgttcttttcacatctataccaacagctccctgctagatgaccctgatgcagcaaccctaatgccattgttctcaaattcataagaatcacctaggacttgctttgtaaatacagatttcctggctctaccctcagattttattaatagatctgagttgaggcccagaaatctgtacttttaaaattctttccagacaattctttaaacacagccagatagaagacatactttgcctaaaacacttaccaccatatatacaaagaatttcttggccctgagtgggattcaaggttaaagcagcttacagtgagaggttataatccccagccttccctaatgttccaaactcctattccacctaggtcaaagaggacccagccacatgatatcttaacattcccttccactgctgtgattgcagctgcattgtgagtccctagaagcaaagcctagtaaattaaaccagcaattattgctgtttaaaatggtagtgattttaagagttttctttgaaaagtctgtcaataggagcagaagactatgaataacaccaaaatatttagctgtctattgaaatttctttacagtatcaaataaaatgggaacagatgcaactagaccagaacttggttagtaggtaacagatttattgggcttgctcattttaaaaattaaggttataaacaacacatgtcaaaaatcctataaaactgctgtggaaatcatcttcctggaaagccaaaatccctgctaatattctgaatttgcttttcagaactgaaaatggcattgtatacatctgccccactatttgaaacaatgtttccttgagacagagctcactctgccctgagtgtgcattcagtagctaccccaaagtttcaaatacctgctctcttcccagaatgtaatccatccaatcccttgagagaagacaaattctgtatttacaaatacaggtggagttgctatgagttacagttttctggaagttttcatatatagctcatgatttgaaagtaaaaggaagtcatatgacagtgaagtcaccaggtcttccatctatcctgaaggatagagagagacctgatgagaatctcaattggctgtttttctttttactgtcacatatgcaggtttcctgttgaatctctctggtccactgttccctctaatgaagtcatgttctgtgctcagggcagtaatatcttcagaagcagatgtctcccataaagcatgacttcattccttggaatgggaagagccagcagtagactgttgggctaatgggtggggagggctttatttaaaaatagttttctaaaataatgtgtttaactttttaatacatttctataaaaaggcaaattagtttgttgctgttttttgttgttgttgtttttgtttttgtttttgttaacctcactccgtacttccagaaggggcaaccactagaccagaaggaatggagtcctcgcagagcacaggcacttccatccagttgtttgtacagatgggtgaaaattaggattttccagatgctgaatctaggctctgtatcagaccccactgaatcacagcctagatttcaacaagcctttttataacagccctggagcttagaggaaataaactgaagtgcccaaggaaagttactgacccagatgctccagcaaattaggcaagtgggaatattgctagagaagggaagagtagagaaaaagggtggaccaattagaaggatgcagtttgaagtcaatccaaacttgctaaagagaatgggctttccaggctattcctgttcctttagaaaagtacatgtagggcagttcctgaacactgacttctcaaattattaggaataaccaagatgaatggcatcctgtactctctgacatcctatcatcagggcttacaggcactgcccatgtgttctagtgtgttactcacttctatttctgtctatgcagaaggtgatcactaaacaaggtccaaagagctaatttcctaaacatggagggcaaagaccttttccataaacaagatccataaacaaggaaacatgataaggtagttaccatctgagcttggtaccttcaatttgtaaatttaatcactacatccccataagaggtccatttcagttacagctatgcattaaaaatgaagatatgccaataattctgtaaatattgattgatggcagtaaatactgaaattaaatttcctttcccaactcccacattagtcaccttggccagcaaccggtcctcctccagataactctttaagcttcatctccaccataaagcctgatacagtttggctctgtgtccccacccaaatctcatcttgaattgtactcccataattcccacatgtgagtgggagataactgaatcatgggagcagtttcccccatactgttctcatgatagtgaataagtctcacaagatctaatagtttgataagggcaaacatgtttcgcttgactgtcattctttctcttgtctgctgccatgtgagacgtgcctttcaccttccaccatgattgtgaggcctccccggccacgtggacctgtaagtccattaaacctctttttcttcctagtctcaggtatgtctttatcagcaccatgaaatggactaatacagtaaactggtaccagcagaatggggtgttgctgaaaagatacccaaaaaagtggaagcaactttggaagtaggtaacaggcagaagttggaacagtttggagggctcagaagaagacaggaaaatgtgggaaagtttggaacttcctagagacgtgttgaatggttttgacaaaaatgctgatagtgatataaacaataaggtccaggctgaggtggtctcagatagagatgaggaacttgttgagaactggagcaaaggtgattcttgttatgttttagcaaagagactggcagcattttgtcccaccctagagatttatagaactttgaacttgtgagagatgatttagggtatctggtggaagaaatttctaggcagcaaatcactcaagaggtgacttgggtgctgttaaaagcatttagttttaaaagggaaacagagcataaaagtttggaaaattaacctgacaatgggatagaaaagaaaattccattttctgaggagaaattcaagccagctgcagaaatttgcataagtaatcagaagccaaatgttaatccccaagacaatggggaaaatgtctccagggcatctcagaggtcttcactgcagcccctcccatcacaggcctggaggcctaggagggaaaagtggtttcgtgggccaggcccagggtccctgtgctgtgtgcagcctagggacttggtgccctgcgtcccagccactctagcagtggctaaaaggagccaacatagagcttaggccatagcttcagaggttgcaagccccaagccatggcaacttccacttggttttgagcctgcaagtgtacagaagtcaagaattggggtttaggaacctccgcctagatttcagaagatgtatggaaatgcctggattcccaggcagaagtttgctgcaggggcaggatcctcatggagaacctctgctagggcaatgcagaagggaaaagaggggtcagagtccccatacagagtccttactggggcactgcctagtggagctgtgaaaagagggccaccatcctccagaccccagaatggtagatccactgactgcttgcaccatgcacctggaaaagccacagacactcaacaccagcccatgaaggcagctgagagggaagctgtaccgtgcaaagccacaggggtggagctgcccaagaccatgggaacccacttcttgcatcagctggatatgagacatggagtcaaaggagatcatttcggtactttaagatttgactgccctgctggatttcagacttgcatggggcctgtagcccctttgttccagccaattcctcccatttggaatggctgtatttacccaatgcctgtactgtacacttattgtatctaggaagtaactaacttgcttttggttttacaggctcataggcagaagggacttgccttgtctcagatgagactttggactgttgacttttgagttaatgctgaaatgagttaagactttggaggactgttgggaaggcatgattggttttgaaatgtgaggacatgtgatatgggagggatcaggggcagaatgatatggtttgtctttgtgtcctcacccaaatctcatcttgaattgtactcccataattcccatgttgtgggagggacctggtgggagataattgaatcatgggggcagtttcccccatactgttctcatggtagtgaataagtctcacaagatctgatggtttgataaggggaaacatgtgttgcttggctctcattctttctcttgtctgccaccatgtgagatgtgcctttcaccttccaccatgactgtgaggcctccccagccacgtggaactgtaagtccattaaacctctttttcttcccagtctcgggtatgtctttatcaacagtgtaaaaacagactaatacaaagccttcctagggcaacctcccagactttgtttcttatctccttgagtccatccttcctgtctcctccttctgtacctttgtctttcatccttcccacctctgatgcctctagagacaataacattggtgcctgaaataaaaataaatggaaaacagataagaagagattatgaacttttaaaaaatcattgtagctgagtggactgagaaaaataaactgaggtcgtgtatgagttgttgtctctcaagaaagtgtcacacactaggaataaccatattatttttaatgaaggatactggactttttttctaccagggagaaaaaagtcacccaatgatatcctagaaaaagggagttagggctaagtatagtggctcacgcctgtaatcccagtactttgggaggccaaggtgggtggatcacttgaggtcaggagttcaaaaccagcctggccaatatggtgaaaccccatctctactaaaaatacaaaaaaaattagctgggcacagtggcaggtgcctgtaatcccacctactcgggaggctgaggcaggagaattgcttcaacccaggaggcagaggttgcagtgagctgagatggcgccattgcactccagcctgggctacaagagtgagactctgtctcagagaaaaaaaaaaaaaaaggaaaaaaagaaaaagagaaaatgggagttaggcccaaatcgagatattacagaacaaaacagttcccatgttccttaaactgttacaaagcatagaaagagaaataattcctctcagttcatgttataaaattggtataaccttgataacaaactcttccaaagcagcaccagaaagacaactaaagatatctcacataaaaatcttaggtaactactagcaaatcaaaccatgcaatatatttatagtgtgtcatgaccaagtagggtttgtcctaggaatgcaaagattattcaataataggaaatctcttaatattatattatatcatcaactcaaaggatataaatcatttgatcacctcagatgtcacaaaggcatttaataaaaatctaacactctttcctgattattcttagtaaacgaggaataaaagggcattctctaatatgataaagaatatcttggcctaataaacagcatagtacttaatggtaaatatattagaggcatttctgctagaattgggaataagacaaagatgctcattgtaactgctgatgttcaacattattcttgaagttcttaccaatgtaatggggcaagaaattgaaataagagatatcactgttggggaattatacaaagtaccattatttacagatattgttctatagctagaaaacccaagagaatggattaaaaagatattataaatagcaatcaccgaggtggccaggtcttatattatctgtttgtagtacaaatatggtactagcatatcttgtgttcaaacaacatttataagttgaatataattgaaagaattaactgaaaaagaactttctacaggcagttaaatccttcaaggccatttcagaatcttgctgtgtcttgggataattattgtgaacaccaatttatattggataaagaggttcagttaattgagatttctgtttgcttgagtttgggacaaatgaagtttatatggttatagaattttgcaaaaagatgaatttgtctttattgagtgcctagagaatatcttacacttgcttttcatgttatcttgtataaacctcataacaactctataaggtaagtaatagtatccccattttataaatgagaatgtactcagagagatgaagcaatttgctcagtgtcatgcagcacttactaagtagtggagctgggcttgaatgcagttctgtgacttcaaagaccatgccttttccactagtgactttcaattatgtgttcaatttccctggaagagaaatgtatttcctgggacaaagttctgctgagtataatgtatagaggatggccaacacacagctaccaaaacagacactgcctttatggagaagggggtggcaataatgaaaatattaaaggcaagataaatacttaccatgttgaaggataatcccagaagaatccaggtagtatacccttcttggggaaaaaaattggattggctctttctaaatcaaagtattagcagcacctccatcctagggcaggcactaatgtaaatgactggagtacatacaaactgaacatcagaaatccttagtttgtcccatcagaagaagaatctagtgtgactcaggataagctccattcctgattaaagggacacaacatgcacaatagcacaatagctagccatcttgaactgttctgggacccaatctagagccatgttgcatatgtgtggttctcaatgtaatcgctgtttgtggtttggtttggctggccagctgccatggtagcactcctcctcagtgaagaggagccagccaaatggctgtcatcatatgcttctgggaacagcacattgatgccagccatttgggccccttcagcccattgatggggttaatctgccgacagtaagacagggtagctctgatgatttatgtcacatcccaaaagtagattcccttctgactcctatgttctgctgaacaaaaaggttggatgataaattgccagtgtagcctttactatgtttagtgagttaacacatctcaactactgaagcaatccatttgattcatgtgcatactgcttaaaataattttttgcatttccttagcacttcatactttccaaagctgtttttgcttctattatctcattaatcccaagagctggagatggaatactctggaatattcttaacctcagacttctgttgagcccaagtgaaggagaaatggtgttcagggcttgtcctagagtagtggttctcaaccttggtcacacattagactcccctgggaaggtttgaaaaatcctcatgcccaggtctgaccccacaccaattgcatcagaattcctagggctggggtccaagcattgagagtttttgaaactccacaggtgattacaatgtatagacagatgtgagaaccactaagaagataaattcaatctgaggcatgagagttcccggtaacaggaatgcgttcaagtggcaatgtcacagtggtattagagacacgggctgtatcattctccatgagggttgaagtcctggaacaaaatgtgctcatgaaagagtgtgtagataaagaaaagcaggggcctgaaaactaacttttgatattcatagtgttaaggtttctatctgtgttaacctagtttttttttcaaaggcaacatgatttcataatgaaaaaaaaaaacatgactaatcagaggcctttgtggaaggaactgtgcatatatctaaagggatcaatgggtgtaatttatttagactttcaaaaaatctctaactgacgttctgcagcaaaggttattatgctttaagttatgtcaccatgaaccatggaattagaggggccatcctatgaagagggcttgaatgcagggataaaggggagtgataaatgctgtttctggttttattaaacatttttgtatatagtctaggtgaaagagtttgcagtggaatctctaagtttgcagatgatgaatcatttagtccaaacacccattcaaagttctgccacttactagctgtgtgacccttgaaaagttacttaacctctcttgtcctgtttcctcaactgtaagataatggaattggacatgaacatctcagctagaaattctgtagattagcttaactcagctcccctctttgtgttgataatgaaaacaacacataatcaagttctttggttgattagggcaatgttagagagtgacaattatggggtcaaggaccagagaaagcaattgttatacagaattattcactatacagagttcattgtaaccagattgacaaagcactatttctgccagccatctgctggaacacaaaaatagctttgttatacaggaccgtcctttataattggatttaacctgtatgacagatttcttcaacaataaatttataaatccttgtatagcattttagacctgaggttcataaaattttggagtaagaggtcacctagtccatacctatatttggcaggaggagagagaaatgcagacaggtgaagtgattcgcccaaggtcagacagcaaataagtcatagagctgtatctctggacaactactccggttttcttctccctacactcagttctcaaagcagtcaggaatatagccatttgagtcccaggccagacctattttgaagctgtttggttagccctgccaggtaggtatgtggcttgataatgatggtgatagaaaatgaatgtgatgatgatagctgctatttattgagtgcctatatgtgctaggccttgtgttaagtactgtaaattatctaattcaatcctcctgacatcccttttgaggtagatattattgtcccaattttcataaatgaaaaaactgattgagaggtgaagtaacttgcccaaggttacatagctattgaatattattatagaactagaattcaaacccagttctgaaaagttaacaaagttcatgctgtttccacaaccccagtatttcccaaacagtacaatacagaacattaagtcaacaagagataggtatttctttaaaaagcttctataaccaaataagtttgggaaatgctgcatttcatatcccctttttgaagagtcacatttctaagtagtatattaaaggatatgagaaatcttcaatgaagaaatctgtttttccttaaccatgtgtttcccagactcttttttgaccaaggagccccatttccaataacatccgttgatgtcacacaggaccctggtgctctctagaacacagtgtgaaaaacactgcatgatctcccattcatctttctgattatcttcagagattgttacccttaggcctggctttctccatcctaaccactaaagtgaccaaagactaagtgttgcagaatacttatttagcaaagaaacacgcttatgactttgggaacatatttggtacctatacctcatgaaactttgagggaccattatgcttctgaaatgtcagtagttggtaggactcttttagtactgtcttaaccacagtaatattttttagtcttttccaaactaagccagaactgagccagagaagtttcacagctgatcataacttaagtttgtggagcctgaagccccagagatgggcccctgctgcaagggctagagaggaaatccttggatgaggaatgtaagccatctcgcctaagaaatacttgagattgggatgggatggggcgggatgaaaatcaacttgcaaacccctaccttttcttgcctttttgtcacgctttacagcagatgctgaaactgtaatctgggttctgaacatgggcattccatgtggttctcattcaaaattctcactcttctttgaagctaatggcttctatcttcttcatatatattgagcttgccacgcatatttgcacatttcctctgtttacaattctaatagtgtgagatagaagataaactcttaagatgccaagatttgaagatacaaactgtattgaagaatggttttctttttcttgaataaaatgtccattcctgtacctccctggttgctagccattgccttctctttattcctttactaactggtactgaataaatgttgacaatgtccagttctctggtattgttctcaacataaagggagaaaagcatgaaagctagaagcctgggccaggagcagtgactcacacctgtaatcccagagaggccaacgaaggaggattgcttgaggccaagatttcgagaccagcctgggcaacatagtgagaccctattgctacaaaaaatagttttaaaaagctagctgggtgtggtggcacatgtctgtagtcctagctacttgggaggctgaggcaggaggattgcgtgagcccaggaggttaaggctgcaatgggccatgattgtgccactgcactccagcctgagccacagagcaagaccatgtatcaggaaaaaaaggtgggggaaagctggagcctactacctgtataaccagagaacaaataaaattaaattaaaatttatgaatacctactctatgcacatgactttcatttatttaggccataaaataactataaattgatagaattatgcccattttacaaatggacagttttttgaaactattatcgttaatactttaagcttagcatgactgtgattcaatggaaggtacaatgagcttggagtcagaatcttggtttacttcccaggtttaccactttcttcgtcattcgtttgttcattcaacaaacatttttattgaacagctactataaaagaaatgctttaggagctggagatacagagatgagtaattcacagcccttgccctcaaggagttaacaatgtattaagtagaacgatcacatatcagaaaattataatttgataaatgcaacagtgtgttaatggaacacagaggaattagtgtctgacttttaaagttttaaaggatgtgtaggtattgagggaaagtgggactggagaagggcacttcaagcagagggaatggcatgaagaaaggtacagaggcaagaggtatgtgaaaggtgtggtggatgtagagccagggcttggagattcatgttgaactacatgccatgcagtgttgcttttaaactagtggatgttttataaatttatttttataattacagactatttttagaacagtttttgtatacaggaatattgaacagaaacagagagttcctgtatacaaagagttcctcttcccacccttggcaaccactgatctttttactatctctgtagtttttccttttccagactgccatatggttggaattatacagtatgtagcattttcaaactgacttctttcacttagcaatatgcatttaaggttcctctgtgtctttttctggattgatagcttatttatttttattgctgaataatattccattatatggatgtccacagtttatttaaccatttacctatgaaatgacatcttagttgcttccaatttgaggcaatgatgaataaagctgctataaacattggtatgaaggtttttgtgtggacataagttttcagcacatttgggtaaataaacacctaggagcacaatttatgggtcatatggtaagactatgtttagctttgtaagaaactgccaacctgacttccaaagtggctgtaacattttgcattcccaccagcaataagtgagagttctttttgttccatattctctcaagcatttaatgttgtcagtattttgaattttagcccttctaagagatgtttggtgctatctcattgttttaagttgcaattccctgatgacaatggtgttgagcatatttttctatgcttatttgccatctgtatatcttctttgttgaggtgtctatgcaagtcttttgcccatttcttaattggatcatttttttctgatttttgagttttctgttcagatctttgcccatttcttaattgggttaactgttttcttattgttataagagttctttatgtattttggataagtcctttatcagatacatgttttacaaatattttctcccagtctgtggcttgtctcttgattcacttcacagtatctttctcagaaatttttaattttaatgaagttcaacttatcagttttttttctttcacagattgtgcttttggtgttctatctaaaaatttattgccaagcccaaggtcatctagatttctcctatgttatcttataagagttttatggttttgtgctttgcatttggatctatgatccattttgagttaatttttgtcaaagttgtctagatttttttgtataaatgtccagttatcccagcaccatttgttgaaaaaaaaactatcccttctccattaggttgcctttgctcctttgtcaaaaatttattgactgtatttgtgtgggtctatttctgttccattaatttgtggtatttcacaaataccactgtcttgattactgtagctttatagtaagtattgaatcaagtagtgtcattcttcaactttgttgttattcttcaatattgtgttggctgttctgagtcttttgcctttccatataaactttagaatcagtttgttgatacccacaaggcaacttgctgagatcttgatattgtttggctgtgtccccacctaaatctcatcttgaattgtggttcccataatccatacatgttgtggaggggcctggtgggaagtaattgaatcataaaggcagttactcccatgctgttctggtgatgctgagtgagttctagtgagatctgatggttttatgaggggctttttcccctttgctcggcactcctttcgcctgcctccatgtaagacatgcctgttttgccttctgctatgatggtaagtttcctgaggcctccccaaccatgtggaactgtgggtcaattaaacctcttttctttataaattacccagtcttgggtatgtcttcatagcagcatgaaaatggactaatgcagatcttaattgggattgctatagacaaagttgggaaaaagtgacatcttaacaatattgagtcttcctatccacgaacattgatcatggataggaagacacaacattattaagatgtccattgatttagatctttattttctttcattgaagttttgtatttttcctcatatagatattcatattttgttagatttatacctaagtatttctctatatattatgttaatataaatagtgtttgtttttaatttctaaattccagttggtcactgctggtatgtaggaaagcaattgatttttatatattaggtgtgtatcctgcaaccttattataattgctacttagttctagaagatttttgttgattccttgggattttcacatagacaatcatgtaatctgtgaacaaagacagttttgtctcttacttctcaatctttatgcctcttatttcctgttcttgcctattgcatcagctagcatttccagtattatgttcagtaggagtggtgaatgggaacatccttgccttgttcccaatcttaaagggaaagcatctagttcctcaccattaaattagctgtatggtatatggatgtccaatattccaggatcataaatattctgaatgttatagatgttctctatcaaattgtggaagtgccctttgattcataattggctgagagtttttatcatgaagtgatgttgcattttgtcaaaaatccttttttggatctattgacatgatcatatgattcttctttaaccttttgatgagtaatgggattcaattgatttttgaatggttaaccagccttgcataccaggaataaatcccatttggttgtggtatataattattttaatacattgttggctttgattagctaatattttattgaggatttttgcatctatattcaagagatagcagtggtagttttcctttcttgtagtgcctctgtctgtttggtatatcagggtaatgctgacctcatagaatgaggtaggaagtgttccccctgcttctatttccttttttatataatttcaacttttattttagatttgggggtacatgtgcaggtttgctatatgggtatattgcacagtgctgatgtttggagtatagatgatctcatcacccaggtagtgcctctgattttagtttttgaaacagactgtagggaattagtatgatttcatctttcaatatttgattaaattcaccagtgaaaccactggggcctggtgctttcccttttggaaggttacaaattgtcaattcaatttttttattacatataggcctacacagattacctgtttctccttgtgtgagttatggtagattgtgtcttttaaggaattagcccattttacctaagtgatcaaatttgtgggcatagagttattcataatattcttttattgttcttttaatgtccatgggatcaatagtgatggcagcccctctgtcatttctgatattagtaaaatttgtgtcttctcactctttcttggtaggagtttgtcaatttttttgatctgggaaccagctttcaatttcattgattttctctattgctttcctgtttttactttcatttatttttgctctcatttttattacttcctttcttctgcttactttacatttaatttgttctttacttctagtttcttaaggtagaagcttagatattgattttatatctttctcctattctaatatatgtatccaatactataaatttccctctcagcactgcttttgctccatcccacaaattttgataggtttcattttaattgtcatcttgttcaaaatatatttttaattttccttgagacttttcctttgacccatgtcttatttagaagggtggatttgtttgtttgtttgggttttgttttgttttgttttgttttgttttgttttgttttgatgcggagtctcgctctgtctcccaggctggaatgtagtggctcagtcttggctcactgcaacgtccgcctcccaggttcaagtgattctcctgccttagcctccagagtagctgggattacaggcatgcaccaccatgcccagctaatttttgtatttttagtagagacagggtttcaccaggttggccaggctggtctcaaactcctgacctcaggtgatctgcccgtctcagcttcccgaagtgctacgattacagatatgagccactgcacccaacctagaagggtgtttttaaatcaccaagtagtttgggatttttccaactatcttgttattaatttttagtgtaattccattgtgatataagagcatactttgtatgatatctctttttaatttttaaggtgtgttttatggcacagaatatggtctgccttgttcagtgttccatgtgaatctgagaagaatgtgtatcctactattgttagatgaagtattctataaacgtcagttagatctagttgattgatggtactattcagctcaactatattgtcactgattttctgcctgctagatctggcaattactgaggacatattgaagtctccaactaatagtagattcctctatttctccttgcagttattttgccttatgtattttgatgttctgttgtcaggcacgcatacattaaagattgttatgttttcctggagtactgactcttttttatcataatgtaatacccatctttttccctaatcattttccttgctctgaagtcggctttgtctgaaattaatacagctatcccagccttcttttgattaggagttagcatgatatatctttctccatccctatactttaatctacctgtgtctttatatttaaagtggatttttttatagacaacatatagttgggtcttgtttcttcattcactctggcagtctttatcttttaactggtgtgttcagagcattcacatttaaattgattattgatatagctggattaatatctatcattgtattagtctgttttcacactgctgataaagacatacccgagactgggtaatttataaagaaaaaaggtttaatggacctacagttccacatggctaaggaggcctcatgatcatggtggaaggcaaacggcacgtgttacatgatgtcaaacaagagagaatgagagccaagcaaaaaggggtttctccttataaaaccatcagatctcgtgagacttattcactaccacgagaacagtgtggaggaaactgcctccatgactcagttatctctaccgggtccctcccacaacatgtgggaattatgggagctacaattcaagatgagatttggattggggacgcagccaaactatatcaaccatatttgtaattattttctatttgttgccatttttctttgtttcttttttttggcttccactttttctgccttccctgattttaattaagcattttatatgattccattttctcttctctcagcatgtcaattacactttgtttaaagaaaagtttagtggttaccctacagtttgatacatacatttgcaactaatccaagtccattttgaaataacactatactacttctcccaatccttccctttcatcccttaaaatactgctgtgatttgtttcacatatccacatactacaatcacagaaagcatttttgcattttcgctttttttttttttttggagacagggtctcactctgtcacccaagctggagcgtagtggaatgatctcggctcactgcaacctctgcctcccgggttcaagcaattctcgtgcctcagcctcccgagtagctgggactacaggcatgagccaccatgcctggctaatttttgtatttttggtagagacagggtttcaccatgttggccaggctggttattattttgaacaaactgttatctagtaaatctattaagaacaagtaaaatgttttattttaccgtcatttatttgttatctaatgtgctttccttctttatgtagatctaagtttctgacctatgtcatttgccctcaccgaagaacttctgttaacatttcttgcaaggccgatctactagcaacaagctccttcttttttgtttgtctgaggaagtctttatttctccttcattttgaaggatggtttcactggatacaaaattctagcttgctattttgtatgattgatcctcatcggaaccctgggctttgagtagagacagagtatgtagtgtcccctaatttagcagttgaagaaccagaagaaaagtcacttgccctatggtcattttgtggttgagtaagcactagaatctggctagacctgctgctgctggcctccatggccctgattccatcacaagatccccttttcttattgtcagataggcaaactacctgcccatattgatcaaaatttgtccaatcccaattttactcctatcaaagcagtcccccgtactgcatagctatatgtccccctctgatgcaggtgggttttgtcgaaagaaaacatatggttacaaatagggggaattggaatgatataaaaatgtagcttattacactagaaatagatatgtaatagtgatagtgctctgaataggtatgaataaggttctgaagcatatagagaaaacaaatagatgtatctaaaagattatagaactcatcagggattactgcttttgctctgagtcaagatgctcgcgtctagtatgggacagctctagctccctgacattttctctctagaagctgcaactacagtagcctcaagtgaaagcagtgaacatggtagagacagagccaaatcttaaaggtccgtgttgaaaataataagaattacttactggtcatggtgagctatcttagaacaagaagaaactcctatactgctgaaatgatgtacttattagcacttgtgggaaatgtgatactgtctaatgacaatcttgtgaatacttttacatctttgttttttcccaagggatatgccaaatgttcactaagcaggagctctctgagagcccttctatgacccaaactatagtggaagaagactttgtgagccccgagcccagcaaagctgccttacggaaaagcagccagactgttttccacgtggatctgtgtccctgctattcctcactgagcaaggcctcccgacctgagaccccagccaccccaccgctacctgggctcttgggccagtagcagctctgcacctccctgggacagagctcccagtggaagcaggcaggcctgccacttttgctgcttcacagctccctcctctaatgccctcaggctcaggagagagcaaggtgattaaggactatcatggacctccagcacagtgcagatgccttacagaaaagcagccagactgttttccatgcaggtctctgaccttgttactcctcactgggcaacgcctctccacctgggcccccagcacaaccaccctgcccctgcctgaacacttgtcagtggtggctctgcatttctctgggaaaagaaatcccagagacaacctacagcccctctcccattgcagctgcagcggtatcgcccttactgcccatgggctggggaaggaacaaagggcctggttgtgtcactgtacctccagcacactgcagcaaccacagggagaagagcacagtagctcttccctgtgagtccttaccccctacacttcaccagatagggcccccaacttgggatctcagagtagctgccccaaccctgactgagcattcccgctggtagtggctgtgttcccctgaggtggaacttatgaggaaactgacagcccctctgccactgccactgcagtggttctgctcttgctgccttcagactgaggaagaaacaaagagcctaagggctttacttatacttccagcacaccacagttgccatatggaaaggagcccagtctctcttcccagtgagcctctgaccccctgctcttcaccaagcagggccccagctcaggcccatagtgcagctgccccaccctctggctgaacattcccattggcagcagctctgcatttctctggggtggagctcccagagacgactgaaagcccttctgccactgccactgcattgatactgcccttgctgctctctgactggaaaaggaactaagatcctgagtgctttactcacacctccagcataccacagctgccctaaggagaagaggccagtctgtcttcccctacaatacccctgcctccctactcattaccaggcagggtgccctggcttgggcccacggcacagctgccctaccccaggctgattgctccaatcggtagtggctctatatttatctggggtggagctccaagatacaagtggcaggccctctgccattgccactgccaaggtcctggccctttcagtccccaagctggggagggaacataatgcctgagcacagcccaggagtgccaagtggagagctgagagctgagatctacagccagcactcatgtaggaagggagcccacaccctcagatcactgagagggagcacagctgaagacacaaggaaatacagaggaaccacatggctgggcaagagcctgcctactggccattatgcctaagtgctatctactggatcacagctcaaatttcaacaacaaaaatactttgctagcgtaccccccgataaaatcaaggacaagagttcagctacaaatgaagacctagcgcaaagcctcagccctctgatacatccaaaaacaaagtcaactgaccataactgaaattataccacagttaaaggaacatcagcccacgcagatgagaaagaaccagcatgagaactctggcaattcaaaaagccagagttctccttacatccaaatgaatgtaccggtatccagcaagagttcttagccaggctgaaatggctggaatgatagtcataaaattcagaataagattcaggagaaagtcaaaacccaatccaaggaatctaaggactacaataaaatgatacaggagctgaaagatgaaatagacattttaagaaagaaccaaactgatgtgatagaactgcaaaatacactataaaaatctcataatgcaattgcaagtattaccagcagaatagactaagctaaggaagaacctcagatctcacagactggttctccaaactaaatcagtcagacaaaaataaagaaaaaaagaattttaaaagaacgagcaaaacctctgagaaatagggaattatgtaaagacatcaaatctaacactcattggcatctcttgaaagagagggagggaatacgagcaacttggaaaacctacttgaggatattatccatgaaaatttccccaaactcgctagagaggccaacattcaaagccaggaaatgcagaaaacccctatgagatactgtacaagacaaccatccccaagacacatagtcatcagattctccaaggtcaacatgaaagaacaagtattaaaggcatctagagagaaggggcaggctacctacaaaggtaaccccatcaggctaacagtggacctttcagcagaaaccctacaagccaaaagagattgggagcctatattcagcattcttaaagaaaagaaactccggccaggcacagtggctcacgtctgtaatctcagcgctttgggaggccaacgcgggtggatcacctgaggtcaggagtttgagaccaccctggccaacatggcaaaactctgtctctactaaaaatacaaaaattagtcgggcatggtggtgcatgcctgtaatcccagctactcgggaggctgaggcaggagaatcacttgaacccaggaggcggaggttgcagtgagccgagatcacgcctttgcactccagcctgggcaacagagtgagactccatctaaacaacaataaaaaaaagaaactccaaccaagaatttcatgtccagccaaactaagcttcataagcagaggagaaataagatccttttcaggcaagcaaatgctaaggaaattcattaccaccagaccttacaagaggtccttaagggagtggtaaatatggaaatgaaagaccattactggctaccacaaaagcacaattaggtacatagaccattgacactataaagcaactatacaatcaagtctacataataaccagctaacaacacaatgacaagatcaaatttgcacatatcaatattacccttgaatgtaaatgggacaaatgcaccaattaaaagtcacatagtggcaagttggataaagaagcaagacccaacttctttcttcaagagacccatctcacatacagtgacactcataggcccaaagtaaagggatggagaaaatctgccaagcaaatggagaaagaaaaaaaaaaacaaaaaaaaacagggattgctattttaacttcagacaaaacagcctttaaaccaacaacaattttaaaagacaaagaagggcattacataatggtaaatggttcaattcaacaagaagacctagctatcctaaatatatatgtacccaacacaggagtacccacatttataaaacaagctctgagagacctacagagagacttagataaccgtacagtaatagtgggagacttcaacaccccactgacagtattagaaagatcattgaggcagaaaactaatatagatatttcagacctgaacttgatacttgaccaaatgagcctaacagacatctacagaactctctaccaattaaaaaaaaacccagaatatacattcttcttatctgcacatagcatatgctctaaaattgaccacacaattggccataaaacaattctcagcaaattaaaaaagaaaaacagaaatcataccaaccacactgtcaaaccacagcacaataaaaatagaaatcaataccaagaagatcactcaaaaccatacaaataacctgctcctgaatgacttctgggaaaataatgaaattaagcagaaaccaagaaattctttgaaactaatgaaaacaaagatacaacttaccagaatctctcgggcactgctaaagcagtgctaagtactagatgcccacatcaaaaagttagaaagatctcagattaacaacctaacatcacactttgaggaactagaaaaacaagagcaaaccaaccccatactagcggaagacaagaaataaccaaaatcaaagctgaactgaatgtatttgagatgtgaaaaaacatacaaaagatcaatgaaatcatacttggttttttgaaagaataaataagatagaccactagctagagtaataaagaaaaaaagagagaagatcaaaataaacacagtcagaaatgacaaaaggggcattaccatcaatacaacagaaatgcaaaaaaaaaaatcagagactatcaaaaacacctctatgcacacaaactagaaaacctagaagaaactgataaattcctggaaacatacaacctcctgagactgagccaggaagaaattgaatccctgaacagaccaataatgagctccaaaattgactcagtaataaatagcctgctaagaaactaaaaagcacaggaccaggtggattcacagccaaattctaccagatgtacatagaagagttggtaccattcctactgaacctattccaaaaagttgaggaggaggggcttccccctaactcactctgaggccagcatcatcctgctaccaaaacttggcagagacaaaaaaaacttcaggccaatatccttgttgaacataaaagcaaaaatcctcaacacaatactagcaaactgaatctagcagcacctcaaaaaagctaagccaccacaatcaagtaggctttatccctggaatgcaaggtttgttcaatgtacgtaaatcaataaaaattattcaccacctaaacaaaactaaaaacaacaaccacataatcatctcaatagatgcagaaaaggctttcaagaaaatacagcaccacttcatgttaaaaatcctcaacaaactaggcattgaaggaacgtactttaaaataataagagccatttatgacaaacccacagccaacatcatactgaatgggcaaaagctggaagcattcttattgagaaccagaacaagacaaggatgccctctctcaccactcccattcaacacagtattggaactactagccacagcaatcgagcaagagaaagaaataaaaggcatccaaataggaagagaagaagtcaaactatccctctttgcagacaatatgattctatacctagaaaacccccatagtctctgcccaaaagctccttgatctgataaacaactccagcaagtttcaggatataaaatcaatgtacaaaaattagtagcattcctatacaccagcaacatccaagctgagagccaaaacaagaatgcagtcccattcacaacagcccaaaaagaataaaatacctaggaatacagctaaacaaggggtgaaagacctctacactgagaattacaaagcactgctcacagaaatcagagatgacacaaacaaatggaaaaaacattccatgtttatgcgtcagaagaatcaatattgtcaaaatggtcataatacccaaagaaatttacagattcaatgctattgttatcaaactaccaatgacattcttcacaaaactagaaaaaactattttaaaattcatatggaaccaaaaaagagcctgaatagccaaggcaatccaaagcaagtagaacaaagctggaggcatcatattacctgacttcaaactatatgttaaggctgcaatacccaaaacagtatggtacagatcgaacaatggaatagaataggtagcccagaaataatgtcacacacctatgaccatctgatctttgacaaaattaacaaaaacaaacgatctagaaaggacttactattcaataaatggtgctgggatagctggctagccataagcagagataattgaaactgggccccttccttacaccatatacaaaaattaactcaaggtggattaaatccttaaatttaaaacccaaaactataaaaacccttgaggaaaatctaggaaataccattctagacatagaccctggaaaaaaatttatgacagagacatgaaaagcaattgcaacaaaaacaaaaattgacaaatgggacctaattaaactaaagagctcctgcatagcaaaacagcaaaagaagctatcaacagagtaaacagacaacccaaagaatggagaaaatatttgcaaacaatgtatctgacaaagatatatccagtatctataagaaacttaaacaaatatacaagcaaaaaaacaagcaaccccattaaagagtgggcaaaggacataaacagacacttttcaaaagaagacatatacatgagcagtaagcacatgaaaaaatgctcagcatcactgatcattagagaaatataaatcaaaactaaatgagataccatctcacaccagtcagaatggctattactaaaaaaatcaaaaaataagagatgctggtgaaattgtggagaaaaaggaacacttatatacttctggtgggagtgtaaattagtccagccattgtggaaagcagtgcggtgattcctcaaagaacttaaagcagaattagcatgcaacccagcaatctcattattgggtatatacacaaaagaatataaattgttctaccataaagacacatgcacatgtatgttcatggcagcactcttcacaatagcaaagatgtggaatcagcctagatgaccatcaacggtagactggataaagaaaatgtacgtacatgtcatggaatactatgcagcacagtagactggataaagaaaatgtacatacatgtcatggaataatatgcagccataaaaaagaatgagatcatgttctttgcagcaacatggatggacctggaggctgtaatcccaagcaaactaatgcagggacagaaaaccaaatgctacatcttctcacttataagtgggagctacacattgaatacatatggacacaaagaggggaacaatagacaccagggccttcttgcgagtggagagtgggaggagggtgaagatcaaaaaactacttattgggtactacgtttattacctgggtgatgaaataatatatacaccaaacccctgtgacacacagtttatctataggaccaacctgcacatgtaccccagaaactaaaataaaagtttaagaaatgactttgagccctgtttctgttggtactcttcatgtcatgggcattttagggaaaaaatataaaaattttagttaactctttgtcttacactgtatgccaaaatctataccagattaattgtagatttaaaaataaaaatgaaaccataaaagaactagaaaatatataaagagttacctataatatcacattagggaaggcctaagtaagcatgacactgaaggcagtaaccatataggaaaagattattaggtttaactacatgtaaggaaagcttttcacaccctttgacccaacagtgtcatttctaatgacacatcctaaaaaacctttggacaagtgtataaaaatgtacatatgtggggccgggtgcagtggctcacgcctgtaatcccagcactttgggaggccgaggcaggcggatcacgaggtcaggagatagagaccatcctggctaacacagtgaaaccccatctctactaaaaaaatacaaaaaattagccgggcgtggtggcgggtgcctgtagtcccagctactcgggaggctgagacaggagaatggcgtgaacccgggaggcagagtttgcagtgagccaagatcgcaccactacactccagcctgcgcgacagagcgagactccgtctcaaaaaaaaaaaaaaagtacatcattgtttataaatgtacataacatataaattgtttataaatgtacatataaattgtttataaaatgtacatataaattgcttataaacatacattgtttataaatgtacatcattgtttataatagtgaaaaactggacccaatctaaatatttatcaaagatgattaaacgctgatgcatccatattaaaaattacaatgtaaaaatgtagttattgacataaaaaaggttatcaaatgacatttttcatctgatcccattttgtaaaaatacctatttatatacatagaagacttctagatgtgcatgaaatgttagtagtgattatttgggggtgctttaataagctctttttccttttgctcctcttttgtatgtatatacgtatgtatgcatgcgtttatgtatgtgtaaggagtaggtatattttgtatgaaaataatagaagcttaaaaagattttaaaatttccatttctctcttttcacttgtggatttaagtcagaccttctccaggaagctatttgttccccttaagtggccagtataattcctgaagccactccctcatcttttgtatttccctattcaactgtaagttcttgaaggtagagttgtgagttgcgtttcattatttactgccttccatacacatactctgtaaggactggttggctggtgatggcctgatttcttcaaagtctgcttttgaagtctgatataacagtgcttacccttaaccagctgaaacggtcaaaaacttggtccgggccagcacacctttgcaaagagggcagggtagccataatggctgtcttcctactactctcctaggctgtggtggctagctggctgatagagctgagccctttctgtgtaaatctttccccaaacagctttcttgttcaagaaaaaggcgtttctcaggttgagtcgctgcctcatatcattaatgtctatgtagttgtgctttcctctcagaacttccaagcacattttcaagaactcgcaatgctgttaaaaaaaaaattcataaaggatgggtaacaaagaaagaagacaaagaactgggaggagaggagaggagaagagagaaggaaaagagaattgagattcatgaccttaagtacagcaggttgctccaatctaaaacatcccctggacataacaatagctactgttgcacatgaaattactttgccagaaaagtctacacagacattggtttttcaagggacctgtgaaagctctgatggccactctggcagccctccaggttagagactttactgatctctaatagggcctgctcttatagttagagatcattccacgtttgttgcaaatatcaaatgagatgataaatggaaatatgttttataaactataatattgaaatgcttggtgttccttttgtaagctcttgagggcactgacagtggtttaatgtataactgtgtcttcatggcagtttggaacagattttaaatacctgtatttaaagaaagtcaaatccgtatacagaatgaagagaatttatttcctagaagggaaaaaaaaaatgactgtctgggagcgacctaaactgtttggggagttgcggtcacctaactatgttagaaacaccttgggttttctaagtaccttcaattgattagaattattttccttagaagtaatttccaataaaatgcttgtgatttcactgccaatgaaatggttgacatgtcttattttattttattttattttattttatttatttatttatttttgagatggagtctcgctctgtcacccaggctggagtgtagagcgtgatcttggttcactgcaagctccacctcccaggttcacgccattctcctggctcagccttccaagtagctgggactacaggcgcccaccaccacgcccagctaattttttgtgtttttagtagagacgaggtttcactgtgttagccaggatggtcttgatctcctgacctcgtgatccacccgcctcggcctcccaaagtgctgggattacaggtgtgagccaccacccccggccgacatttcttttaaagtgtccattaacttatagtaaattacaatggaaatgcatgtggccctcaagagtgtattatggtcaaacttttaataagtaacaaattaaatcatgataaggaagtgactaaaagttaaacactgctgctctgctctttccatgaaaatgaccctttgctccttccaagttcaacacgagacttcatatcagattctcacctgaacgcatgactcttcaacctcaggacttgcagaattaatggaatgctgtcctaaggttgttgagttgtgcatttctgggcatttcatctctatggggaagtacccattccctcaccccaaagactgaagtagagagatttttctccctagggaagaatcttccttgaaacttttgtggcctcaggagtcagaagacagaatggggaggtttgatagttggatccttgccaaaagcctgacccttggctgtgagactccctcaaatttgcagtgtcttggggatccctcctagtgactatcttagaaaataaacattttctgttcatttccaatgacttaattatctattttatttttcttataggcccagttaaaaacaagaaaaagggtaagttcctgactttataaaattgctgtcttgtcatatattttctaaagttagaagaaaaaaatcaagagtgcgatttttgtattatattctttcagcattgtctgtctgttattttattcaatcatatgttatcttcttgagtattgtagtttctgaagaacaagaaatcattcttcagtgatgattcacctctttcattcttccttgttcttctccctgcccttctttttattcttttttttttttttttttttttttttttgagacggagtttcactcttgttgcccaggctggaatgtaatgatgcaatcttagctcactgaaacctccacctttggggttcaagcgattctcttgcctcagcctcctgagtagctgggattacaggcactcgcttttatcctttttttcctcctttatcaaatcagtgattgagtgtgaatgaaatcctgtgtcaccatgtaggaactagatacgctacctatcaaaagatgtcagtaccctatttcttggacttaaagcttccctgatttgatttcccaaagagtcagggaaggtatttcttgctttgaggattcaatatcattttctctgtaatgaaaaagctattctggagtagtaccctgaccatttagtcttttcaaagcagcttccattgtgccgttgttgggtcagtaagtccccagtgtacttgcaatgaaactggccctagggcatctacaagtgctcacttactaaaagaggagaatcaatccaaagacagaacagtctccaaagacagggccaggcaatatggtctacttcttaggactgaaagaaccaattatgaaactagttaaagcacctgtttgtttctgggttctgacctgggaggaagacagagtaaaactaatgattgttcattaaaatgctttaagtgaaatgatgctgtgtgataagatttatggagctttatagaatagattgtcaaccccggactaggccaaaaagactggcttcagctgcagtctgccacttctttgaacactagggtactctggtgccttgaggtatcatagtccacatggaaaagttgtgtgcctgttgtaaagaagctgaggaatggcctggcctcctgagggcctgaactgagcaaggctggaaaacagccagggagctggagtcagtgaggaaacctttccctgtggggcctgggcacttaccaccaagatattctgtcttttaagaaagtagatttgattttcaaacatgtagttcttaactcttgtcatatccctttaaaacagaaattataactcagatcattgcctggcactgctaccttgtgtacgggacattattgagaagacagtgcacataggctttaaacatttactttggctgaaagttatttagaagccatttaatatggatttccttggacatggtgaataggcacatgcttgaagaggtaaattgaattgttctcttaattttcaccctttaatggaattttcctccttccacaactctctctcactcactcattcactcacttttggttgttctttgattttgggcttagctaaaaggttaaggaaatactcctttgatgaagtttagctttgaaaggaatgtgtatattctttcatctaacactacatagggtatgtttctaagtacaaacgtctctgggcttttatatcatgaggtgttctgttaaagtaaggaaatcgagagaagggagtcaatcctctgaagttatcctcttgctccaggggtcattttgtacattctcttctctgggcccaactttgtgtaagtatgcaagtgtgagaagctcacttgcctaacccttgttgcagagaagcagaggaccagctgcagaactggaacaaagcaggagtttttttttttctcaaatgccttctaacattttcataagtgaacattctctgttttcactgcaaccattagtctcttggactggaggagtttctggctctaattcttccaaaattacattagcaattacaggagactcacattcttgaaggtgaagtttgtgctacccacagaacaccctctagcttgaaaatcactgttaggcttggaaatcttggaacacaggacagcctaatatgcaccaacttctgtgtctgtgccacctagaaaataaggagggagaagcaaaccttacaaccaggctaagaaagcttcctgactgcaaggggtaagccacccctccttatagaaactcagtctcatgaggaaacagagaaatcattgaggccaagctccttgtttcacagatgtagaaactaaggctcaaggagaggaagggatttgcccaaagtgtgtctgtggcagagctggggcttacatccttatctcctgagtacagattttgtgttctttccactacactagctggaattgaaacttgggctctgaataagcctgatttggaagctgcccaaatctgaaaggagatggttttcctgttcagcatcttgaaattggctagatctagaaacggggcagatccaatcttttgctgctaagtgcagagaaacctctaaagctcatgcctctaggtctttaaggctacagggactcttctgggagagatgttctctggaccttcctttccttcctttctgaggaagagaccccacgatgaccccatggtttcattccaaatgcagatgtggttagacatagacaaatggcctcttgagtggcattgccatgaggattgggtttcttggccatgaggcattgttcttaagggaggacctgataaatcaggacaagattctcctgcctaagtgtctggggagcaagaagtcagagtcagtaagaaggtttttagtgagactagagaaggttgtatttaaaactaagaaactacctcaggtgaagacattgtgatgaagtctggaaacaggcttccattcctgaaactttccataaaattgtgagaaggtggtgaaggaaggaagaagacctgtgcctacatgtagtctttgagtggagctgcacagagcagaggaagtcaacaggaagagctggaggttttggttcaagaccacagttatgactcatttaagataactacatcctggtgggaatgttgaaaggactggaatatgaaataggagggtcgagattgttctagaaggatagcaaggaggaaagggggaagagttggtgggcatgattaataatacatttgagaatgggacttctgaggaaagactttgggaagctggattatttagcctatagaaataggggttggtgggtaacttaatttcttttcatatataaggattattatgtatatgtatattcttctctgtctacacaaatagaataagagcttaaactgccacaagagggacatcatttaatataccagagaacttcctaacagtgagcagtgaggggcaataaacattggaacatgttactatggagtttgcagaatttcctttcccagagatcttttaaaatagagtttacagaggtcagctgagagagtgaaacttgctgcctcctcctcagctccctctactctctgtctctgcttctttcctgtttctcaatatctctctctctccctcctcctctttccgtgcccctcttcctccttctccattcccccatctccaaaactccttcccattcctcattcccgactagcactgtccccatcccaacccccatttcctgtacatcctgactcctggaggaaccttcctggagctgatactgttcctaaggccaggctgtacggcttcctcttgttatcgacatcaagtccaccaaactgggcagtaaacataaaagctccacattcttcaacaatagccctttctaaaaagaaccacaaagtgacccataggtctaatcacttggtagagaaattctcatcctttggactcagctgaaatgtaacctcctttttgaaaccttctctgacctcttcagcatttggtccctacccactaaggtagcacttctactatcccatgactgtgtctgtttccccacagacacagactgatctcctggagggccacttatttctatatgctcaaacctagctttgtaaatgcatattcacaaaagggagtggggggaggggagagaaagcataagacagacggagacagggagacagagatgtgtgataaaggtatccaactctttagcagggcctcccagagagctgactttgtgtcctcagaagtctgtagaactcctgacagtacactcatcacaggaaataactacaaatgtaacactgaggccaggcgcggtggctcacgcctgtaatcccagcattttgggaggctgaggcaggcagatcacccgaagtcaggagtttgagaccaacctggccgacatggtgaaaccccgtctctactaaaaatacaaaaattagcaggtcgcggtggcacgcgcctgtaatcccagttactccagaggctgaggcaggagaatcgcttgaacccgggaggtggaggttgcagtgagccgagatcgtgccactgaactccagcctgggcaacagagcaggactccgtctcaaaaaaaaaagtaacactgaatcctatttttcaggaaagaaagcaggacctcctggacccaatggccctccaggacccccaggacctccaggaccccagggacccccaggaattccagggattcctggaattccaggaacaactgttatgggaccacctggtcctccaggtcctcctggtcctcaaggaccccctggcctccagggaccttctggtgagttcccctgtctctccaccccaccaggtgcctttaaagtactttaggagagcaggagtgggtgatcctgagagcagtttcaaacggtggagatggggttggtgtgcaataagggatgcagatctcctagcccagtgtaaaactaggaattggacaagccagtagggcctggcctgctctagcttcttatatctaccaaactgtcaaggacaggccacctgttcttgccccatctcaacccttctgttacaagccctccctgactcttggcctccctgtagtggaccagtaaaactcatatgagccagagacagaggccctggtggttcacaggagttccagtggggaatagatgtaatcttctgtgattcccagcatctagctccacatgctgatgtttgcatagaaataggctatggagtagaaagttgaggactgaacaaaatgacaagccctaggatagtttcatcttgtgaagtctgaagtgcttttcccatagcaagtagtcactaatggtcaagaagttagaaacttaagagtcactcaggctgtggatgaagcaaacccaggcaccaaggctgtcctgtccgggaaccaagtgcttcttgcactagatccttaccctaccacacttgccattcaaatgtcatttcatccctttgcatctttctccttaagccctgaagggcatccgaaaggtatgaatgcagatccaaacctgcctaattggagttgacaagagtcagactgcctgggctaatgtcagttgttatttctttctcctgctcctcactcccctgccctgtatcttggggctttaaagaaatggacccttacagctgatttctccaggggcaagaattctgcagcaggattcagattctttaacttgtacttcacacagggctcagcagtgttaccatggccacaagagatggagttagagattttttttcaaccaatcattccttaaatattgagcactttctgtatacaaagagatatattgatacatggtcccttttcttatagagtttatctcctagaggaagagagaacaaagaaacaagatatttacaaatagcagtgggctctatgaagaaaattaatagaaagggagcaaaacactagagaagccaatgccattgcctcagggtcacacagtgatgggaatgctctctcattgttctccatgggtgcccggtggggcttgccttgggctaatattggccagaggcaatactcagaagtttccctgctgggtgctgggcccactgaagatgaaggtcagggcaggaaacagaaggggtgcactctgactcttcctccagctctgagccctggagaataaagctcagacagggctggctgcagggagcatggctcaccaccactagctgctcaggtgaggggaaaaggaagtcaaaagattatgccctctgattgtcctatcctattttgcaggtgctgctgataaagctggaactcgagaaaaccaggttggctggggattgctctcttcctgggtaggagggaaagccacaggctagagccacctttaaattagcttcttattagatttcctgaggctttatttcatgagaacaccccggagattctgacggttttcactcacagccccctcccatctctatgaatagaaaagctttgccccagggcatgtttttagctaaggaaagggtgtcttgccaggatcatttttcctcattccacaggagaccccaggttcaccatagccaggcccagtagtcagctgaaataagctgccagtcagacctattcacctgagcctccaactccccaaccaccccagacaccttgccggctctcagaccacctgggatccggagctgaagagttgaagagtatgtccttgaaaaacagccaaccagctccaggcccagcctagcctgggcgtctgccttaatggcctgaagagctcctcccagtctttgagcttcctaatctgtctctattggcaggttctactgccttgccttgtctcatctcagcctcccttgctacagctgtgtggccacagtgataaatctacacagctgcacagtgcttgacggcttgcagggcaattttatatccatcacctcatttgatcttcagacatccctgtgagagaggccagacattcttataatccccattttacagttagggaaatgaggctcagaggcattacatttggttgaggtcacatagctaggaagcggtagagctacaaaatcatattaccctctagtagaaatgtagtcagtaacatcccaagacaggggagagggatcagaattggattacaatagaagactagaaaccaggatggaaacatgggactggtggctgagcaagcagccattactcatagtgactactctctatccttctcatcctgccagccagctgtggtgcatctacagggccaagggtcagcaattcaagtcaagaatggtaagaatcaaaataggctctctcccaaagaggagcttctcccctgcctcctccccagcctccaaataatcacccagcctagttcctcccaggccgctgaggtaccgttggcatacgaagtcattctttgctccatcatgccctctactggctgtcctgagcaattgctggcatcaagaccagttgctacacccaaattgctttagaatcactgatgacggagctgaaagggacttgagacatcatctagcccaggcattctcaggggatggaggttatatcagagccaccatggagatatgtgtagttagattaatattttcacaatacaaattatagaaagtaaaactatgtaaaattaaatttttcttgtctgatctacacaggtgggcagacaggctgcatctctcagggaaggtggggcatgttagaatctccagggaatttaagatgctagtgtctatcaaaaaggagaacatgtttaatggggttaagaaacactgatttgttgtaatccctgcatttaaaagatggggaaacagagtcccagagagattggataataccataataaatcatgctgtctcatatttgtacgatactttagagttctcagcatactttctttgtctttaatttcattcagtcctcacaaccaccctatgaggtaggtatgagctcctttttacaagacagaaagtgaagttcagagagattaattaagtttcccaatatttcttagtcaagttagtttaggagccaggattcaaaactacatctttctgactctttcctctcccctgtgctacttcagtgatatgtatgtacactccactgaatgattaggttcattttcttcccccaaagaaacatgaacattcatgaaagaacagcactttggaataatgtccagtccccagagtgcacaaagcctaaaatgcgtgaacccccaggagccttgggaagcagcaagctagccaagatgccagatgcttacagagcttggggtggaagggaggggttgtgagtacagaaacggtaaaggaaggttaaaaaaaacagctacatggggacagtttctaagaactcagtcagtcctgaactggctgtgctgagtttccttaatgactgtatttagctacttccctgactgccacctccatgtctgacttagtagcctcagaagtgtaaataggaacacaatggcaccaaaacccaattggtcctgctggggaccccaaggccctgagtgggccatgatccccacctgtccagggaggccagagacaggccaaaatagatttgtttggatatctagatggatagtgtttattctgtgctagcagccactgattttgctcccactgccacataataagattgtttccagcccctctgggccaatcctcagaggtggtctgtgctgacctttagtactaccagaagaagtgatgggggtggggtgcagtgactcacacctgtaatcccagcactttgggaggccgaggctggcggatcacatgaggccaaaagtttgagaccagcctggccaacatggtgaaaccccgtctccacaaaaaatacaaaaattagctgggcatagtggcacacacctgtaatcccagctgctcgggaggctgaggcaggagaatcacttgaacccgggaggtggaggttgcagtgagccaagatcacaccactgcactccagccttggtgacagagtgagtgacagtccatctcagaaaaaaaaaaaaaagaagaagaagtgatggggtcaggggttggaggacgtcatgcagagtggtccattgatgggacagagccagggcagctcctagcccatctacttaccacctcaaggaaagatggtcaccttttccagaaaggctgtttcctcacccctcagacaggcaggcctactgaaactggccaaagatggacttataaaatataatttcttgggtgcaggatggatggcttagaggggaaaaggctccctgggcttggatgtcctcctctcatggtgggaaggaacattcctctttctgcaggatggaaagagaagtttttcctccatcctcacacactggcttccgctgtccaaaggagtgtgactgccccctccacccctgcctggggtggggctgagacagatgctttgccaagggtggctcggctcctatcctcccagctggctctattgcagcctgccagtctatccttcactctcataaggatccctctcacctatggggccctggtactagtggtcagtagccccagttaccatggagtctgaatcatctctaatccctaaggttctccagatagacagtgggctgagtggtttcctcccagggaggctttccagaaagctgtgggtgtggaagaaccgtaaaaaagaatctcttaaggagaaagagaaaacccatgaacctatgagatgagagggattcaggagctctggctgggaaagtaaaattgaataataagacctagcctgccactcagtgtctgaattttgcctgtgcaggccccataacaacaaagaaaatagggcagcatgcccactctcatcctccaccggcaaattccagctagaaggtattggttaaagacccttccagatgcaagggtcaagaaaggaaggataaagacagacaggcagagcccaggagccctgaagcaggcctggcagctgctttacaaacagaacagcttctctgctttcaaatgctcttcttaaagtttggccttctaggctaccctggttgcactgggataggggtgggggttgtgaactccttggtatttattttctgttgcctcgattattctgacatgtactgagtgactgcccttctctcatactgagatctttcaggtggagtgctcaatgactggtctcgcatcactatgaaccccaaggtgtttaagctacatccccgcagcggggagctggaggtactggtggacggcacctacttcatctatagtcaggtagaagtgagtacggtcttaggcctaactcttcttatatccagaatgcagatccggtgcaggccacataggggcactgtggagccagccaagaccatccaatggctaacttcctgctttgggtgagggggtggggggaccgcactgggagggagttgaaaggaggaaagagagagggggccagcttcttttgttttgttttgttttgtttttccctagccaaatattattgaaaaactgtgaaaaagacccctcccacaccctgccatctgattccctcctgcagggcctcaggcccctgtttaccctctgagctgtttggctgcactgccaaacttgaacttggtctcagtacattctttgaaagtcagttccagggttactgagaaccctttccctcaacactgctggctcggacgttgtaatgaatagtgctcctgcagactttctttccacctcaaaaagatttctgactgtctttccttcctctttctcccatttgtttccctatctttctattcctctattcttgcctccttcctgctgtcattctcccagccctttctccctctgcttttgtcctcttcctgccctgggcccgctccccaagtccaccagtgtccatctacttccgttcccccattgtttgcctccatgggagtggctccttggagataaaggaagatgagccatgaggttgggatttttgtgggatgggcagcaagcaggcaggtggacagaaggactatggagccaacagatgggtgtcacatgagagcggccagagaaggtgggctaacaagcatctgctaggcacactgagcaccccgctgtagcttgggtcctgacccgtatatggcacccaaatatgctgttcccacctgaagagctgatagagggagtgacctttcataaaatgatttacggtgatatctgagagtcccaacacccatggggcacatgggcataaccctgatgtcctgtgagccaagttccacgtggtgggggtgggcggcagatcaaaacttggtgtgaggtatgatggataagggtagtgaaggatggaaaaattaattttctgagcctaggagagaattgagagtggcccatgcaggctgggaaaatccccatgacattaggccactgagcataagttagtgcttccttctggccacaaagttaggggcctgggcttttccaaattctttgtcttgtttgtggtagctagctctcgatctctctggacctgtttcctcaatcatcaaatgggaggcccaaggggcactgtgaatcagtgaggggagtccaggcccaggggaggggtggtgcaagctgaataagcttctgttaaggagctcaagaaatcacaagttgttacatgccctctctggggaatcagtgacttctaagtttctccacaaatagtccgtggggctcaagaatggaagtcagtttgtgtccacggcactgtgtacacacctgctacgtgcagagcactctgcttcatgtcagggctggggcaggggtgggcgggggaacaggggcacggtgaagctgcaaatagggcatggttcttagccttacagagtttgcgacaagtgtgctgttgtaagaaaagtttgctcagccagctgagccccatggactaggggaagaacaatgcctgtcacctgtcctttcctgttggccagctagcacgccttcacatggcactgccccatccatggggtatactaacagctcatctgagaagattctgtcaattcaccacagggagggccccccaccctctctttcctctcttccccaatcccttcttgttgcctctcactcaggtatactacatcaacttcactgactttgccagctatgaggtggtggtggatgagaagcccttcctgcagtgcacacgcagcatcgagacgggcaagaccaactacaacacttgctataccgcaggcgtctgcctcctcaaggcccggcagaagatcgccgtcaagatggtgcacgctgacatctccatcaacatgagcaagcacaccacgttctttggggccatcaggctgggtgaagcccctgcatcctagattccccccattttgcctctgtccgtgccccttccctgggtttgggagccaggactcccagaacctctaagtgctgctgtggagtgaggtgtattggtgttgcagccgcagagaaatgccccagtgttatttattccccagtgactccagggtgacaaggcctgcttgactttccagaatgaccttgagttaacaggacagttgatggagccccagggtttacatgaagcagaaccttctttggttccatgttgactgacttatggcatgactcttcaaccccgaggtccctgttgtcagatctattgtttgttgcactaaaatgaggatccagggcagcaggccagagaaagcaaaggtgcactccagactctgggggtggacatctgaccccaagggggctgctgctcctctcttgggtagggtagtggctggggtggagtgggaagggagcattgcagcctaagaagaaggccagagagggaaaaggcaggtgcttttggcagagaccataagagaaacctgccaaggagcatccttggcagtgggaatgttctttctgctctatactgtggcctgcaggagggttggagtgctcttcccactccagctgacagccacaccgtggcagcttgctgggctttgggaagtttgctgtgctttggaacaatcacagggaatggccacaaacctgcccgcctaagaccctgaatccgtacttgggtcacatgactctcattttatttacagctgtgctccacactcagaaaattccctggggtcaccttctagttgcccccattcccagcctgactagaactcctgtcttctttctccatggagcctacctctgtctgagacaggtgcctaacctgggacctgtggtcatgtgagtctgggatattctttagcttacctgggcacaaacagaattttccatttattaagcagtacaaatgtttttcatccattcctaatcaaattctgtctggggacgaagggttggacgggatgacctccagaagtcccttcaatttctagtacctgtgactcttagccctcaccacagccttctaaattcccaaatcctagactgctcctgggcattagcaaggcagagcctttttacctggcctagaaagggcaaggggtgaggataggacagagggattttgttcaagtttgctgcaacccaagtggacgttaggccaggccttatctgaaaggccagcagctgatgctgtactaacccagtctttcttcactctggcttcaaaaagccacagcagagcattgtcaccgcaggtgctcatgctgctcccctaaagccaggctcaggagaagccagtgtctaggcactgagcagggatctgccccctagttcaggtccaaattcaccttcccctaaaccccaagcttcccaacagatcatatggtaggaccctcgagagccttacttcaaagtgcctgggctcagcctggtttctgggtgctagatccagcccaaacctgggaaggccagccttgtacagtctgctcctcttgttcctgaaatgtgtttccttttcaggagatggggaataatttccttcaggcagctgaaattcaccaagaacagcgggtacttatttctcagctgtgccttccctttctaagcaaccacactgcttggcccttcaagggtcagggtgagacgtgatgggctaggcctccgttgtctggttgctaatgacagccttgcaacccaaggtgaggtgaactccaggcatgtgtctggccctaactcctataaagtgcctcggacagtccgcagttgtagcagaaaccaacaagaaccactccttcatgtttggaaaataatttctcttgtattatctcctttgaagaaggcaaggctgataatatgacaaacatcattgtttagatgaggctcagagaggtagcactctcagagtgttttgaccagtttaagccgcagacctggagcttcagccaggtctgactccaaagctgttccattacaccacagcattgtgtggaatttgaggtctagagagaaccaataaaagtggtaattgggaactgaaatccttgagagttccggggagaaacccagagatgcctgatttcattcctcgatggtaatacccgtcctctcggctgccaggggctctgtggcaaaaagagtcagacatttctttggaaaacagcgaacagccttagagctcttgtgttcagaagaatcttcctggcacaatgttggagcagcaggcctctgggacccacagaacttgtggcctttatgttctttcacccatcctaggaaccagccaaccatcatgtgtagagcccctactgtgggcaaagtcctcctttcattaccctacagacagcttacaggagccagcctgcttcccacaactactagtgtgactccttatctctttccaccataccttagagactttgatactaccagggtctctcagggatggagggaagacctgaaagagaggactggttctgaggccagaaaggtgtgaggagagaggaggaaaagtcttcctaattgtgcccctaaagagcatcctgataccattctattctccagacatggaggggatgataaaggaaataggatctccactggacccttgattcattctgaaccctccaaaggaactctagagggcgagggatgatgagggaagcaataggtagctggggagccctattgctgctaagtcattggcaaagtgacaaagcaatttactgatgagagaatgtggaaatagatgtgcagtttggaattatgttggtgtgaatttgccagaggaccaatgcttgcatggagaatgggacgaggacatttgtgggcaagcagatgacagaggtttgaaggagaatggcatggcaggagtctctgccagttacttgggcttcaacagccaagctggcacaaaagacagctggcggaggctgctcggctactggttacctggagaagtagtatttgcctatttcccccttcatccatcctgagccaaatttcttttgctgaacaggaaagagctaggaaccctggaggtaaacaaagactttgatccatgtatgagtgtatgtgtttatgtaacttcctgtggatgcaaatagattcagagaaatttagagctaaaaaggcccttagagggaatctagcccaacctacattccaccctgttacttatgtagaaactgaggcccagagagggaagatgacctgccccaagtggtgagcaagcaccaacctccagactcagcagagtgagggggtaaagcagttcctgtcccacatggccatcttctttcttccacccacaaactccaggctggaagtacttggcccccttcaggagcctggccaggcagggagagagtagctgcagccttcatcagaactcttcctcctcccaaggcattctcccagctctagcctctggactggaaagcacaagactggcccagtgccagcaagtccttaggctactgtaatgctgcctcaggacccatccctgcctggaggctcctctaggccctgtgagcacaaagaagaaagctgatttttgtcttttaatccatttcaggactctctccaggagggctcggggtgtgtcatttctatattcctccagctgggattggggggtgggctttgttgtgagaatggcctggagcaggcccaatgctgcttttgggggtcagcatccagtgtgagatactgtgtatataaactatatataatgtatataaactgggatgtaagtttgtgtaaattaatggtttattctttgcaaataaaacgctttccccgtctgttcttgaaatcggcgtgagtacttcctacatgttaggtgcttctttgcaaatgacgccacacatgagctaggggaaggactaaggcacccatttcagaggcagcaacagaaggaagatggtctgaatttcctgttggaacatcccacattctctccatgcctcagaccacactcccacatccccattaccttaggtcagggtgtccaatcttttggcttccctgggccacattggaagaattgtcttgggccacacataaaatacactaacactaacaatagctgatgagctaaaaaaaaaaaaaaaaaaaaaagtcacaaaaaattctcatcatgttttaagaaagtttatgaatttgtgttgggccccattcaaagccatcctggcccacatgtggcccgcaggccacaggttagacaaccttgccttaggtcttctgtgactgtgaccacatgaccggtaggctagatgtcctgccaaaaggaacattgtcctggggcagcaatacacagaactgactcactctcagcttaagaatgtggcatctacaaaagatacttcaggcctgggccccaaatagcctgggtagacccagcctccagctcattttgcagatgaggaaaccaacactttaatttgaatttaagtggctcacccagagttacccaactagtaagtgtgtcaacctggtctgattccttcccagccgaggctgctgttacctgggaaagtagtatttgcctattttcccctccatccatcctgagccaaaatcaataaggaagaggctcacatgaaaaagaccagattgcagctcaagaacacgtagctcaagagaggtcttgcgcttttcacaaccccagcagcctttcccccagccccccgccaatcttttggcttccctgggcccgcccctgtgccatcgtataggtggaacaatgtgcacacagcagaccacgacaaacctgcaatggccaggtgtgcatgggctgggtgttggagcccaggctggtcctatggccaccttagaggtttgtttgtttgttttttaaggaaaccagtcacaggaaagctacagactgtttaaaaacactttatggaagctcagggaaaacgtaatctctggcacaagaagtaacaaagacagcagaaaagcagaagcatgtctttggccactgtatacaaatcatcacatgaggcaggcacccaggatagaggcagcagctcacactgcagtaaacacgcaggatgttgtagaccaaattgaccaacgtaatgcaggtaaatcactggaccaaatggcacccacccaagagggatggaatgagagggatgtgagccaaattttgtagcctgtcattgcaacagccattagaccaagagtctgagagacttgccattcagaaggagagttctttatggctgctaaaagccaggcgcctcattttcatcctgagcaggctggctgactctcaaacaaaggccagaattatagggccacacaagtataggcaagttgctgagggaatgacagagaaaattaggcctgagcccaacccattctgttacagctttgtgaggcagaaactgagtgagggctagtgggtagcagagggtatttcgggcgttgtttgctcagggacaggaaatgggtaaaatggttggagaagaaaatggtgtagctctccagtttataaagttcaatcacatccaatattgtttgatcttcccaacggcctttgaggtaagcaagagacagattgttagtctcattttatagaagaagaaaggaggctcagaggtgactgattgccccaaagtcacatggcttgaagttggtggagcttaaactcaaagcccactggctctcaaggccccagtcctactcctgtaggaagcaggactcaatgccagaagatggggctcaatgccgggagatggggctgtttgacagctagagaaggagagacatgcatcccagagccttcaaaacagag

SEQ ID NO: 11946 - DNA, 7277 bp, Human
caaggattcatgtaattttgtcattccttgcgtgatattttaaaaaacattctgtgtaaggtatttataaagcgtttactattaccgcaatcacaggggcttgaggaaaaactttgactgtggccgggcaccgtggctcacgcctgctaatcccagcactttgggagaccgagccgggtggatcacttgaggtcagcagttcgagaccagcctggccaacatggtgaaacccccgtctcttctaaaaatacaaaaatttgtggggcgcgcttgtagtcccagctacttgggaggctgaggcaggaggaatcgcttgaactcgggaggcagagcttgcagtgagccgagatcgcgccactgcactccagcctgggcaacagagtagaactccgtctcaaagaaaaaaaaaaaaaaaagaaagaaaaaaaagtggactgtgaaaactgaaaggactagaaaaactacactacaaagatacagaaaccaagaaagcaccatagcgtttgccttcaactgcttcccaacttgttttcctcttccaatttgattgtggtttcctctccagaaggaactccacagtacttagcgttggccacatagtaggttctcaaatacttgttaataaataagtttgttcgagaagctgggcaatgatattctacagctggaagaagaaacataatgatctagtaattagctcattaaaaataaacgttcttctttcctcagaggagcatttcccaaggcctgccttgatagccatccaaaaaggccaagctcatccaatcttgccctagatttatgctaaaatgcagttacaatcgataggatgacagaaaacgacagcacttatttaaatataataggcacttatttaaataggagaagctgtgacttcatagcaagtgttggggttaggaaactgggtggataaacttgctgatgctgtagatcttagcctctacatgagatcatgtggaaaatctgaaagcattttaggttccttatgtttgcaatcaaataactgtacaccttttaatttaaaaagtaccatgaggcacacacacacactcgcaggaactttttggcgtaacaaaactagaattagatctaaagctaactgtaggactgagtctattctaaactgaaagcctggacatctggagtaccagggggagatgacgtgttacgggcttccataaaagcagctggctttgaatggaaggagccaagaggccagcacaggagcggattcgtcgctttcacggccatcgagccgaacctctcgcaagtccgtgagccgttaaggaggcccccagtcccgacccttcgccccaagcccctcggggtccccgggcctggtactccttgccacacgggaggggcgcggaagccggggcggaggaggagccaaccccgggctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaagtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgaggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatcctacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaaagactcttaatccttacagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtaagttggctgtaaacaaagttgaatttgagttgatagagtactgtctgccttcataggtatttagtatgctgtaaatatttttaggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtaacaatttaaagtaacattaacttactgcagaggctaaagtcatttgagactttggatttgcactgaacgcaaatcttttttccaaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaaggatgactacttaaatgtaaaaaagttgtgttaaagatgaaaaatacaactgaacagtactttgggtaataattaactttttttttaataggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaagatg

SEQ ID NO: 11947 - DNA, 7948 bp, Human
  misc_feature (1)...(7948): n = A,T,C or G
gaagccatgggagtggaagagatgaccaagggggagtgggctggatgtgaagaacctcggggagtccgcattgaagggagctgcaaggaaagcagattctttactgtatccccagcgcctagctgaatgatatttacatgggacactggagagaggaggatactcctactgaaaggaagggcagaaaagaggaccgtggtccagaagctagggaaaagagtgcgtttgaagaaagtggggtgtagtctaccatgttaaaacctacaggcttgctgggtgctgtggctcacgcctgtaaccccagccctttgggaggccaaggtgggcggatcacctgaggtcaggagttcgagaccagcctggccaacatgacgaaaccctgtctctactaaaaatacaaaaataagctgggcatggtggtgcgcacctatagtcccagctactcggaaggctgaggcaggagaatcacttaaaccggggaggcagaggttgcagtgagccgagatcgcaccactgcactccagcctgggcgacggagcaagactccatctcaaaaacaaacaagcagaaaaacctaccggcagatcaaggaggataaggcctgggaaacatccatggggtggagtgctaggggatgcttggtgagtgtgatgagggcatttgatgggtggagtgggagccaggtctcagggatgaggagggaatgggaagaaaagagtgacggggatctgtggacgacattctttaaagcaggcaggccgtgaaggggaggacaggatatggcacctgaagaaggacaggagttgaaggggcgctgttttttatccttttaatattgtagaaacttggccaaacttaaatgatgggaaggaactagtagattgaaggtataggagagctggaagagggcatctgaaagggaaaggaagttatactagaataggcagcccaggcttccggttctaggtgcttcaggagccgtggcttaaggtgcagacatggccaagtccacaccatacaccaccagtcccgaaaatggcacagaaatggtatcaagaaaccgcgatcacaaagatacaaatctcttaagggggtggactccaagttcctgaggaacatgcgctttgccaagaagcacaaaagaagggcctaaagaagatgcacaccaacaatgccaaggccatgagtccacgtgccgaggctctcaaggccctcgtaaagcccaaggaggttaagcccaagatcccaaagggtgtcagccataaacttgatcgacttgcctacattgcccaccccaaccttgggaagcttgctcttgcccgcatggccaaggggctcaggctgtgccggcccaaggccaaggccaaggatcaaaccaaggcccaggctgcagctccagcttcagtttcagctcaggctcccaaagctgcccagtgccctacaaagacttcagagtagatatctctgtctgccaacgtgaggacagaaggacaggtgccacccaccccgggctgccgtctgcatggggctggggtcctcctgcgctattggtacaaataagcctgaggcagaaaaaaaaaaaaaaagaataggcagcccaggaagaagggttagccttgggtgggaggagggactgtcctatcataaatgggagaaattgtagcgtggaaacaggtaagtgcatacgttttacagccagaagtggatggaattctcacctgatggccttttatttctgtgatataggaggtgaggctttctgcagagagggcaacagggcaacaggaagaccaggtttgagaagagtggaaaggatttgcaggtagtgacttgtgagaacaggagggagggcaggttagggaacagggatgcagcctggagaacccaggtgggacaggctgagtcacggtggtgccaagctgtgtggtcatgtgaccttctccagcctttcccacaggggctcgaggggaggacagtcggatttagccagcactggcgttttgtcaggaggtttagactaaagaatgagacaaagtgagtgaggattggcgagagagtggctaaaataaaggataccaaggtctgtggaggaggaagtgaagtagggagggggttaacaggaagaaaaaccaggggtcagtggtctgaaaaataagcaggttgggagaacttgaggaccaatgctgggatgcaggggaggaagctgggccccgggagcaggaggtctgagtgggttttctcagacgtggagcggttgtgaacagcaagcttcagggcgtggcatgggagtggcagctggaacaggaaggaggaggccactggatatgaggtggcaaaggacacttaagatgaaggcttcatatgcaatttaaaattgcctggtatctctttttttttttttgagacagtgtctctgttgcctaggctggagtgcaatggcacaatcttggctaactgcaacctccacctcccaggttcaagcgattctcctgcctcagcctcctgactgatatctcatttaataaagaaaaaaaggccaggagtggtggctcatgcctgtaatcccagcactttgggtgctgggtgaggtgggtggatcacctgaggtcagnnnnnnnnnnnnnnnnnnnnctgggtgtggtggtgggcacctataatcccagctactcgggtaggctgaggtggggataattgcttgaacccaggacgtagaggtggcagtgagctgagattgcgccactgcactccagcctgggtgacagagtgggactccatctaaaaaaaatttgaaaaaaagaaacaagtgaattaactaattaatttatttattttgagacagaatctagctctgtcacccaggctggagggcagtggtgcgatcttggctcactgcaacctccacctcccgggctcaagcaatcctcccagcttagcctccagagtagctgggactataggctcacactaccatgcctggctaatttttgattttttgtagagatgggggtctcactatgttgcccaggctggtctcaaactcctgagctcaagcgatcacctacctcagcctcccaaagtgctaggattaggtgtgagccactgtgcctggccccagtgaaattcattttaatacttgatccaacattccccaaatatcattccaacatcaatcaatataaaaattattaatgggatattttctattatttctatctatttataatgattattgttttagagacagggtcttgctctgtggagtgcagtggtgcgatctcagctcactgcaacttctgcctcccaggcttaagcgattcttgtgcctcattctcctgagtagctgggattacaggcgcacgccactgcgcccggctaatttttgtattttttgtagagatgggattcccccgtgttggccagactggtctcaaactcctgagctcaagtgatccgcctgcctcggccccacaaagtgctgggattacaggcgtgagccaccataccaggcctctgcttcatttctcatctcgacatttccctgtgcttcccagcctctccacctgttcgattgttgctctagtttatcccctcgtgcggtcccctcactgcctggctgctctctctcaaaggtcccttctgattctctttgcggaaattgactactgggagcggctgctgtttgagacgccccattacgtggtgaacgtagctgagcgagccgaggacctgcgcattctgcgtgaaaatctgctactcgttgctagagactacaataggtagggcttcagtcctcactgcagcccttcaagatgctattttattccttctttttctcttatctgccctgtaatgttgttcattttctacaatttctgtcctctacatcttttccatctcaaaaaaaaaaaattgtctcccactcttacggccctatcattattcctaccccttgtagttttattttctagctgcagggtggagagtaaagccaaccaggtcccctcccaccccactggtcacttgtaccatatatattgtagctctgggccagttctctaggaatgagacgggctggcattaggattatgtgcacagaataacatcagactcattgaactaaggccctgctgcccccatccctgcctcagtttctggactgccttggtattctctctggagtgaggctttgttctgggttaggtactgtcttagtctgtttgggcttctataacaaaatgccatagaccgggtggcttataaacaacaaacatttatttctcacagttctgggggctggtgagtccaagagcaaggcaccagcagatttggtgtctggtgagggcctgcgtcctggttcataggtggctatcttcttgctctgtcctcacatagtggaaggagacaagggagctctcttaggcctcttttatgaagccactaattccattcatgagggctccaccttcatgacctaatcacctcccagaggtcctaacaccatcactgtgggagtggggattttaacatataaatttggtggggacacacacattcagacgatagcaggaaatttctcagcccagttaaagtccaaggaggtgcaaccagcagtcttgtttgggtgtctagaactgcagtgtccaacatggtggcctccagctgcatgtggctatttccatgtaaattaagtaaataaacttaaaaatttgattactcattggtacaggccacatttcaaatgctccatagccaaatgtgatgagtgggtgctatattggacagcacacatcgcattaagttggtgcaaagtgattgcagttgttgccattacttaaatggcaatcacttttgcaccaacctaagagaacacttccatcattgcaaaaagttcttttggaagtactagtctagaatctagtctagaatctagactagtggtctagaaatgttcacatttctccactgtttcctgaagtggaggaaagatcttcagggcttgtcccctctggataccaggcctctcttatgcacaggattattgccatgctgtccccagatgagcaggccctattcaaagagcgtattcggctcctggataagaagatccacccgggactcaagaaactgcactgggccttgaagggggccagtgccttcttcatcacggagtgccgtatacatgccagcaaggtgggccatggtccttagaccctaaaggtctgcaaggctgatgggtcatttatacctgagtgttgcatagagattgggaaacctgggggtagtgtaaaaagaattaagtttgcttggggaaggacttttttgtgtgtcatccagtctagctggagaacaagtgggagggtagaatgaggtccagatggtctcttcccgagctgaaactcccccatgacggggcctgactctaggtgcagatgattgtgaatgagttcaaggcatccactctgaccattggctggcgagcccaagagatgtcagagaagctgctggtacgcattagtggcaaacgggtatacagggacctggaatttgaagaggaccaaagagagcatcgggcagctgtacagcagaaattgatgaacctgcaccaggatgtggtgaccatcatgaccaactcctatgaggtcttcaagaatgatggtcctgaggtagggttcctgtggccaggatgttgtggttggaaaaaccacagtcccccagttccatcaggccattctcttgctccccgacccttttttcttttttaccagtgtgtacttctcaaacatcgtgctctagtcttggactcagccaaccttcagtcctcacacctcttcctccaggactcagcgtcctgcgtttccattaaaccaacttgtttccttccctgttggctggttctcacttcccaggatgtgccctgtcttccctgaaaagttctctttttcctccctccatcccatcagattcagcagcagtggatgctgtacatgattcggctggaccgcatgatggaggatgccctgcgcctgaatgtgaagtggtcactgctagaactatccaaggctatcaacggggatggaaagaccagcccaaacccactcttccaagtccttgtcattttgaagaatgatctgcaaggaagtgtggcacaggtaagaaccactttgcccccaacatctcaaaaccattgcatcttatttgtcagtttcccttaattcctaaacttggtccttggccttgactttatcctatggccttcagacctgctgctgaagtgtgtgaccttcccagtcctaaggcttttctctccatctccactgggttcctcacaggtggaattctcacccactctgcagactttggcaggtgtggtcaatgacattggcaaccacctcttttccaccatctctgtcttctgccacctccctgacattctcaccaagcgcaagttacatcgtgaacccatccaaacagttgtgggtgagtgggcaacggggagggcacaaggcacagggtttcagaggctgtcgagtgggccaggccaggaggagagaccagggctatttccaggcatactgggccagtcacctccctgacctggggaaaactcaggtcaaggggccagatcggctggcacagtggcttgtgcctgtaatcccagcactttgggaggctgaggcaggcaggtcatttgaggtcaggagttcgagactagcctggccaacatggcaaaaccccatctctactaaaaatccaaaaattagccaggcatggtggcgggtgcctataatcccaactactcaggaggctgaggcaaagaatcaccccggaggcggaggttgcagtgagcggagatcatgccactgcattccagcctgggtgacagagtgagactccatctaaaaaaaaaaacaaaaacaggggggccagactggggaagggagcaggggcttggatgggggttgagattaggtgactgatgctcatgggttttgggatttgggatgggagatgaggaaagacaagcttgggactgggactgggactggcctgtaagaggcctagataccaacagacaagacatcacatcctatgaaggagacactaagagtcacattttcactttctgcctactcctttaccttctaatgtgcatgtttgagctgtatttctctgggaagctggttttagagtggaaggtctggagcagtgggcagggctcaggcagaagttgggttggggtggaagtcagtgagaagcatctttcttggtcctttgaagagcaagatgaggacatcaagaagatccagacccaaatcagcagcggcatgactaacaacgcaagcctgctgcagaactacctcaagacctgggacatgtaccgggagatctgggagatcaacaaggactccttcattcatcgctaccagcgcctcaaccctcctgtctcttcttttgttgccgacattgcccggtgagtggtgagggtggattgaaagtctgtctgtaggaggcacagcactgcaggaggagcccaggcctagagtcttgggaagtgggtaggggagctgaggatgacatgtgtcctcaatgacaggaaaagaacaggacctaggacattggacctttgcttctcaaggggtagagatcagggaagagctggacaggatttaggtgaaaagcagttgtctaggggaggatggcagggcctggtgagaaagaagaagttccagagatctggaagatgaaagaagtgagccctttgattctaagaaggcagatgggagttaaatagaagattattttgtttgttttattttgtttgagacaggatcttgctctgtcattgcctaggctggagtgcagtggtgtggtcatagctcactgcggcctggacctcctgggctcaagcgatcctcctggctaacgctcctgagtagctgggaccaca

SEQ ID NO: 11948 - DNA, 9169 bp, Human
tcaggaggctgaggcaggagaatcgcttgaaccgggaggtggaggttgcagtgagctgagatcatgccactgcactccagcctggatgacagagcaagactccatctcaaaaaaaaaataaaaatctttggtactacactctgttaaaacctaatggctttccactgcacttagaatgaaatccaagcccctcccctagtcttcaagggcaccctttgatttcccttctcaccactccctctgtctccctgtgctccagccacactggcccttctgtctgctccctaaacaacctgagcttgttctcaaaagctttaagagcttttgcacttcctctccccccgacgcccccccaccactccccaaccccagcgttcaaatgactcctgtcttcagctcaaatgttacctcctccaagaggccttccctgattttcctgtttcaagtagtcttccctgcactctgtcattatctccatcactctgtttgatttattattgtatttatttttcttttcttcttttatttttttttttctttaagatggagtcttgctctgtcacccaggatggagtgcagtagcgtgatttcagcttactgcaacctccgcctcccgggttcaagcaattctcctgtctcagcctcctgagtagctgggttacaggcgcccactaccatgcctggctaatttttgtatttttagtagagacagggtttcaccatgttggccaggctggtcttgaactctcgacctcaggtgatcctccagccttggcctcccaaagtgctgagattacaggcatgagccaccacgtccagcctattgtatttatttttcaagtcacttatccttatctgagatttatcttcatcattgatgttttctcttgtctgtcttcctctactagaatacaagctccataataccagcagggctcatgtctgttttcattattaactcccagatcagagtacatgttcaataaatgtttgatgaaggaaggaacaggttaggtgtgtgagtgtgccagtattaccttattcattcagcataagtatcagaattattattatcagtattagtattttgtcagcattattatactctcaacatagactaagatactggagcccaggtgggtgaaataattggctcaaggtcactgaaccaggaaatgatggcgctgggattcttagcttccgcttcctccccgcttccagagtttcacaaggtttttttttttgtttgtttgttttttgttttgttttgttttttttttgcgacagaatctcactttgtcccccaggttggaaggcagtggtgcaaactcaactcactgcagcctccacctctcgcgttcaagcgattctcatggctcagcctcccaagtagctgggattacagtcgcccgccaccacgcccggctaatttttgtatttttgatagagacgggtttccaccatgttggccaggctggtctcgaactcctgacctcagatgatctgcccgtctcggcctcccaaagtgctgggattacaggcgtgagccacaacgccctgccgagtttcacaaatttcatctcccatcctctgaccccccaccacggggccaacttcaccagcccaatctcaagtccatgccacagaaatctggcctcttttcccagactcctatccagctccaagctccatcagggaaagcagacatccggccccagggcaagacctcaaaactcaagggtcctgagaatcgggccctcccacccctgacgcttgccccccccaagaaccccattccaagagtttctcatctcaaccctgggagggagccccagatgatgtctgtctggagggattgggtgggggcccaaagaaagaggaaccggagtgcctgggccctcccactggcagccgacctcagctgggtgcggtgagggtgggtttataaaagggtcagtatatattgagaggaggagagaaagagaaacgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggtaagtttccagtccgttattcagggctgggacttcttaatttacttgggaatgtagcagtttgggaaggacacccccaggctgggagagacgtccctgactcttggaaatccttttaatttaataagtgatctcttagcacttgaggtggggatatgggaaggggtggggcccggcaaagttttggggtcccagcagagccctccactggaaaacttcctgcagtttttccctcagcggtgtccactgtcctctggggtccctgagatcagggcattgcatgagaacaccccaaatctgggagacctctaggtcccctgttcctgggcaccaaagagtcctgggaggctaactccttcttgggcctctcttccccccagcgcgaatcctatccatttcctccagaagatgtccaacagtcaccagtctggcagcagggtggggtgaggacctcgtggacatagccaggggctggggtttccctggtgcttagagatgggggggggtggggatgagtcaccagatgactcaccaggtccccctcctcccctcaacccaggagaggagtggtgtgagtcaagaatgcctgttgctgggggcagctcctcaatcctgatgtcggggtgcagggtggggtctcaacttgaattttcactatctggcctgtatgtaacccagagtcagggttctggggagagaggagccacattgctagtcctcctcattcaaggaacccaagagtccatctttggccctctccacccctccagccaatggggatctcaggaatccaggccccagcggtctcctccctgagagacccaggagtctgcacccatgcccttcctccatcaggagacatctcacctgcctttatgccaaatttttttttttttttgagacggagtctttctctgtcacccaggctggagtgcaatggcatgatcttggctcattgcaacctttgcctcctggattccagtgattctcctgcctcagcctcccgagtagctgggattacaggtgtgcaccaccacacccagctaattttgtatttttagtagagatggggtttcaccatgttggccaggctggtctcgatctcctgacctcaggtgatcctcccgcctcggcctcccaaagtgctggggttataggcgtgagtgtgcctggcctgtgccaacctcttgagactccgtcccctgctccccctccccaggcttccactgcagccatgtcactcctcttgctggtggtctcagcccttcacatcctcattcttatactgcttttcgtggccactttggacaaggtaagcctacttggagctcagggcccttctgttcccctttggaatcttgccacgcccctcctctaaaggcattctggccccaccccctttacctagtatttcttttttattttatttcatttattttgagacaagggtctcactctgtcccccaggctggagtgcagtggtgcgatctcggctcactgcaacctcggcctcccgggttcaagcgattctcctgtctcagccccccaagtagctgggattagaggcacctgccaccaagcccggctaatttttttattttggtagagacggggtttcaccatgttgcccaggctggtctcgaacccctggcctcaagtgatccacctgcctcggcctcccacagtgctgggattacaggcatgaaccaccaggttaacccttttagctctacctccgatgcctcctccctgtcctgaccctaccccctctcatattaaatcctaactctccccagttctgccccatcccagataccctgcccttttcccagcccttcccacagtctgcctgaccctatcccctctcctttcctaaccctgccccttgtttcgttctctgtccatcccagtcctggtggactctccctgggaaagagtccctgaatctctggtacgactgcacgtggaacaacgacaccaaaacatgggcctgcagtaatgtcagcgagaatggtgaggggtgagggcggcgggactggtcttcaaaggggaaggtaaacccttcgtgtcctcatgggactgagaattgggaaccctcccccaacaaagttggagtgggcggggtccaggcctgagtggctgagtgcctagggctaatgcatgtcccgcctgtctggatgtacctacctcttgttttttttgtttttgttttttgagaccgagttttcctctggttgcccaggctggagtgcagtggcgcaatcttggctcactgcaacctctccctccggggtccgagcaattctcctgcctcagcctcccgagtagctgggactgcaggtgtgtgccaccacgcctggctaattttgcatttttagtagagacaggtttcaccatgttggccaggctggtcttgaacttctgacttcagctaatccacctgcttcagcctcccaaagtgctgagattacaggcgtgagccaccacatccagccagtacctcctgttctgaagaggccatatagataaaagcatgctataggtttaaagaatagagaggggaggccaaggcgggtagatcacgaggccaggagttcgagaccagcctggccaagatgatgaaaccccgtctctactaaaaatacaaaaaaattagccgggcatggtggcgtgcgcctgtagtcccagctacttgggaggctgaggcagaagaatcgcttgaacccaggaggtggaggttgcagtgagctgagattgcactactgcactccagcctgggcaacagagcaagattctgtctcaaaaaaaaaaaaaaaaaaaaagaatagagaaaaatctcccaagattctgagaagacaagagtatttttccaaagctctaaggagatggggctggtgctctgaatggatgcctgggaccatttcatccaaattccaaggggatggggctgaaaccacttaaggttctaaaggggtggggccaggtgcattggagttctaaaggaatagagctgcatctatctaaagttctgtgtgaaagatttaatgcaaaactaagattaaaggaagtggtctgctctcaccacttctattcaaccttttactggagtagccaatgcaagaaggcaagaaaaagaaataaagggcatgggaaataaattaggaaaaagtgtctctattcccagtaaacatgttgtttatgtagaaaatccattaaaattctgcaaagcagacagacacagtggctcacacctgtaatcccagcaccttgggaggctgaggaggaaggatcacttaagcccaggagttcaagaccagcctggacaacatagggaaaccctgtctctacaaaaatttaaaaattacccaggttgtggtggcttgtgcctgtggtcccagctactcaggaggcaggggtgagagaatttcttgagccctgaaggacgaggctgcagtgagccatgattataccactgcactccagcttgggcaacagagcaagacctggtttcagaaaaaaaagaaaaaggaaattggcaaagcaactactagaactgagaagggaatatagcaaggtaacagggctcaaggtcaaaataagtgatacatctaagtatctaggcttgtatgggcctaaacgggagcagggatggggcagagaagggtcacatggtgagcaagcaggtgaagctggaactctggacccacggtgatgtccccctctgtgtcctccttactgcaggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagtgagcactgcccctccccaaccctaatcccccaagaattgagcagaagggagtggggtgtgtcaagatgctgggggccctgagaatgggcctctcgtagaaaaaaacaactttcaacaccccacgagccacaagaggtgcctccgtgggctacatctctgcccccagggattgctgggacttgtagttttcagtggctaatgatagttatggcttgtgcgtatgagtcatcagggaactcagagtttcagggagccggggctggggaaggaggtataggtaaatagttttggtcccagggatcggccgtgacgtggggggataaactaattagtacctcagtagagagctctaaatcataataataatggtatttatatcagccaaccgctgtttcttgcgtgcctattgtgcatcagatacttcaagaagttttgcgtactttttaattttttgacttaaggtgcaaagggctaacttaatcacagtcagtttggggaacattataggttcttgcaaagcttctctcttggtttatgaatttactactgcatgtttggcttatagaaacacactcaaaaatattccttggatggatagagagatattattggacctagagagattaaatcagttacctaaggccgcgctacagttgcacggcgctgggcgggggggaaagaaccacaactcccagcaggcagcggcgctgcccacgggccctccggcgcttctttgcccccatgggatattgggaaatgtagtcttgagggggcactgcatgacgtgtggttttcatcttccgcaggcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgggctctgccttgatcttccttccttccgcctccagggacccaggctgcgcacgcttgacctctcctgaacctaacatggtccccaccgccagctgctcagccctcagaatgcccatctcccagcccccaaccccttcctcccgaggacacaggagccgggaccccaggcaccttttccctcccacagacccaagagcctgggccttccccgctcaaggcccaagagacctctgtgaggcacctgaatctagaccttcagacacttctgggaagaacctggattctgggtcccagcagaccctgttaggataggaagcctgcagtgaccagtcctgtctccttgctcaagcttctgtcactctgttgctctctctctctgaaccccgggcatagtgtgtgtttctagattgtcggactctttttttctttctgtccaggttggagtgcagtggtacgatctcagctcactgcaacctccgcctcccgggttgaagcgattctcctgcctcagcctcccgagtagctgggactacaggcacgagccaccacacccggctagttctggactcttttttctttctactaactttccatttgggaagacagctttctttttccctctaggaaaccagtctccctctctctctttttttttttttttttttttttgagacggagtctcgctctgtcacctaggctgtagtgcagtggtgcgatcttcactcactgcaacctccgcctcccgggttcaagcaattctcctgcctcagcctcctgagcagctgggattacaggcgcccaccaccacgtccggctaatttttgtatctttagtagacacggggtttcaccatgttggccaggctggtcttgaactcctgacctcaggtgatccacccacctcagcctcccaaagtgctgggattacaggcgggagccaccgcgcccagcccagtctccctctctagggactgaacatttggggtcctagagagggagacttcccctgtctccccaaaggctgcctctagcccatatgacacgttagcaaaaattaggaggcaccccttcttctggctgacccagccccacaccaggatacatgtaggggtatgggctgggtcttacagccacccacccgtggctgtgttcctttgtgcagttaacaatctgcacaggccgggtgcggtggctcacgcctgtaatcccagtactttgggaggctgaggcaggtggatcacctgaggtcaggagttcgagaccagcctggccaacatggtgaaaccccgtctctactgaaaatacaaaaaattagccaggcgcggtggcaggcgcctcccagctactcgggaggctgaggcaggagaatcacttgaacccaggaggcggaggttgcagtgagccaagatcatgccattgcattccagcctgggcaacaagcgcgaaactccatctcaagaacaaaaaaaaatctgcaaatctgcacaatcgcacatggctacgctatctcctctgttcatcaggccctgggactcctctggaatcagatccttctaagatcctcttctatgactgtctttgtttcaccgaccatgaacccagcctctttttaggactacagctttctctgtctgggaccccaagacctagctagagtccctcccctctttccaggattcaaatgctttccttccctccaactcctgcagccatcccactcatctagatttttaaaaataattttttaaccactcctacagagcagggttaccctaaaggcagtgcgttaagagtagcctcatccagacttattaaacatgatttattactttgggacaggagacgggagaaattgatagaccaataaatattgcacaggctgctggtggtggggagatccagaccgaggtagtttctgtagaaagggtgaaagacctgggcgaggaaggcacctgaggttgccgggagccaggttgggagcgagtcttggtggcgagggtgg

SEQ ID NO: 11949 - DNA, 10233 bp, Human
  misc_feature (1)...(10233): n = A,T,C or G
tccactacatgaaaggtaaaatgaattaccgacgttaagccgtcaataaagtcatttctgtaaatggtgtctccaaagggccgccgtattattcagctggctttatcagctggctggaaattacgtggaggagccgggccgcgcggcgcgcggggccgctcactttgattaagcgtcttgccagcgcgatgtgacagagcttttgaccagggttttattcacaggcctgtgatgaacgccaagctgatcaggcggaatgaagagtaattaaaacctataaattatcttccgcagcccttctcgaggcgtctcctgcaggcgagataaggcgtcgagaccctatttaccgcgctgaaagggaccgcggcgcacaaaagctacgcagctaaataggatattgatagtgtcctaattagaatttaattaagtacccacgcttgcttgcgggataaagatttcaattttgcgaacttaaatataaataaaatcccacccccatttcggggagaaggggtgggggcgcctggagatttcggggagcccttgggtgtgctactgaagaggactcgggagactccaaggtggggttggaggcggcttgggaaggtagagaagactgcagcgcagcgttagggagagaggttttctcccctaggctgcagcgcaagtctagccgggaactcagccccggaaatcgggggaccctcgcctgctcccaagatgcggtgagcaatataaattcctgctctccaccagcccttttgagaaacttcagctactgtggtggtggttcggcttgttgtgggtttagttgcatgttcctcctagcctaaccctctgtgacttttctggaaaactggaggtagggggattctttcgcatgtcacaaatagacaatatttccaaagggatcctttctctactgtcccagttgcggagggcgttcagggcgaggaggtccgctggagctctaagatgacacccccgaaggcctcgtttgctgacgcctttctcggccaccgcaggcttcagcatagtcggatactggtcctccaaaacgaatccggagacaagtcccgcaggtgcctagagcttcagtccacacgccacccccgtccctcacattcccggttatgagaaaattttgggggtgcctcgaccaggaaatagcgaaaaagagatcggcagacgggagaatgatagcagctggaggaacggcatttccctcaaactagggaagaacgcacagagctggagccggaggcacccagggagttgggagcaatcccaggaaattcagtcacccggcaattgagggaaactccctgttcacaacttcagctagccagggcaaatacttggggtgcagcgctttcatttatttgattttactttgcagggaaatctaacacagaggttaccctgaactctaaaagctagggcctagcgcgcatccgcgttctgactcgccggccccggggccctcctgagattaatctgcgttgcccggactcccactgccagggaaggtccaggcaactggctctggggctattcctagccctctgggcttggctctatggcgccagggcagctccagggtgttgtcgaaagtctggaccgggaagggcatgggtgcggattccccacaaagggaaagcaatgcagcgggccggcaggagacgtacaaacgtaaacgtgcgacgctagctaggcgcagcgggcctttcagattttgctatttgtgaaaaacaaattgcgcctctgaaagtaaccaactctaggtctatttcacatcaccgacctccctgtctcactccccctccctccactacacacacccaaacccacacccacccacaaacacacaaaccggcagtgacaacaaccacccatccttcaataacagcaaccagagacagaggagaaaataaaaagctgagtttcttaggcgtgggggtgcaaaacagccaggctcctgcctactgcccctgctcccggagctcacagacccataatcctgcatttctctaacaagttgtttatggagttgcttctccatttgcctacatcccaaaattcacccctcccgggtttcttctgccccctcctgagtcccggcctgaaggagggggagggacgcgggtgcgggcgcgggtgggggagggcggacccgacgcacagggccagcgccgaggcgccccctctccgccagcggttgacgcccccggattatttatccgcaaagtcccgcgcgcgcccattgggccgaggcccgagtgtcagcgcgagtcccggctcgccattggctccgcacacgtgcggccctgactcacgtgcttccggtttgaaggcaaaaagtgtgcctgggtgattttttttttaagcgagagagtttgtgcaaagatccgagctgtcagagatttgaaaaaaaaaaaaaaaaaaaaaaaaaaaaaaacagcccggcgctggcggagacgcgctctccctgcaaaaaaagcaaaggcgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgctgcctccttcctccgcgcacccccacgtgccgctggcaaagtggggtggggagcgaggcgctgggggcgggggcggcgcgcgcggaggcggcggggcggcgagcatggaagaacagcagccggaacctaaaagtcagcgcgactcggccctcgcgcggcggccggcgactccgggcggcctcagcctgagcctcagtccgggcgccaggcagcagcggcagtcaacaagtggagacagcgtgccggtgtcccgcagcctgattgctctcgccaggcgcggctttgcctgccgcccctgcccagcacccgcacccccaccacagtatcgattccgcacctcacatctcatgaccctgctcacaagcgcagcagcgccagctgcactgagcacaactttttatcgagaaatctgaggcggattcgcttgaaaaggaagagcgcaccgagttttggtgttgcgtgatcagagaatcgagatgaggaagcgtgtcagcgttaagagatcaaattgnnnnnnnnnnnnnnnnnnnnccccttgcctgccgcccctggcccaccacccgcacctccccccacgccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgcctaggcgtgcctcgctcctgtgcgccccggacgcgaactgtggcccacccgacggctcccagccagccgccgccgggcgggcgcgtctaaagctgggaacccggctgcggcgcggcggcgccgcggcggcagtggcggacgcggcggcggcagcagcagccaagccctcggacaccggtggcggcggcagatggcaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtgagtacccaactccgggctgcgccatgccttctggccccgcggaccgccccagaacgccaagctgcggcgctagggagagcaaacccggcctcgggtactccagtctctcacgcctgcttcctcaccccagttccagtcacaaccgaatgttcatccagctatgcgatcctggcctctgcggccaccacccgagaagctacagctcgtggcacaggaggctcgggtctcgattctttgattttgaactctgaatccctggggccttctttgtctcttatctttattattcttaggaaaagtacatagtcagtgattttctttccagggtgtttagataaggcaggaaggtgggcctagtgatgtgtgtctgaaatcccaccagcctgatcgtccgaaggccagatttgaccagagaaggccttgttcagaaaaattatattcactgtgtgtccttacagacacaaacaccatctcgatattttctgcggagagaccgtttacattgataaacatgggaaacacaggaagacagggaggaaagcgtctgaaagccgtccctctcccccggctgggtagcgaaaagagtctgacccgggtgggtagaaaccagggaaaggcagttgccaaaaaggtgggtgctggcagcccctggttttctggagctgaaaaacagtgggagaggagagaaaacaggtcaggctcaggccaggaagcgtgtccaagggcatgagagccagtttcctccgtagcttctccgcggaacggttcccgcatcctccccgcgcggcgctttccttttttcacccgcacatccagcagacttctggcatccgtaggcctgtttttctcggctttccttccaccacttttccgtgtgcccctcgcgcttggcgaacccgaggaggagacctgagctgggctccgggagagaaggccaaggcctgcctgacgccccggcccgcagtgtctgggagagcggcagaagctttggcccaagatcagcactccaggcacccggtccggcagggggccgggaacaacgtagccacgcgccgctttcctctggctggtctctcgccgccccacagctgccggccgggcgcggatcgatgcgcactatcagctcccgccatctcgagccccgttattgacacgtcgggctccctgaacctccgaaaagctgctttgattgactcgcctgatggatagagtgattgagctgtcaggctgcacggctcgggctggccgggagactaggaacgattttattacaagagtccgtgcctctgcacacacatacaacaacacttcaacatgtcccggatgcagaacgggcagtggggcctttttggggctgtgtgcatttcttgggctatttctccccgctcagctaattacgaatcaaaaccccagttctgctctggagagggccttggctttgttcttggccactttccttcttatgggcctgggtaggtaggggaccagctccttctcctgcttgggcagttgggggaggaggggatgagcctcgacccagatctgagtcgctgcagtatgctaggcctggactcgttgtcataggacagctggttaccccagcctcctgcctgccccaggagtaggctgcccagccttcctctctgtagctaggtttggagatgccggcaaagatccttctttccagacagttttagagatgaacaggcctgacagggacttaacttggttcagcaagctaccatatccaaggcaggacccagcaagtaaatgccagaagacttgggtgtggaagcaggtgggcagaggtgcaggcttttgaggcacacaccaacagttcaatcctctcctggttttcccgctttccctccctcctttctcagtgggccctcctcccagactagtatttgaggggaacttcaccttcctaaggaggtttcctgtggccccttcccattcctatctggtggtcaaagcacatttttttttttctggattgtccctgcttccctccctctcctttttgctcataggtgggggaaggggctgcagtctccttgcaaatgtcatcagtaggcagagaaagccaatccggcttgtttttgttattcaggagtttttaatcctgaaattgcatcagttgaaaggggagataaggaagacccagataagagagaccctgccccacgcagccggttagaggaatgtggaaggccctccctttcttattggcaccatccaaggggcaaggctgaaaacccagagccagggtcatgaggatggatcagggccttttctccttcagagaaggggtggtccctgcatccctgagaccctagaaaaggcttcctttaggccaaagagaaagaaggcgaggaggtgtgtgtgggagggaggggtgcggggaggggggcagacaccaaatactttggagctaagcagccctctcccagccggctcactatcccgttgttttctgaggtcaatagctacaagcagatggggtcttattgtagtttctcctgtaggtatgattcttgaggaggagaggaagatttgtttgcaggctggcgactcccccagggcctgccctcactgccccagtcctatctattccggggcggtgaggacagcaggcccctgacccccaactctgggctgggccatatgagctccaaatatctcctcatcttggattcctgccttcttggcttggaaatgttgtgatttcggtctgtccctgactgtcctgtgagaattggggtgtggggtgcacctacaacctcaaccagctttccttcactgctcctttgccctcccaaagggaacccggggaccccagtggtctggtgaggggcacttcgatccagggattggctggcgggagggagccaggggttcagcagggcctccgagatcgccccggaagcgcggggctcgcggcccagctcggcaatgctattctcacggcttcctttgccctctcccccctcccttctgccctcggtccccacccccaccccaccccggccctctccgccgctgcaggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccagcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaagtgtacactgtgctcacgagcgctggcggccctcctgtttgcgggctcgggaaggacgtgggtccgggcacacagcgccccagcgcccctgcgcacgccgggcggggagccggccgggccttgcgatcaccgcacaacgaatgcagggcgaaggggaagcgcgacccagatttgggtttagcctgggtctgaagggtctggcgggacacgcctggtctccgattgcgttcaagggaactcaaaggccgacaaccacagtcctggcttcggaaacgctgcctgggctgcggggcagctccccgcaccggtccaggcccagcccagtggcggcctcctcctgtacaaactgcttttcactccaacctgcacttttctttttctttctttcttttatttcccctggtgcaggttttgctgcagattttttttatccagagatagaagggggcctgccttcctccctccccgacagcccgcttgggcgaggggcactttggcctggcctcttggccgcctggactcactgcacttcgtttgcgggagggcttctgttggcgaagcagcaggtccgggggcggcctgcggagcctcgcggggctcggatctcctgggcccgcaatgccggaggagaggaggcccaaatgctgggaaagctgttcggagtggctgcttgggccttgaacccgaggtgggcgcacgtctgccgtatctgggccctaaaccaaagagggttcccttaggcatcccaacaaagcctaactttcttcctcaccaaggggggcgcacatagaagcccccagggccctcaggacaccctgggttcccagaaggaaatgtctggcctcttgctgctaacactggggcccatccttccagagcaggagctgctctcagatcttaagaggttaaggggaggaagggaagtttccttctcaggaggtattatctttgtccaggatttttttaaattgtaaattccactcccacattttttctctcttcggcaatatgtatgtatatacccacacgtgtgcagctagacgggcaggtgcccacacatacttgtgtgcatatacaataatgtgcagatattggtgcacctaagttcctaccagttttttgtgtattcctgtacccgtgagtattgtgcaactgattttcttctctaattagatacacaattggacgtttgtgagttcactgtgtgtacatgcatgaatttgtgtttgcacactggaatgtctgcaggtgtgtttgctgggtttgttcatgtgtgagatccctgttctctgtgctcttcccttgagtttctcaactgtttttgtaggattgattttgtgcaaaatgataatggctagttattccaccttttttattgaaaaattttccctgatttggcccaatgtactgtttgctcctggccggggaactaacagggctagatctcaatcccaggaagcctaggtcccctccaaatccctacataagggtttggcggctagagtggaattggagggtgcatttgacactgctgtgggttcccaactttatcgcaattaatttccttccttccatctgcccattgttttctggaggagtaactcttgcatataataggtgctcaaccaatctttgtgggcagagttagaagcagtgagatgggcccttccctggggttggtctaggggagttgttttctggtagtcaaaagcctgtgctttgcttgccttggggagtgggcttggactcttcaagccttccaggctttcctgttaaacagtctgaggcctgtgtcttggagcacccttctcctaatacctctcagaatttcaggaagagtcccattccatttcaccctcccagcacatcagatgtgatgttaaggatgctcaactctatatattggagaaccttactattttgaatgtctaggaattggctacactcccttctcccctccctattgtggcctcttaggatattcaagtcccccaagacta

SEQ ID NO: 11950 - DNA, 121427 bp, Human
taagtcctttgcttttttttttttttttttttgttgttgttgttgttttgagacagggtcttgttttgtcgcctagactggagtgcagtgacacaatctcggctcactgcaacctctgcctcctgagttcaagctattctcttgcctcagccttccgagtagctgggattacagagacgtgccaccacgctcagctaagttttgtatttttagtagagatggggtttcgccatgttggccaggatggtctcgaactcctgacctcaagtggtccaccctcctcgacctcccaaagtgctgggattacaggcatgagccactgcacctggcctagtcctgtgttttttgtgcaacatgctattgacttaatgtatgcttatttgtagccctcactcccttagctcctcaaaggttgtctttattcatgtgcccatgaacttaccacatcgtagaagccattatataggtgaattgacttgactgtttttgtggttgcatattagatgtgaaaaacatttttaagttatttttattgagaaaatttacatatcacaaaattcacccttttaaagtatacaatccagtggttttggatatattcgtaaggttgccagggggcgacggggaatgcagagtgactactaatgggcacaggatttctttttggagtgatgaaaatgctctagaattagtggtggtggttgtaccactttgtgagtatactcaaaatcactaactgtatactttaagagggtgaaatttatggtacatgaattatatcttaataaagctttaaaacaagtgtacttttttttttgacttattcaagtttgtaccacttaaaaagttaacacaattttttttttttttaagagatggggtctcactctgtttctcaggctggcctcagactcctgggctcaagcatgtttcttgtctcagactcccaagtagctgtgactacaggaataaccatgtccgtctcttaagtttttaccacctttgaagatagctgggacactactcgttgtccagggtgccaggactctgggcacttattattggcaagggaggggagagcgaatgtgatcggctatctccgcaggccccgcctgttgttctttatgtcagcgtgctgtaacactttaaaagtccctctttgcttatgtaaaatttagttattttcagaatttatttaaattttgttctaattagttatgataagaacaatcgtcagatgcattttttccacctcataatgtcctcatttggtttggattatggcccttaaatatttttcttatatatagaaagaaaagtgtgattatggttgggtgggatggaggttcggagttttgattagaatttgagtaccttttccaagattaacttttgcattggaacagtgatggtgaattacgggatttaatattggaacacagaataatacatttttgttattttaccttcttggctgttacacaccatacacttaaaactgttttttctaatacctaacattttgatagattttgggtttaatgtatgaaattgtagtgaaatgtgtctcattgctttctagcactgttgataacatcttcctgttacagaataaagaataccaagtacagataaaagtaatttttcttaaaaaacttggattttagatatcaattattgtttataacaagttgaaaccaaataaaagtaatccctgtttcttgagttcttgatgattttaagttctagctatatggaactcagaacacacagagttctattgtgatgctagttttgggtctgtgatgctgatagagaattctaaaagttcgagcaacagtctccattttgtcttgtgcttttgaatcttctttcttgatgtgctttctccctgtcatctgttactcttcttctcatctttccttaccatgcccctcgcaaccaaactaaatttgagagaacttacaaaatgacattttatgatttttgttttgattacagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcaggtatgtttgggaataattgcctggaaatgaaaacctgatagcgtaaccacataataaaaagggtttgtttgttttggatcatttccagatttcttgtactgagatactgctttagcttaatgtatacggaatgggtcttagattggtctaccatagcctttccctgttactccttgaaaaaaaagtcccctatatataccaattactaaaaaattcatgtctgtaacctgtttaggtgaggtagatactccgagccctgccatctcttttttaaacagaatgctcttttatgcctctttaagttttcactggacagtaagtagtagatttgtgtgtgcgcattttagttgcctaacaaagcctaggttttgccatggtataagattttaattggaaatgttattatttgagatgatacttaaattgtagttgctgggatgtagtttctttgattcatttaatgccaaataaccaacttggcaaaatgagaattttggccatgaaaagaggatgaggggaaatatcctttctattggaattttcaagtctttaaaaatctgaaagttacagtgtttaaagtaacgatcctaattcttatgaaagattttccttttagtatgttgtcatctgcaaggtggttgactatagtatgaatttatttttttttcctcaacagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggaggtgagatagggagctgagtgagagctagcttgatatgtggattgtggcatggcatgatgaatagatttttgtgttttattaagttcctgtaagccagttgattacagttttgcactaaaaaaaatacattgaagtgggtcatcatttctgtcacaaatatttcatgaccttgggataagcagggatgctattctgccagtctgcactagccgtgtttactggttcgtgtgttaatgactgggtgttaaatatttggaatattgcttttggctagaagatgtttttcttgaggaaaaatgatagcactaggctgacatttcagaataaagaagtttcagcagtaaacttagccccaagtgttttatcctgagacagatactggcttaacatctaatttatttactttcatttaattaaaaaacatctatgatttgcaaaacatacagttcattagcgctggtgctgacagaagtcactttaatcttttaacgcatctagtaccttataattttatgtcaatcagaagagtttgttgctttccacaaattatttacgtaacgtatactaatagctaatgtttgctgaagaactgtgtgaagtgctttgaatggattatcttgtttaatggattatcttgttttattgattaagaatcaataaaggtagatattatcattgctattttcagtgttacatgttacaacggggaacttagggcttagagaagttaaattccttgcccaaagttttagggctgggtgcggtggctcaagcctgtaatcccagcactttgggaggccaaggcgggcggatcacgaggtcaggagatccagaccatcctggctaacatggtgaaaccctgtctctactaaaaatacaaaaaaattagccaggcgtagtggcgggcgccagtattcccagctactggggaggctgaggcaggagaatggcgtgaacccgggaggcggagcttgtggtgagctgagattgcgccactgcactccagcctgggcgacagagcgagactccgtctcaaaaaaaaaaaaaaaaaaaaaaaaaaaaaagaaagaaaaggactagcaaaagaggattaaaaatccttgtcttagtttttgctgttgtaacaaaataccgtcaactgggtaatttaaaaacaacatgaatttattgcccacagctctggaggctaggaagtcccagatcaaggcaccagaaaatttggtgtctggtgaggggcttgatctctgcttccaggatggcccctcctttctggatcttcacatggtggaaaggccaagtgctgtgtcctcacctgatggaaggacaaggcagctcccttcaacctcagttacaggggcactaatcccagtcatgaaggcagagtgattaagtcatttcctaaagacgccacctcttttttgttttttttttaatactttaagttctagggtacatgtgcacaatgtgcaggtttgttacatatgtatacatgcgccgtgttggtgtgctgcacccattaactcatcatttaaattaagtatatctcctaatgctatccctcccccatctgcgcaccccatgataggccccagtgtgtgatgttccccttcctgtgtccaagtgttctcattgttcaattcccacctgtgagtgagaacacgtaagacaccacctcttaatgccaccaccatagggattaggtttcagcgtgaattttggagggaagcattgagaccatggcagtccttaaagctttcttttcttctcctgctctttttaacactttgtttgccctttcctgagactccctttctatcccagggagagaggagaggtcttagggataggagtaagagaccataaagaaagggacagaatggttttttgaacttgattacattatatttgattgcatgtcccttgtctttcctacctatcctagaaattaggggatgtagatttttgagaaccaacttgatgttaatgtgaccttaagtcatttgctcaacctctgtagacctcagtttcttcatctgtagaatatagaattatttagatcatctagaatgcccttttatttctgaagttctttatatcactaaaccacaagactgaccaacgtactttatggtttaaatctatctttgttctcttttttaaaaaaaatcataaaatattttaaaaatacaaaaatataaaaataatagaggagacagttgtgtatccagcacaaaaatttctatcatttgttaccattttgccatgtgttttagattttttttttttgagatggagtcttgctctgtggcccaggctggagtgcagtggcacgatctcggctcactgcatcctctgactttctggttcaagcgattcttctgcctcagcgtcctgtgtagctgggattacaggcatgagccaccacacccagctaatttttgtatttttagtagagacggggttccaccatggccaggatggtctcgatcacctgacctcgtgatccgcccaccttggcctcccaagtgctgggattacagtgttttagatctttaacaaaatagaacatttaagacattgccaaagtctcattctcatcttttccttcttgtcctgcatgtatctttttgtgatatataaatctattcatttagactgttgtatagtatttctttgactaaactagtttattcccctcctgagtcacagtttctttgtatactataagaaatagttctttagtgaacattttaagacatgtttccttgtgtaagagtttcttcagggtagatacctagtggcggaattgctagattgatggaatccagttttacttcttcagtttccccagatattgccaaaataataaatgaaattgataaaattgaccatttacatttcaaccagcaaccattaagtttgattttgccacattgtcatcggtgattcttgttaccagacttattaatttggaccaatcaaatgtatgtgaaataccttctcagtattttaacttgcatttgtttgatcactgtcagctttcactaggttatgttgcagtagccaaaaaatctgcaaatcttcacgacttttaataaaaatggtttatttcttgctcatgttacatgtgcttggtgggtttgttatggctcttttccacaccatctttatttctgatcaagactgaaagaatagcctctacctgggatatgctggtttcatgataaagggaagagaaaacatggtagaaccatactacagttcttgaatcttctgcttggaagtggtatatattactttaactcacatttcattggccaattaagtctcatggccaaggctgataacagtatagtgggcaagtatgatcctctcatgggaaggatactcaaaaccatgaaaacagtactacagcttatattaggctggtgcaaaagtaattgcagtttttgccattaaaattaatgaggctggccgggcacagtgggtcatgcctgtaatcctagcactttgggaggctgaggcaggcggacctgaggtcaggggctcgagaccaacctaaccaacatgcccccacaaaatctttaccaaaaatacaaaaaatttagccgggcgtggtggtgagtgcctataatcccagctactggggagactgaggcaggagaatcacttgacaccatggggcagaggttgcagtgagccaaggttgtgccactgtacttcagcctgggcgacagagtgagacttttgtctcaaaaaaaaaaaaaaaaaaaaaaaaaaaaagtactgaggctgagcatcttttttctcctcccctccccccctccccctcctttttttttggagacagttgctctgtcacccaagctggagtgcagtggcatgatcttggctcactgaaacctccacctcctgggttcaagcaattttcctgcctcagcctcccaagtagctgggattacagatgcatgccaccatgcctggctaatttttgtatttttggtagagacggggtttcaccacattggccaggctggtctcaaactcctcaccatctttttatgttttatttaggtttatatgatcactctgaaatttttaaaaataaatattatttctcagattaaggactttctcccctagtttctagacttactcatgagtaggtggtgaattttatcaaatgtattttttgcatcaactaagaggatcatgtatttttctaacccgctaatgttgtaatctacattattttctactgttaaaccatctgaatttctaatgtaaacttggtagtgatgattctgcattcattttgtattatttttatttaggacttttgcatatattgcctttaattttcttttatcgaattgtcttcctcagattttgttatctgggttgtattctatcctcataaagttgcttcccttttaccattacctagaaaagccttggataaattactgttggtctatttttggtgatctggtagaacttgactttaaaactgtcttggatggtagcctttttgggagaagagtggaagtggaaggtagtttttgttttttttaaatcgttgattcaaatttttaaatttttttttcccgagttagttacagcaattaatatttttggtagagattgtccatttcatctaatttgacaaatttattggcatgaaggttttcataatattcttgttttgtgcatttgatttttatttcttatttctagtgtcgtttgcctttttaaaattattcttactatagatttaccattatatattttttcccaaaggaaacaacttggttttatcatttctattgtatcttctctattttgtaacatttcatctcgttttgctctttttctttgggataactgtgctttttctaatttcttaacacttaaaacattgctttcatagctctaattttcccttgaagtacctctgattgattgtacaaatttgaaatacagttgacccttgaacaaggagggagttaggggtaccagccttctgcacagttgaaattttacatataactcttgactgcccccacatgtaactactaataatcagtctcctgttgcctggagcctttccaataacgtaaacagtcaacacaattttgtgtgttgtattatatactgtattcttaacaataaggtagagaaaagatgttcttaaaaaataagaaggagagaaaatatatttactattcattaagtggaagtggattatcattaaggtctccattctaattgtcttcatattgcctgaggaagaggaggaggaagaggagggactggtcttgctgtctgtttcttggtggaagaaaatctaggtgtaagtggatccatgcagttcagacctgtgttgttcaagagtcaactatatagtgctttcattaccattcagttttaattttctcgtcctatcccatttgggtctcccctctcctccactctcctcccctcccctcctcttccctcctcttcccttccctgtcccttttcttcttttttcaacaggatctctctctgttgcccagactggagtgcagtggcagtccctcttcttgcctcagcctccagaatatatggggctacagatatatgccaccatgcctagcttatctttaaattccttttatagagatgaagtcttgctttgttgcccaggtaggtctcaattactgggctcaagcaattctccctccttggcctcccaaggtgctgggattacaggcatgagccactgtctctggccccattatgtatcatttttgaccactggattttttataggtgtgatttaaaatttccaaaagtgtgtgcatttgtgtttatgtatgcatgttttgtgggaagagagaatttttttgtttgttcatatttccagttttatgttacagcgtggtcagaatgtggtctaaataatagagattcttaaatttattaagactttgaaatatatagtcaatttttataagggttctttttgaatttggaaagcatgatcttcttattgttgataccggtttctaggtctgtccacttggtcagacaattatgtgggtcatgttatctatctctattaattgtttaactgcttagtttatcagttaataagagaggtgtgttcaaacctttccttgtaattgttgatttgataatttctcttggtattcctgtaagtttatgctttacaaaatttgaggctagattgttagatgcacacatgtgcagaattatatattcgtggatagccctttctttttttaccatcatataataccttgaaatttattttatttgatatttatgttattgtactagctttattttagttagaatttctcatgactctcttctgccttttatctcctgaccttttttttgcgtttaaacattgtatccttatgtctttgagatgactttttaatcacatttgagaattctgtctttaaactggtaaatttagaccatttatttttagtactactgagattagtgactctattttgccatttaattttggattgtctatttttcttcgtttacttgaatttgcttttttcccttttactgctgctcttttagaaattaagtatattacagacacacttgagttaataaagtctaatgctaatcactatgcctactcgcctctttccccatcttatttagtatgcatttcgtagatctcggatctcgttttggaatgatacaaaaacaacaatttcttatctgtgtaactagtccttctatgatctactacctgtagggaatcaacttactgtgttgcctgaagcagagttgagatagtatccaaagcgaaaagcagcagtttagtcttctaattcaccaagatttaaattgggaaagcataggagtcttcatttttatgactgtattaatttatagttagagtatcttttcatttaatagatgattacttaatattgccattataagaatgaactttggaggacaagacatgatgaaataagcttaaaaacagcatttgtgttgagtaatcctttctttttcttttgagttcatagcaaaatggagtttgaatagattttagtgatgctatcccacagcagatcttatgtaccagcagttcacttgaattctaagctgtgactttacatctcaacataggccataattcatcaatatcctaatagctattataacaatgcagaagttataaattatattccccattttattgcattttccttttatacaagttttcctcttattttgattttcccgttgcttgcttagtatcattagtttgggtctgttactcatcagacctgttcttgtttcctcctcaggagtggagcccagagtacagccatcatggggttgagcaggctaatgtttcccaattccagtgttgaccttaggcagattggatgatatgctgatgctgcttatcggtggttctgtatctctacaccggaaatcaccgtctgaggactatttggggaagtagatatgggaaactgtagctattaatgaacttttgagcactcaaggaaggagaatagaatatgggaaagaaatacttgtatttggtttgagagaatagatttgtttccatctgtttactctcagcaaatattgtatttctttatggctcttcagaggactgtagttattgtttgttctttttctttctatatgtacatgtgtctaattttcaattaaaccttgatataacatgcccactgaagaagacctaattgtcttcacttagggtgtttacaacaatggagagaagccactcaaagcatgggctgtgcaggaagtcatgaggtgatagcttggcttacagggatcttatagagagtagggtgaggttctaaaaggcctcaaatgccaggatgagaagattaaaactgatccatagcaaaaaggagctgcttagtaatggaccagaggttgtaaagtcattggtatacaggacctagcaaagtcaagggcgctgtttagattttggaacattgtagctagctatatggctgcagtaatttaaggggctggggggggggtcttctttattcagtgcattgcttatgatgcacatcagtggtctctatagataatttttttttgtgatgcgattagaacattgggtatgttaggcactttcctgttcttgttacctatcagtacctttggtcaacaaaagtaccccctttaaaccatttaatgtgaatattgctatatcaatggaataatttttttaaaatcaaaaaacataattcatgggggcatttttgtttgacatctgaacatcatctctgcttcctagcttactcactctatataattaatatattctgtataatctatattaacatgttgttatatatttatatgtattttatgtgtctatatccccatgtatctgttcatatcccttctttctcccctcatcctctactttttatggcttcctgtttccacattgtttttcctgtgggctatcaacctattctttatctcctaaacttcaggaattagataaagacaactgtccaaggaaccaatacagtactgtttttaaaaacaaatcgccatctttgaaatttgtgttcttttaaggaaagagggcatttgctaatattaagtggataaaaaatttttatgccacacagaattttctggattccccaaggctggaaataataaatgaacataaacattgagtaacagtgcatttttaaatgatgattatagttaagttaaaaaaaatactatggaaatggcccaactttaatgttatttttggcttatgtaacaataggtttattgctaagccatgcgttaattttgacctgaggcctaggctctctttgtgcatttgttccaaatctttgtggtaggtactgtttcattgttgtcactgataattacaatttacattctatactaatttatcatctattgatagtcaactgagatctcaaaaatttttcgaaaaaactttgaagattttttaatgaagaaactttataacttgatttttttggaaatgtttttatctcattgagatatttaaatggtatgtgccaaccttctttggttccagagttaaattgtagagaatttttgggtgtctcttggatcctgcatgtttacttcagggacttgactctagcactctttatgatgttgctgctaaggtcatttacatactcagtgtgttaaaacagcagagctctttcctctaagcgggggaaaaaaacaataaggtttagttgaagccatggatataaagtcaggcgatctatgtttacttttctttttactctttgggtatcttgggggagtcacttcctctcttctattctcagattgcaaagagaatgaaaatatttgcttcctccatttctagaattgagctggttttactacaactgataagtcggtatatgtgttttaaagtttgcaaataagtgtgaaagttcctgcaagactttggaagcttgagtgaatgtgcattctgagttagagttgctcacattttcctctggcatctcaaagttgttcccacatgttgattttgtctgagaatcaagggcattgtttctgcctacacaggaatgtcagtaccgttttttcttagttatgaataaggctaacaatgtaggctctcttcatcagtgttctgttgataaaagtatttctcagagagcagaatgtgtcgaggtctttttgcctttcttgtgttgagttcgggtctcggaaatccaatttgctatcattactttgagtgtgttttatttgcttgtttgtttattgttgtttcttttcaccctccaaggtggtatttcagacctatagtactgacacttactaagtttactagttaaacagtttcaactatctacatatttgtagaggatctggaagttatggcactctataagattccataaaaatagtggcagatttatatgtcattttgggaactaggaataatttaatgggcatgtattatgtgcaatttaaaattccagtgacattggtcaaggtggcatgtctttatccttttagcttaaaacaggatttagggtggtaattctattcaaaacttaatttgtatttactaaatgggaaaagactgccgtgccatgtaagtgatagaatattttggtccagcttgaagaacacaaggagctcacagcagcagagcctggcctcataatcaagtcactccttagctggacctcggcccccctccctcctccactcttggtcacgtataacctcaggctatcttttgacctctgttaccacttgattttctgagtcttcccttgtgtcaagttggtcctctaatcagacatatgctgagttgcctggccttccttccagtttctgaccctaccaactccacattttgctttccccatcacatgattcctgcctatcttagtttccaactcaaatccagctctcagaatgttcttttcttccttggaacttgtttgcaccattagtttggcaattaagcatgcactgccttgtgaaagactctcttgtattgctgtgttgaacaactgctaaactcttgtattgtttgatttttctcatgctgatgttgtttcttcacctggtttattattagtttctctggaaaaataactttcttctctctccccatagagtcttaacggaggactttgcctaaaatacttctcatagaaagtaattttgatttatttccctgtactttcttgtacatttataaagtttttatctttctatccaagataaatgatagcatttgtttatttatgttcctaagtcttctctccatcccctctaattagaaaacaaagatttgggcatttgtgtgtgtgtgtgtgtgtgtgtgtgtgtgtgtgtgtgtgtgtatgtacgtatatatatataatccacccaccctcatcattgcgactgctgtccattattgccctgcttttcagatgcttggaaacagcagaccgacttgttatataaatacttcaaaggcttattgtaaatgaaaactattatgtttctacaaaagattgtgaaactctaggcatgagagccatatagaagttactatggtgtgaccctggccctttaggagctcacattcacagctcagagggaattgcaggctcccggaagctctgttctttcacttctgttggagctgctatcagaccaggttgtttgctggctgggcgtaggctgggcttgaagatactataattcttattctttgtcccttgttttctaataatgcctcctcttctcttgaggaaactaaagaatgataggccattttatttctcagcattcgaggaattctttcacatgctttttttcttctctgtcttctccacatttggtttcaaaaccaggggattactttgtttgcccctgcatcactggtattttaaaagcattaaacttgaaagtaatttctaactgtgagcagccatcctgacatacttttgaagaaactgtccacctcttgctggataggcatgctacacactggcagccatgccaactccttggtgatttaccacttagtaagtttttaccctcatcagagggtggtagtagaacaggaactagatctttgaattatttctctgttttggaatgaaaattacttcagggtcgagtaaggttagaaatgttgggaaaagttattttcagaataaaatttatgctttaaaatcagtttggacacatttttgttactttaaaatatgtactcacgccagttagaatggcgatcattaaaaagtcaggagacaacagatgctggagaggatgtggagaaataggaacgcttttacactgttggtgggagcatgaattagttcaaccattgtggaagacagtgtggaagatccttaaggatctagaaccagaaataccatttgacccagcaatcccattactgggtatatacccaaaggattatcaatcattctaccaaaaagacacatgcacatgtatgtttattgcagcactattcacagtagcaaagacttggaaccaacccaaatgcccatcaatgatagactggataaagaaaatgtggcacatatacaccgtagaatactatgcagccataaaaaagcatcagttcgtgtcctttgcagggacatggatgaagctggaaaccatcattctcagcaaaacaggaacagaaaaccaaacaccgcatgttctcactcataagtgggagttgaacaatgagaacacatggacacagagaggggaacatcacacaccagggcctgtcaggtggtggaagctaggggagggatagcattaggagaaatacctaatgtagatgacaggttaatgggtgcagcaaaccaccatggcacatgtatacctatgtaacaaacctgcacgttctgcacacatatcccagaacttaaaagtataatttaaaaaaatatatgtaggcagtaaaatttaaaaaatctttgccagagttcatcaaatgaagggatgtaatctaattacactctctcatgcaacaacaattatcagtatcttttgttaaatccactgtgtttagaatcattctgtcatcattactgttttatttctagtctttgatttcttttctattgcttcctgttcttctgaacaaatttaagatgatgttactgacatagtttttgtttttcagctatcaggaaattttaccaattatttgctttcctcatcctacctccaccttcccagctgccaggcatgatatgggggacagggatttgagaatcttgtctccacctgtgaatgttgtttaatttatcacacaaaagctggaattaggtgcattctattcatccattcccttagcaggagcacatactctgtggccaagtggaaacatggacagaatttatcattagtatttatagcactataacataatatgccagcatttggagcttaaagggattgaatgcggtataacataataaaatacagtctgtaaaaatccgtggattattcagaaaaatagttttatgatgcaaggtggctaaattattaaagcactgacataaatgatctgtcagtttgctatttaaatatttatttaattatgctctacaatggagttatacatcaactctgaactgtgttagaaaaattatgattaggagtattaatttatcttttattttgttttgactcttatattctggagaggcacctgagggcacaagctccattctgtctagtaatcaaactacatctcataagtgtacttcatttgcagaatatgccattttagcctgttttgagattaagcctgattttgtgcatcagtctggttatttgcacagagaggaaacttaatctgagtgttaccaccatctacttgttgtattcactgacatctccttccagatttctgtcagcaacaatttcaagtgaatcaaataggactgctctgataagctattcttccgtagcacagaaagcctgtatgaatcaaatgtcaaaattcattctaggcaaatagtttacagagaatgtgctagcctacagaagtttgctgctcatggtttttgaaataagttttcatggaaatatggtgcttagcaacttttatgaaagatacttaaaaaaatttggtgtgcgcttctggctagaagttcgatactagcctctttattatctaacagttatagtcaattctccgtcttttaaaagagattataattcattagagacttaagctaagtcttgctgtttaaagtgagtagtagaaaaagttggacaaaaatcctgggttttcatttttaaaaaattaatgacagggttgctagtctccctttgtgatggtatataatttttaagaaaaatgagaagttaaggaagtcatattttcacactattttacaaatttcctctcaaaatagtatttatttaaatatatcctatgtgttcagaaataatttttatccccagatattgatttggttcctacttgagctgagaagataaaaagaaaagtatgaagtatcatttttccttttatttatgaattttactttcagagataagctttacatataagacagtaatagcaggtgtttatacacacacacacttatatccacatacataaacatatgagtcaaattgataaagtattgtttatagttctgaaaagtaatacaaaagcacagaagtgccaagttactataggctggagtcggtatgcatgtcttcactgaggagaaacttttggatttcaaagaatgatatatttagggctgagcacgctggcttatgcttgtaatcccaggactttgggaggccgaggcgggcagatcacacttgaggtcaggaatttgagactaacctggccaatgtgatgaaaccccatctctactaaaaatacaaaaattaactgagcatggtgagggggcacctgtagtctcagctacttgggaggctgaggcacaagaattgcttgaacccaggaggtagagtctacagtgaaccaggatcatgccactgcagtgcagcctgggcgacagagtgagactccatctcccaaaagaaaaaaaaaaaagatatatttaggaaaaactcagctataccctaacctaacctattacatttttcattttaaaactgcttaaatagtagcatccaagcaaaaattgggggttacaagaaagaaaaggttttaatatatccttgcgtatcaaggatgacataaaaaaaatgtaccagaaacatttgttcagggcaaaccactttcctggctttacagggctagtgttgccatttttgatccaggctttctttggcttggcattaactaggaatcttcatcttgcaaagccagtgtatttattggggtttaaataaattaagctctttgcttctgctaaatctatggagaagtggattcccacccatgggaaagaaagcataaaatacaaatgcactgatcctacctcctatcctttttcagtctgcttatcctaattttgcttttcccaggttccttgcattgggggaagaatcacgtgtgcatatgtacacagtaacatgtacactctgcattgtcttagaacagattttgtagggaacagagctaagtgtgcatgttcattctaccatctttaattggaagtctattttctacttaataaaagttgaacgatgagcatgttttgtcacatactaaaataaagtggactcttcccctgaatatagcacatgtcaaagttaccattaggctctctggatatcttctaaaaagacttttgattgtggtagctttagtagcatctgttttgacatagttcattgttttcttgcagatgcttttcattagttttcattttgttgctttagtattccctgctggtgtctagataatccgttttattttgcatgtgtgtttaattggggggtgggtcctaggagatgaaagaggatagaaatgcttttctccttaaaatatgttatttggggccgggcgcggtgtcttacatctgtaatcctagcactttgggaggccgaggtgggcggatcacgaggtcaggagtttgagaccagcctggccaacatggagaaaccacatctctactaaagatacaaaaaattagccgggcttggtggcacacgcctgtaatcccagctacttgggaggctgaggcaggagaattgcttgaacccgacaggcggaggttgtagtgagcggtgatcacaccactgcactccagcctgggtgatagagtgagactcagcctcaaaaaaaaaaaaaagttatttgggtttttggcaaataggtgcaattcatttgttattcacttggtttgggtcactatttattatatatagttttgtggctttattcattaaacatttctggaccaagcattggtgatatcatgagggatttttagtctcctctgcccctggttggagcctgtgcagtaaaggggaaagatttcattcctgtgttcatggttgggtttcacactgatttacttttctatttcttggtgcttttcgccgttagactttcttgttactagttccatgatgatatccaggtgttcctttatagtattataatacaaaaaatgttctaagcttcctgcctactttttcttcctctggaaacaaaatccctactttttcaaatctagcagataagcagctaagtaacagaggatcagcagtttgagtgaatgactttagtgtgtgaattacctgtactgccttctaagagatctctgtattttaaaagaagatacctgtttactctaaagaatctagtggtcgaattctagtggtagaatttcactattgaagccaagagaagtaaaaaaataaaggcattttggggtgggaggaggctagagggctggatttttggcatctttggatcaggtgggcacactaccagtagtacagcctttttgaaaggcacggttcagggccatgttcacccaaagctgcttaactttcctgcttctgaattctaggttctttctgatgcctcagagtttcctccttacatagttgtagcattttttgtgtatgtgtgttttaaatcaagcaagaccttaaagattcacccagccaggtccccctccctccacactccagtggtgaacaaagaccttgttgtcactttgtcttttattttactttgttagtcatccaccaggaatgaaaaacttttacttggaaaaaatgtcaaattgaatagaaacactgttgccccaagtagatcaatgtttaaaaactgagatatctcaaaatgaagtggatttttccctagattgcctagaagttgcttgtcatcaaattcaagaatcagaaattcaggtggtgaagtatatggcaactactgttgttaggaaactcatcgagacctctccttttgtgtcacgtcctatctccctctgctttacaaccataataaagtaagcgtttaagtgatataagattattctgcattgtaacttgtcttctactttggttagtttttaaaagaataagcactcctggctaatagaggtaagaacagtttcaatgggtctggcttgtgataagatgtaggatctccagtcgtcttgtgtttttccacctgatgatttctttcacaaaggtagactcaaatatagttgtcattgaagattgtcagataaatcttattttagcaggctgtgttaatcttttttttttttttctttttgagatggagtctcactctgtcacccaggccggagggcagtggcacgatcttggctcactgcaacttttgctgtcctggttcaagcaattctgcctcagcctcccgagtagctgggattacagccacctgccactgcaactggcaattttttgtagtttctgtagagacatggtttcaccatcttggccaggctggtcttgaactcctgacctcacggtccacctgcttcggcctcccaaagtgctgggattacaggcatgagccaccgcgcccagccaatcattttttttttaaagcattttaagtgaataattgagcatttgatttattatcctggcttttctatctgggtctttgaaagggacaaaaggagcacatatacaccatgggatgtagcctggccagattgaaaactgaaaattgatggatttggagtatgcaggcagatagttgaatgctgggacagggatcctctttgctgactgcctcatggttaagcttttaaaaatttgttggttaagcttttaaaaaaattttagggtttttagggcaatgaagttactctgtatgatgctataatacatcgtggatacgtgtcattgtacatttgtccaaacacatagaatgcaggacaccaagagtgaaccctgacataaactgtggactttgggtgataacgacatgtcagtggaggttcaccagttgtaacaaatgtacccactgtgtgggatgttggtaattatcccaatgggggaggttatgcatgtgtgaaagcagggaatatatggaaaacttctgtaccttatgcgcaattttgctgcgaacctaaaactggtctaaataaaaagttacagatgcccaggttcttcttttgtagattctaattcagcgggtctgatgccggctggagcatttgtgcagccagagttaagaactgctttgagaggcctcacgttaagactgtaggaggtcttactaagtgcatgtttgggttcctttacttcacagctgtttgctaactaatcgatagctgaatttggttatgatttgttttgagcaatgcctaggacatagtaagggcttgataaatattaactctaattgttattatattttaaaatcctgattatatatttttctcaggattttaccagctttcttaaatttctgatgaaaatacttaagtcgtatgccttggataaatttctagtattcttgtattttatcactaactatttggcttagaagggccttaatgtaaacgtatgccacttatatatttgcaatgtctttgtaatttaaataacttggttagactgaaaaattaaaccctatttagtacttttacaagtaagaaaaaccccacaagatttaaaaatagtatattttatcttgtaattttgaataaaccaatccctagtgtccaaggacttacccttctgttggagggtcagaagagagacattggctataaccagttgtgttacaaaaatgtagaatgtcaaaggtgaacttatttcccactgaaataaactctaagagtagaaatatttgttttttgcagataagaagttgcaaatttagcaggctatttagcagctgtttacttagagcaaatgaagatttagataattcttcctcataagctagaatactattccattaaacttttattaccaaaggaaggcatttatggaatgcctgcagggctgtattttatgaatggctgagcaactgacatactagaactgacagaggtgtttattgtcttgtttaagcaaaaaaactttttttgtataaaatttgtgggtatttacatgtcatcaaatatggttttcttagcaagctttaagatccattgctctgggggcttttttgaggttttctgcatcttcattccagaggttggctttgggtttgttgtggagctagaatgtaaatgtgaggagtgggaattggttcctggaatagccttctgcatacctgtttggagatagaagtcctccaagtgggcacaccctagtctactagctgattcttgtgtcttgaaaactattgaaaatttctgggctgcaggagataaaaactacaactgcctaagaaataaattcgtgtgtagttatgaatgagatattaaaaggttgatattgtttaaaactaaaaattagcatttattttctttttaaaaaaaggggccatatcatagacttcaactgttattgacagtgggtttttttgtgttaataatgttggtagcaggatttcagatttttttggtgccattttccacatagcataaaaatgaaatatatttttgcatcttgtttaagcttaccgagttgcttatgagattaattatatgctcagttaagaattctgaaatatttcaaaacccagcagactggggtggaagaacattccattgaatactgctcttagacttgatgggcttggaagcatcgtgctcatgaaataagggccttacttatataacatgtaagaagggcaagtaaggagtcaaagtatctatgtgattttattaaaggtgaacctgtgtgcttatagctttactaggatttccttttaaatgattgcaggttacagttactggagggtatctttgcagtctgttctagtctagtgtgtgtttttctaagcagcagctttttaattttaatttttagcaactgaaactacattgaatggtattttgtgtcattcctgtcaacaacactgcaaaattcccccaatattctgtcataatcctttgaatcctgtggaatggaaaagatgtggcaatccttaatgaactgtgagaagttttcctttctccctcccttcctttttttggtttattctctaaggaatagtatacaagaaaaatatgttgtaagaatccaacatgtttacgtaaatctcttatctatcttaactgtttacttgtatacgtatatacaaagttttcctgattaatgaaaattaagtttgaaaaaaatttttcagttacaaaaaaaaaaaaaaaagaaaacaaaaagaaagggacgggtgctgtggctcacacctgtaatgccagcactttgggaggccaaggtgggagaattgcttgagcccagaggttttagagaccagcctgggtaagatgatgaaaccccatctgcctctaccaaaacattttaaaaattagccaggcatggtggcatgcacctgtagtctcagatactcaggaggctgaggcaggaagatcgtttgagcctagaagtttgaggctgcagtgagccaggattgtgccacttcactccaggctcagcaacagagcaagaccccatctcttagaaaagagaaatatgtatttatgtatatgtcttctatatttatgtatctacatgcatatgtttgtatattatatataatatgtatcttttttgagtatttggaaaaaacgttttcaaacttaattcttactaatgatcagggaagcttttcttaagaatcttcctttactatatcaatgtctcatttactactggaattatgtttttaacacacacacaaaattgaccagggtttctttttcctggggtttgaatgaactttgggaaagagatgtgttgacagctcccttagattggtaagaaaataattatctgataaatcacagccttggatttgagacactctctcttcttccgtatggttttattggattcccatcctcctcccccaacaatgtatcagttgttgtgtttgctctgtgcatacctttctttccttggccttttatatttgcatagtgttgtttggagctagtgcaaaatacatagcttcagggctgtaatgtatagattgcattgtgcgcttcccatcatcgtctcctcagcacacaataactgcagtgtggagggccctacacggagacagtgatggtgtttataaaacgccagtggtgtgtggcattcactacaatctgccgggtaagcagttgcacaaattcctccaagttgagaggcctccagaaatgtcatgttttggcctcagtgttgaatgccacaaataacagcacaggcatgggggactttgctcagcctctcagattccagcctgccttccttgggctgcatctgcagtagatttcatttactctttttctttttaaatgaaagttcccaaaagctagcattctaatttttgaataatgtattttgagcccatccaaattgtcttgttttgtctctcttttgtgggtatctataatatagttaggtttttaaaaaaactaaaactctgatacctggaaagtagaccaaagggctttttttgtttattgttttaaagttttcaacccgttaactttatattgctagtgagtggtataagtagggttagggagaggcagacagacgaaaaatagatagctaagcttgttgatatttaatatagaaagttatattcaaaatatttctttttgaagtgtatttggcaagttttattaacagttgcatggtttttattgtttaataaacttgatatcatattattagaatagagattgactcggattgtactttatgaagattctactgtaagaacagaaacaaagcaaaggcatgcttcagatagcaagaagaaatgacagcgaaagtgatgtcttagtggaggaatgtgcaagactaggaaaccccctgtcctttctgcataaagatgaggtatggcctactcttaagaggaaggggcagattggctttttccctctagttcccaaaatgtatttggaaatgccctagtttactaaggaagagtataagcataatgtagaattgtgaaaatgaagtgttggtctgtgctggtcttctcccagaaactagttggcagtgtgtgtttggtttaggtccttgaacattatgggttggtagtccatcagctaggtaaggaagattgtgtaagaaaccagcaggcctgaattctagactcaactctgccaactttttgactggccttatggcattgagccgttccatcagcagctatcttttggcctactagtcagctaattactcagtaggaggcattgaagtaagatgtcctctttcttaaagaactcagtatctgaaagtaataagtatcaaaaggagtagaatagaagaataagtgccatagatgtgaataatgctcttgaaggagaatgatgcaatattgagagattggaacaggcttcatagggaaggatattttggagatttgtatacaagtagaggtagttttgacacttgtaaataaatcagaggaaaaaaattagaatatgtcttgataagtcagtaagtggttctctttatctggggcaataccccaaaattgctgtgacaactaatgaagcaactacgtgtactggtatcttaggtgaaagttatgaagcaaaattatgtgtatattttgcttggttaacaaatgtatatttgtagtcctttttatacagtagaattcaagttgttgatttttttttttttaaaagcaatgttaatggaagaaaattactttcctggatagaagtgtggaatattagtgtatattaagagcatacataataatttaattattttaaaagaaattcagaaatcagactgaaaaattagataaactttctataaccttatttttcttatttgtgaaataagaaagtttgattagataatggaaaactttaaaatcatatttaaaatcaattattattttagagcagctcaaaaaggtcttgtaatttcagctggctttaatgaatccatgtaataagccaaacattttattgatcactttaaacatacttcatttaattatctcatcaccattataaggtgggtacttttaaagagcggaactgaggcatagagaagttacgtaacttactgtggttacagagctgttaagagtagggctgggggtcaagcccaggacactgtgattatactgcagtacttttcttccgtattgttaagaattggtgattctcaagaaagatggaacataccagaatctcgggggaaaggaagaactattttgaggaacaatttcaacttacatgcccctgtacatttttatgtgctaccattatgcattgtgccttggttcttcacccccaccccaaagagaattattatttatggaatgtgttgtgaacagtgtgaagacaaagttgtgagccactagatggtgttgctgtctgagccgacccaatcgagtttgattgaacattagtgctataaatgttataacttggaacattcatatgtagcatttaatatgtgtcacctgataatctgatgctttttagaatataagaagaaatgtactacttattttgtttgcctttttgaataagcctccaaagcacatctgttttaggtttcttaggagtgacttttctgtgtttttttgttacaattttccttctcagtccttctttttattccctagcttatgtttcattccctcttgtcttgatgactttattatagctatttaaaaaaataatgcgtgttagaaccttttatatgttgagtataaataataaattagtagaataaaatcattgtagattaataaattttattaattttgctagggattcattgagctttcttaatttgaagttttatagcgttgtttcttttaatattgcctttcccttattctctctcatctccatctaggactctgatgagatatttgtagacccctcattctgttctccatgtctgtgaagttctttcatattgtccttccctttgtctttctcagccacattctggatagtttttttcagatctatcttccagttcactggttttctcttcagctttgtcatatcctgtccatttggattataatttagttactatagttttcatttctaggtgttttatttgattattttcaaaacctgctttttcatattcactttttccttagtcatattttaaaatatttcttataaacacataaaacatatatattttgtgttttgttcttgataattctactatgtgcagtctctgaagatctgattctgatactgtgtctctcaataatggtgtctggtttccttgtcgttttgtgatttttaatgtatgttttttgagatttttgtctatgagaatttcttgcttctcccaggcagctgggcatatctaatcttggaccagtttaaactggattatcttttggcatttttgaatcaaacagatgtgaataccagtgtctacatctgcgttagagtcagatggtggtacaggttgagtatcttttatctgaaatgcttgggaccagaaatattttgtatttcaagttttttcagattttgtaatacttgagcactccaaatcaagaaattggaaatccgaaatgctccaatgagcattttctttgagcataatgttggcgttaaaaaacttttggattttggagcatttcatattttgggtttttggatttgggatgctcaacctgtaattctttcctacctcatttagtgaggtgtggtctttaaaacaaaaattctgttgtagaatacattagtaaatgttgtattaaaaaatagtgggctcttttgctaaatagttttgggaaacatcaggtttcccaagtgaaaggaataatgggaaacagggtttttgcattgcaggactcctcagggtgtctgttatacaaataggtgttttggtgctcagtaatcatatgcaacaaggagaatttttcttgtctcactctgctgctctttttgggaatgaggggtgtatataactcatgggatgagtgggaccagtggaaaataactttggcaaatataggttggcctcgtgatacctttggcttctgctaattgccttctcgctgtctttcctactgtttataccactttatgactgtgcatgtatgtgtgtgtgtgtgtgtgtgtgtgtgtgtgtgtgtgtgactgtctgtcttgtatttaatctccctgagggaagtcgtgattctatctgctattcctcatccccagagcaaaagattgttgttgtgcagagctcttgtatcaggctatcttgtaggctactggtcacttttctttgagccaattgggccaggtacctaattatgtccaaattggtagatacataatgctttatttttggcttcccattcattctctttctctgccagttgcatataaatttcctgagaccatgtttgtcgtgctcatcattgattccctggtatcttaacataggaactgacacatatgggtcaataaagattgagtgctagcttggcaagtcctcacagtcatctgagagtcggacagggtaaccagcagtcatatcgcatggcttgtttattctggatggcttccttttttcattttactgtatcctccagtatcttttgaacagaaattcactcagtctctataaacatccgaagtaaaaagtaagctctataaacatccaaagtaaaaagtaagttattttgaatatctgttttctctacctcaaaaaatcatttcctcctctaagattcccttcagatatcatattcttggcgcagctgtgatttctgttagtcacatttactcattccattcctggtgttctgatagcactttgtacatcgctctctcaacatgtgcttcatgtgttgttgcatttttgcttttccttccagattttgagttcgttgagggtggagaggcagatggaagcttaagtaatgtgtatgtgcaatcaggatctcatcaagcattgagaatatctgttccctggagagagaaggaaagaatagtagagaagcagctttagcatctagaaacattttggtgtttgttagatgtggactagtgaaggaatagttgacagtagagtactgctatggttggttgaggcatattccatctcactgggttaattttattctcacgtgagctctgaggtagctattaccctcattttacagacagggagacttaagtggttttactttgtcacactggtgcggtgcagtaatagtaaatgcttacaaaatgttgaatgatagaggaactaggtccgatagaggaactggtccagccatcatgctgatacctcatgtactgccaaattgtagtggtgagctgtgtggatgttttttcctcttaatcttgtaaggaaattctgcccatgagggcatgttcctatttttgaaatggaaaccaatgagaacatgtgaattattagtaagagttgacttgaagctagtgttggaattggaacgtgttttctccttgaactgaggtgtatttttgtagacatcagttgtcttaaatatcctttttaccctaatttcaaatagcatcataaccaattgttatgtactgcaactcttttagtactcaccgcacctcctgtggtatctgctatctgttatccccatttcacagatgagcagattaaggcaagcagacgttaagtgtcttgccatgggtcacatagcttgtaagtagtggaagtgtatttagaactttggtgtttgacatacagagcccaatactcttattctctatgctgtatttgtatatacttttaatatgtagacaaacaagcacatatctatcttaaacatgctcagtaatttaattgactattaaatcctcattgcaaacctgtaatatgtatgtgacacattgttttatttttaaattttttattatttatgtatttatttattgagacagggtctcactgtcacccagcctggattgcagtggcgtgaacacagctcactgcagcctcagcctcccaggcttaagcaatccttccaccccagcctccggagtagctgagactacaagcacacgccaccacacctggctaacgtttgtattttttgtagagatgaggtttcaccatgttgcccaggctgatcttgaactcctgagctcaagagatatgcctgcctcagcctcccaaagtgctgggattacaggcgtgagctaccatgccaggccttacactgcttattatgttgaaataatgttatctgtgtggcattctccttcttccctttacaatttgatgcaattctattcttttcagaaatgttaccataagaggcttaataataaaaataccagattctcctcctcaagatacatgtgtggggaacattaattttcacacactggatgagctagtacacattttgatagtgagagggcattcgttttgaggatggaaaagtctgatggctttttctttttcactagcagtgcattggtggcttttatcagtgcacctggggaggaggcgtgtgtctgacctgacctcacagttgggttgttccaggggtgtgcatcttaattggagatgagtcaccactctgcttatgttttgccattgaagagacaatgagcttttcttctatggctgtcaaaggctcttacatctctgttcacagcagcttcttaaatttatatatatatattcaaggtaaaaatatgttaagtccttaggggcagttgatttcttgtcccacttccattatcttgtatttttagaatttatcccaaggagcgaacaccatatcattttctaggaaattgtaaataggagcatagctcatatagaaaataaaattctattctacagatatcatggaacaaaaaatcaaacatgaaaccaaagtgttgataggataaattatgttaggatctactgaataatagggctaaatgattttcctggggagtagtgtactttatagatatgagccaccttgaggaattgatggaagcagtttgaacatttttgaaataagaaaatgaacagctaacattttgcctttttcgtcctttttatgtctatattgagtagcagtaaagcagacggtgcttgcttatgcttttgtttcagattttatgctttgtatatgtgtgcagggtgggagggctaaagttaaaaaattaatcacttttatattgttagaaaatgagaaaacaaatatttaatgttaatttataataaatcatgtatctgatatgatgtcttaaatttatagcagtcttggaatctttagtacttgaaaagtaaagttattattttttctccagaaacatgccaagggacaagtgttatttgacaaagtgtgtgaacacctcaatctcttggagaaagactactttggacttttgtttcaggaaagccctgagcagaaagtaagtgatttcaagtttatttttatctttttagaacatattgtatttttttattaaccagtttatctcagtttaaaatttagctttaaaataacttaggtgtttattatgacttcactgtgaaatttggtaaatactgaaaaactatcttgtgtagagagaaaccacctgtagctttttggtgtatgtgtatttgtgtgtgtgcatgcatatgtgtacatgctttgcacttacatcatgagcagacagaatagaatgtcatcagtggaaaagtgatgttctggcataaagagaacacagaataaatggtattattttaatcacttttggctctcaatcactcagtctggcctttcggtactaaataagtaaagaagctggtcacatctgctcatattgtgcagtcacctgtatgctaggtattaaagcatacctgaaaggcagggaaggcggcacattggaacgattctgtctgaggataccaagaacacttggtcacagtgaaagggattactctccatgatctaacattcaaatcacagtcagcagaacagagcaatcaatagaagaacagaagtgtgaattttatttgcctacattgctatcgttgttagtatttacatgtcctactaatgaaatataagataataagagtgataattatatatactttaagttttctcaacttgcttagctttaaatacttgatatctaatttgtggtttaattctttgtttagactaaagacagttaaattacatgcctgcctgctgaatactacatgagtattcttaatagaactctgtttagagtactgttttcagacgtaatagcacatttgactgaataaactaggttttttagactgtaaattataaggtggtcttgataatgtttccaattatgtgctcttctgtttgtcctaaaagctgcaaaagagaaagtggtgggaatttggctaggattacctcctttttttgagatcacatactggtagattcataggagcatataatataatctttgtaaagtagagggacaattcagtatgttgtacaatatgtagaataacatgttctcttagtaggcataggatatactacattaagaaatctgggctaagcgtggtggttcatgcctgtaatcccagcactttgggaggccgaggcgggcggatcacttgaggtcaggagttcaagaccagcctggccaacatggtgaaaccccgtctttactaaaaatacaaaaattagccgggcatggtggtgggcacctgtaatctcagctactcgggaggctgaggcaggagaatcacttgaacccaggaggcaaaggttgcagtgagccaagatcacgccactgcactccagcctggatgacagagtgagactctgtctcaaaaaaaaaaaaaaaagaaaagaaatctgatatttttgaaatactagttttgcataagaaaaggtagtatttagtagtatttatttagatagtaggatatactgtttttttattttgacaactctcaatttatgtcaattcagctttcactgaatctcagactcatattcttaattgcctactggatgtaggagttggcaattccctctgtctgtcatctacacatttagtacacaccttgtttgttactctttctccccattattctatgaattcctcgagggtagaggccatgacttacttatctgtatagcctccgtatatgtagacattaactgctatttattacgtgtgtgttatatcacacctataaggatctccactctcatgaaaatagaaaatagcaagtgttggcaaggatgtggagagactggagatgctgtgtactatgggtaggaaggtaaactgatacaaccactctggaaaacagtgtggaagttccacagaaaattaaaaatagaactagtggccgggcatggtggctcacacctgtaatcccagcactttgggaggctgaggcgggcagatcatgaggtcaggagctcgagatcagcctggccaacatggtgaaaccccgtctctactattaaaaatacaaaaattagtcgggcatggtggcatgcgcctgtagtcccagctacttgggatgctgaggcaggagaatcgtttgaacccgggaggtagaggttgcagtgagccgagattgtggcattgcactccagcctgggcaacaagagcgaaactgcatctcaaaaaaaaaaagaactccatgatctagcagtcccacttctgagtatatatacaaaataattgaaagcaaggtcttgaagagatatttgtttacccatgtttattgcagcattattcataacagccaagagatgaaagcaacataaatgtccattaatgggtgaataaagaaaatgtggtgtatacatacaatggaatatgtatgtacatatcaatacctactcagccttgagaaagaaggaaatcctgtcacatgttgtatcatggattaacctagaggacaccatgttaagtgagttaaagcagtcactaaaagacaagcactataggattccacttatatgaggtatctaaagtagtcagactcatagaaacaaagagtagaatggtggttgctaggggctgggggagggggagttgaggaattgtttaatgggtagtgtttcagttttgcaagatgtaaaagttctagagctctgttggacaatgagaatgtagtttacattactcaactgtatattaataaatggttaaaatggcaaattttatgttatgtgttttttactacaattaaaaataatcccactacctgtgtacaaaccagcgtgctcgctgctgaggctctaaccgtaaacggtgaggacgtgactctgccctcagagatgcccctgcttatgttttagttgagaaggcagagtggaaaagctaattctgcagttagtgaattttgattactactctgcaggaaaaagtcaggatgctaacaggaggactctgcttaggaggaagtgatccttaagcagaaacctcatgtgtgagtggactttggctgggtgatgggacatgggaagcacatacacgaggccctgagactggagcagctgtctgcttaaaaactggaaagaagcctggtgtgggttagtaaggggagaatgagattaggctaggggaaagactgggtgttaacaaggctcagatcatgcagggccacttaaggctatatgttaaggcttgggacatttcctttttgctaagaaaaatggcaaaccattgataggctgaagcaaggatatgagatgaccagttttgtctttaaaaaggtcactttggttgatgggtggcatgggatgagaggggacttgagtagggctgtacacccaaagcacaaaagtagccttgagtaaggttttggcagtggaagtagaaaagcgaatgattgaagagagaatgaggaaggaggctgactcaatctgatgaatgattgaacatgaaggatgacagataccaagaattaaggcctgggtttctggatggttggagttgttcagtaagaagggtaggaggactcgactggggggttggtaggggatatcatgagtgtagtttctgacatattgagttttaggttcaataacttacggaaagagcaagtaaataaatgaatttagttttggaggtgtcttaaagaatgacagcttgcatggaacaaatactccactctaggtataatctgtcttagcagtgcagggtgcatggggtagctttatttcctgatgtgaatatcatattcatatggaggcttgtaaccaggagtacttctttgtaacttacttgtttttaaaaaaatcagaggtggcttttaccttgcaaatattccaaataaaatataaatggctgttaacagctgatcattctggtattctcactaggcagcaggcaccttccctgtgttgtctcatgtagttctcagaataaccctaaaaggtaggtactattaactacacttatagatgcagaaatttgaggcatagaggaagttaaagaagtcacccaaggtcacctagccaataaatgttggtgataagattcaaattcaggcaaaaaactgagaaggaaaaaatacattttagattttaaggaaaatgccaacagttgtaaaccttctgtcagtcaaggtaaaaatgggcacagtttttcatagctatcacaactggaagtagaagaataccatgttgcctcagaggaatttttcatgttctcaaattctgaaagtcaccttgcaagactttaaacatagtgtgttgaaggacattgtaagctgagttcctaggatgagtttcacagttgtcatttctattatattgtcaacaaatttaagggcatgagctaacttattgatggtgattctgtgatggtctgtgccagtgctgctcaaaagagacttcttcctttgtgttagaatcacctgggagacagattttcaattaggaatcttatttatctctcttcttcctccattgttcgtaaacacacgtgcgtgcgtgtgcgcatatgcacacacacatagaaatgcacattcattgggtatgccatgattccttcctttccagttaaaaaatagtgccattactgtttaatttacatataggatgttgaaggatgttatgggctgtgcttccagcagggatatgtcctattcctcagatatgttgggacagaaaacagattaacctttggtcaggttgatattttcaagtatatagctttccagtaatctaattcagtgatagagcttaatataccctgtcctaaataccagctggacatttattagggactagataggagagacacttgcaagttttactacctgacaagggcctgtggtatgaatattttatattggtatattaaagcagatctataaattttggaaatcatatgagcagtttagtgttgacattctattatagctattgagaattacggccagtattctggatgtgggcagggaagggacattttgcacagaagaaaagtaatcgttccagcatgaatgatcatgatgtgggtgcggagtttaaagtttgtccggagggctggaggatgtggcagttccagcctctctgaataggaaagacctgtgaggggtaggcaagctggcagggggaggtagggactcgtgttttctcatgagcacactgttttaacttagatcatgggttaatttgggatgactttgtggggagtgctaatggagtttatgggaaagcagctggaaaaataagcaaatatcattctttggatcttgtatctcatgctgaggaatctagattttaagtaggaagtaacgtggtcagatttgcatatcagaaagaacctgttgatggtgtggagcgagatgataggggactgagaccagaggcaggaaggtcaggagacagttgcggtagtctagtctagaggtgatgaaaaccagggcagtggtactaggagtgaagaggaaaggacagagattctgtgtaggtaatgtctgcagtcactttgtgactgccacctgttagctatgacagcgaggggagagttgaggaaaagtcctaggtttcagggttgggtagctggggagcttgatggagacttttacacagggaccttggaggaagagcagcagtttgaggtatgctagggagcggagatggaacttaatttttattttgccaagttggacacgtttgtaagctgttggctagattggggatcagggagtaggtgaaggatgaagaaatttaaaagtaaagaatttgagaggccaggtatggtggctcatacctgtaatcccagcactttaagaggcccaggcgggaggatcagttgagccctggaatttgagaccagcctgggcaacatagtgagactctgtctctagaaaaaaattaaaaaattagccaggcatagtggcatatacctttagttccagctattcggaggaggggagaggggtgctgaggtgggaggatcacttgagcccagtaggtcaaggcagcaatgagctgtgattgcaccactgcactttcgcctaggtgacagagcaagaccttgcctaaaaagaagaaagaaaaaaagagaaatttgacagtgagtgtaaattgttgtttaaagaagtgtttggctgtggagaaaagaacagatgggagaatgatactagaggatgtaaacctgcaatgtccagtacaagttttcatgatgatgaaatgtttgatacctacactgtccagcatggcagccattagctgcatatggctattgatcacttgaaagagtgctagtgtgtacgaggaaatagacttaaattttatttactgtaagtaatttaaattgaaatagcctcgtgtgaccagtggctatcatattgcacagtggtgacagttgactgagagttttggggttggcagatttactttgatggaaataactttgactttagctatgagaaaacccaagagaagttatgtttgaagaaagaggagagtgactatgatgatgaaagtcatgaagaggattagtcttgaataaagatgttatgtcatcctgagtctgcaagaaacagaataaaaggtggtgcagttgttaaaaaaaaaaatcttagttgagcaaattgtagtctccaatctctgtgaaatagagggtaaaagcatttgcttaagagtgactagggtagcagtgggacaagagaaggagccaaccaagaattagtatgtggattgctgttaatagttctgctgagattgtgggggtcatacatttgggatggcagcagaatatatttgtgtgtgtttttctctaattgccattagcaaccttagtgtcatagctgaaaaaatggagtattagcagggttctcagttgactatgttcatggaggcaatagtaagaggatgcaggattgtgaaatctgaagttgctgatgagatgtaattaagctgattattcacagggtcacaggaaagaaaattactgaagctgtaataggctgatacattgggagaacgtggctggggcaaaggatgaatgttcaaagatgttgaagagtaggtacagtggggatacatgggtagaaaattagagggagaggaaatgattgcatctgagaatgagctgatgaagtctaatgaggtgaagaactatgtgatgatgacaagacccagggtgtggctgtgaaaggggatggctgaagtcaaggagacagattaaggtcattaaggaagaaaatactaagataaaggtacatttgtttgggtctactgtagcgttcttattgacagaaagacactaatgctaaataaggaattcataattccttattatacgtggtagtttctcttatgaaaggtaagatgaacatataaaattagacacatgctttgtatatagactttaactcaaaaactttgggaacttaagaatgaggtgtcctttctgagacattcacttttcaggtgtgaatatttaaatacaattagcaatatctttaattattcatatataatctgatttgctataacttttatgttgtgtaatttttaaaaatttctatctgcttatgtagacaaaatccagtcctcaagacatctaggcaaaacaactcttattcttccactatagatttgtatggtatcctattttttcccccacataaatttattactattatactaactcagctcaatcagtcctgctttgtttaaatcccatgcagttttaacaacagaatataatgatgtaaggatctttcctttccatgccgaatattatctgtacttatgggaaattttgattcttaattcaacccattataaagtaaaggtgagtgaaaaccacgattatttgtatacaaatttttcatggagagaaaatctacacatttgtttggttttaatacagtactatatctctcatggttgagacactgaggtgaaagtctttttagttcattctaggtatgaaaaatctgtcattgttagtgttaaagcttttttaatgtctattgagagtgcttatataaactttactatggaaaatgttgttaaaaatacgtggaatcaggcaacatgttattcaatatggaattccaagtccatatagttcttgtattcatgtctaaatgaaaccatcgttaagggttttggactctctttaaagggaaaaatattgtcttgaatttttgatgttaatagtttggcatttggcccaaaatgacattataacgtcattttgctgcaagctatattgaaaaaggagcttgttagaaatgtagttgatattcacggctaactttatgaaaattagttgaagcagtcatctaatagaccattttgttccagaaactagaactaaaaactcaaatattaaactgtttgcatatataaactattctttaataaagttctacattcaatctagttaaactttataatcccacattctcccagatgtgtagtgaatgtttcactgtgatacagtgcctgtaacttttctcctaacaccagcattatggtagagttctcttaaacccaatttaggcaaaggtatattaaaggggatctgtttcagcactataaattcctgtgagaaaatgcagattctagacaaaactacttttaacatttagtcatacactgtgaattgggttgaatttgttaatttctcttacctggccaaattagagatcacctaaagcaagtgaggaaggcatggcgaggcatttgagaaacttcgaactctggggtcttagggtctaacttaaaggagaattaaatgaatgagatagatttttttggggggaaaggaactgttaaagaaaaacttattctaacacttgttaaaatggtaaggcagactttattcaggactgttgtaataggtataaggacctttgcagtggggttttgcagtaggcaagagagattgggctcagctccagatacgacaaggagaagtggaaatttatagtcaaggagcagggtgggggttagtagatgggaaactaataagaggaaacatcaggggtgcacttaggggaattctggttaaaccaagctaacaggattcttgttgaaggcaggtgagggtgatctgatatcacttgggggatggtggaggatgaggaaccccatcagatatcaagggtaattagttatcaaggatgggggtttcccactaaaccaacttattaacaggattcttgctaaagttggatggtgtgtagatggacacagaagtctaaaacctgaagcctaattgggaagaggattcagaggagcctgactaaagtttggtcaagaaaagactctttgtcttaactagaagatggattttatgactgtattttgggttgttatccaggtcaagcatggttaggaccctgctgtggacaactgcacacccagactactaatgccagttgatgactgtggttgcatatctcttctcaggtgaaagtggttagcaagtagaataaaaagacctggaattctttggtacagctgcttattgtgatggggaggagttcaaaggaacacttagatatgggaatgtggaaactgtgccctgccagggctttctgcaggaagctgtcaaaaattagaaggtttactcagtgaaggctgacaagccagtaggacttgaaaaatgtctctctatattgagctttcaggaaaagaaagaaatttctacataaaaagaactctagggctatcctactcaaagagtggtccaaggaccagcagcgttggctccacgcagaagcttcttagaaatgaagaactctagcgctcaccctagacctgctgaaatagactttattttggctagatgttcaggtgattcatacgcacctttaaagtttgagaagcattgatgtagggataaactgttcttttgatgtagcagagagcattacaggagtttgaaatgtcatgaaagccacgggaggaggggagtcctagtgggcccatgtggttcatggtcccagaagtgttcaaatattcgtagccactgaggcaagagttaggccgttccccaaatatggacatttggaccattattctgaggttctttctaacactggtattctatgaatataaatacagtattaggattcataattaagctttttttttccccctagatgtttctgtcactagagcataattgagaatcatgtttaacactttttctgggaacccgtaatgaaaatgttgtaggggaaatgtcataagacaagactttcatcctcagatttgtggcaaataaagagtaagattaaggagattctctaattaactaatagaaagattttagtgtaaaatacatataagtacagctattcactgtgctgcttagtttaaaaaaaattctgtaaccttttaaggcaggaaaaaaaaatcccacctctttttgtgccttgaattcctttggcagtctgctgaattctataggctgcttctcagaacagtgttttcaatgtataactataataaaagtacacagggctacaaagaaagccaataactaaataacattcccaaaatagtaatctaaaattggagacaaagtaataggtatgtatattagtctgttttcatactgctgataaagacatacctgaggctgggcaatttacaaaagaaagaggtttacaattccacatggctggggaggcctcacaatcatggcagaaggcaaggaggagcaagtcacatcttacatggatggtggcaggcagagagagagagcttgtgcagagaaactcccgtttttaaaactattagatctcgtgagacccattcactatcatgagacagcatgaagatctgcccccatgattcactcatctcccaccaggcccctcccacaacaagtcagaatcatgggagctacaagatgagatttgggtagggactcagagccaaaccatatcattatgtgtttttatttatatattaatcatcagtatcaaatctagtagctactgtgacttcaaaatattggctagcataaatggtattttaagatctgcagctactacaatgtgatgtggaaatgtttttgatttctgcaggtgacaaagaggttctgctgatattaaccaggtttttttctgctatgttcctaattgacagtgatgctaagtttcagttagaagttagtaaaaataaagatggaacatatttccccaaacttgagttcattacctcccaatttcatgtttgaaggtgatttaacaatacttgatattctttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccggtgatttaacaatacttgatattctaaggccacattttaattttattttacttctgttggaagcctgttttaggattccttataacttttattattagtctcttattttacctgatgttcatttaggagataaatatttactgtgttcatgttttgggtttggattagggaatggagaggagaaagtaaggagaatactgaattgagtaagtgactgttcctgctcttaagtagttggcaaaatccttgttttattttttttaataaaacaagataaattttattgaaatctgatataggtcagctctcgagttttgcatggttgcttataccttaatgtttgggaaacactgagaagatccctgtcttgcctgatcttgaattgcctgaagctgtcactttcctgagttccttccctggagaatgttttaggatgttctgggcagttgtccatggacaaagagctgtcttttaaaaaatttgccgggtggatttttaccatcggccaaactggataatactttaacatgtacatagaagctcttagactagtcatatagaaagggcttggttttcatgtcatctcgcctgtgaatacagtgaccctattttgtgaaccgaaagtctgatttattaactttttgtgggtagaaatattcatatagagattaaattctttaatgtatataacacatcacctatggatatataaaattatgtgaagaagatatatataccaaaagatgataatttagttttattattgcaaatagtgatctactaatgatgatctgctggggaaggtacttgtatgcatatttattcttcaggcttgaatattgtttgaaaagaactaccctatgaggtagatgttgtgatccccattttgtgtttgaggaaattgaggcttaaagaagccaaggaatgtgcccaagttagagttgatagaaaaccagaattttactgcgtgtatttctgattccacggtttatatatgtggccacagcagacaaatctttaagtctaaaacctggcaatgaatactgtagtgtatcatggggtgagggcggttgttgtatgttgtgcacacacaccctcatgcatttttctcattctctgatggcattttccatctttttgtgtctgcttcttggtctgctcaaccctcctccttaagtgtcaaaccaagaaattaatttttattatttactgtatttatttaaaagttttgtttgttatttctttgtaactggtaatgcagatcattaacttgtatttcttttaagtcatttaagtcattttttttttacttaggaatttatgatgctataccccacttaccatctaagtactcattagagatatgtattcaagtaaaaataaatgtaataaaagtaatataacgtgatcatttaagatgatcacagcgtggagaggaaggaggcaagcaaggggcatatatcagtcagcaggtattaatttagttctcactggttgcctaaaactgtattaagtaccctggaagatataaataatatggtctgttccagcccttgcaaagttgtagtactggggagtgagaagacagcctaatgcttggcaggaatggaacttacagtgtgaaagtgagtgtggttaggaaagggaaaacgcggtgaggaagtcatgctgctgtttgatcacatcaggtaaaccccgcccacttagtctttggatggttgaaagtaagccatttcagccttcagtaatctgtctggcagtgttgtggaaagtggcctgagaatgacaccaagtctgaatttggctgtctgacttttcactcatattgctgggtttatagagctgactcttaccatgccctatagaaactgttaggtaatttgtacaagggccgggtgctttaggtgagaatagaaggtgccaggtggctgggacacagggttagtccttgggttcacaagcttccaccatcttctggaacagagaagggtcctttgttgctcttctgtactggggatctgtatcactgctcacacttaatgaaattggggatttggaagggtctgtctttaagaccagcactttctcttaatttctctgtgttaatattctggggactttttttttcttttcaatttggcgccattcaatttcgtttttcttgctatggttgttccttgggtgaaaattccacccatttgcccctttctcacctctctcccagcctccaaccagtgtgggctagaggctgaatgatgtgttttttcattcctgtgcacttatcgaggctggccatttgtgagccagctgttgggtgggacagcagctgcagtgcatgcaaactgaatggcaggctctcttctgaaggggtaattagagctgctccctcacatggcactggaggcacccttagagaggcctgctgcccctcacgtcagtagtgcatgcagctgggacaccagtaatatgaaactagaccatgctctggtagttctttattgagaggtttgaatataaccagtgttagaacagagccatgtacaccttggatccttgctaccccgagtgcgggccatgaacagtagtgaaacccgaggggccatgcggctctgctttcacagcatcttactgttttactttttaatagtgtcagttaatgttccgttataccattttaatatggtattaagacagcaggttattttctgtgtactaataagcattttaattgtttgctttatatatctgaataaaattctgtttaagcacagatgttgtaatacagtggtccccaacctgtttggcaacagggaccggttttgtggaagacaatttttccacataccggggtgggggtgagggaatggttttggcatgaaactgctccacctgagatcatcaagcgttagtcagagtctcataaggagtgtgcagcctagatccctctcttgtgcagttcacaatagggtttgtgctcctctgagaatctaacgcgggtggtgatctgacaggaggcggtgctcaggtggtaatgcccacttacctgctgttcacgtcctgctgtgcagcccagttcctaataggccacgatcggtaccagtccgtgggatgggggttgaggacccctgttatattattttggacactgcttagaatgagtaaaacttaattagactcatttatttgaattagtttattgtacctcaaaaattgcacttctcctatgttagtgataacttgagggtagaaaaatgtaaatataaaaatataaacaaaaaaatctaaattttttattggacttttgcttgtagcttcgaaaaacaaaaatttaatgtccttgggtggttcgaacctagtggtttaaatttggtcttttttgctttaagatgctgtaacagtttcctagcatttttttaaagctttcttttttgttgtttagttggagagtttatttaaccattggatgtaactattgacttgttttctttttttttattattattgtactttaagttctgggatacatgtgcagaacgtgcaggtttgttacataggtatacacgtgccatggtggtttgctgcacccatcaacccccgtcatctacattaagtatttctcctaatgctgtccctcccctagccccccacaccccaacaggccctggtgtgtgatgttcccctctccgtgtccatgtgttctcattgttcagctcccacttatgagtgcgaatatgcaggttttctgttcctgtgttagtttgctgagaatgatggtttccagcttcatccatgtccctgcaaaggacatgaactcatccttttttatggctgcatagtatttcgtggtgtatatgtgccacattttctttatccagtctatcattgataggcatttgagttggttccaagtcattgctattgtgaatagtgctgcaataaacatacgtgtgcatgtgtccttataaaagaacgatttataatcctttgggtatatacccagtaatgggatggctgggtcaaatggtgtttctagttctagagccttgaggaatcaccacaccgtcttccacaatggttgaactaatttacactcccaccaacagtgtaaaagtgttcctgtttctccacatcctctccagcatctgttgttttcctgactttttaacgatcgccattctaactggcgtgagatggtgtctcattgtggatttgatttgcatttctctaatgaccagtgatgatgagctttttttcatatgtttgttggccacataaatgtcttcttttgagaagtgtctattcatatccttcacccactttttgatggagttatttttttcttgtaaatttgtttaagttccttgtagattctggatattagccctttgtcagatggatagattgcaaaaattttctcccattctgtaggttacctgttcactctgatgatagtttcttttgctgtgcagaagctctttagtttaattagatctcatttgtcaattttggcttttgttgccattgcttttggtgttttagaaatgaaggctttgcccatgcctatgtcctgaatggtattgcctaggttttcttctaggattgttatggttttagtcttatgtttaagtctttaatccatcttgagttaattttctataaggtgtaaggaaggagtccagtttcagttttcggcatatggctagccagttttcccaacatcatttattaaatagggaatcctttcctcattgcttgtttttgtcacatttgtcaaaaatcagatggttgtagatgtgtggtgttatttctgaggcatctgttctgttccattggtctatatatctgttttggtaccagtaccatgctgttttggttactgtagccttgtaatgtagtttgaagtcaggtagtgtgatacctccagctttgttctttttgtttaggattgtcttggctatatgggctcctttttggttccatatgaaatttaaggtagttttttctaattctgtgaagaaagtcaatggtagcttgatggaagatagcattgaatctataaattatttttgggcagtatgatcattttcacgatattgattcttcctatccatgagcatgggatgtttttccatttgtttgtgtcctctcttatttccttgtgcagtgctttgtagttctccttgaagaggtccttcacattccttgtaagttgtattcctaggtatttttttctcttagtagcaattgtgaatgggagttcactcatcatttggctctctattattggtgtataggaatgcttgtgattttcgcacattgattttgtatcctgagactttgctgaagttgcttatcagcttaagtagattttgggctgagacaatggggttttctaaatatacaatcatgtcatctgcaaacagagacaatttgacttcctttcttcctatttgaataccctttatttgtttctcttgcctgattggcctggccagagctgccagcacagcagtctgagtaaagctttcttaaggagttccttgtgattgctacttccaacttagaatgaggttaagaagaaagaagggtgttatattaagaccaggaagggaaatattgtctccaacctgaccttacctctccttacaattatagagttggagggaaagggaggattaaggaggaggagtagttcgttttaggagttgagataattgtgttcgcttggtatgtatatacttttagccaacagtttcaattttcacactttatccttcatgactaggaatccattattgtccttgaagagctctcatttcagtgtctgcaggggctatttgttggcagttctacagaataagactgtgtgaagatatgtctcatcatttggaccattttagatgcaggagaatgaggcccatgggacccaccttaaaagcatgtgaatattttacttatagtacacacttaccacatttacacacatatgtccccaaggacaaagcaatacttagcccagtggaatgctgataggtgcaagttgctttgaataatactttattaaaatgtgtttacacttaaataattatgtgaactgtaaactgttctattttagactctagaatatttcttatgaattaatttttttccctcatgcagaactggttagatcctgctaaagaaataaagagacaactgagaagtaagtatataaataatcattctttgaagttaaggtgtcttgatatctatttgtgatataaatgatcagtaatagaatggtcagttctattttgcatttatgccatcttagaagttaataatactaataatatttttgtggaattgtgactgtttcgtacatggctcaggtgctcctacttttgggaaggttctagactcacattcctaaatattcactcagaatgtcctaccaagtaacatctgacattttttttctgggaaagaaagagaaactacttttctgtaaattttactttctatgtaaattttactccagtgagacctgatactattgctttgtctgcttcattttgaaagtgcataattagttcaatatgcacatctttggccacagagacatagagacactgttcctggatgtactggagtgaggactctttggggagaagcaaggggaacaatcttttcagttctctgaggtcactgccatctctgctcattggttctacaatccaaggccactttgcatactctttgagcctgggcttgtagttaggcctcattgttcatttcttccccttttcccatttgttcttgtacaatcccaaaatgactccaagagtcccactctaaccagcttcagttctctctatacgttctgcctctgcaggttgttttgcctgtggctgtttttttggtatctgtgccaagaaacatgataaatagagagaaatctctgttaggggatctggatacttaatttacttcagggtctgtgaatgactgaagcagagaaggtaggcagctacaggcagttggaattttcggtctggagaataaaatctgaaggctggtaaattcctaacagccttcctcgactgtggagcccagagttgtcccaggagaaacctcttctccaggtgccagcatgcaagatgccctttgtactgttgatttcatttccttacttacttattattcctaaggtcaaaatactgaaaccaatctgtcctttcccttcttgcccttttcatctaccatctagctcccattttaggttcttcacatttgttttctttatttctttctctctcgaattatttatctttttggtagtcttcctgtcatttctttgcttccctactctctttttttattctgagcatataccttatttttcccatttcctcttcctgtagactcatctttcttttcctttttaaaaacgtctttgattagagtgaccaacctcctgatttgcccaggactgaggggcttctcaggatatgagactttaagtgctaaagctggaaccagtcccaggcaggctggaatggttggtcactatccttttgattattattcctggtttcccacattctctttcttgcatttattttcttggtgtttcatccatttatgcttgcttcatgatggaaaagggagaaaaagaagaggaataagtagacaccagatacattatgcttaccttatggaagaaacagtaccagagctttgaaactttttcctttgtcccttctgcagttgttactttgcaaagtgcatgcattcaaaaaggttacggatgcttagttcttacactttctctgaaaccagacctgccaagtgacccaaacagagagaacagggcaacctctgaaacatgattgatgttccattgagttgtttcctatggttttgtttgggttcttgtttgattattattattattttttttttgtgccactctcttcagagtcatggagatttcctaacttttggaagccaaacctcttgccgattatgaatcatgttcttatgttttgattatctgtgaagtttcaaaaagttatttcagaacttttacccttgtggtttggcaatatgagtaacagtaagattagactttttaaaactgttggaaccagttctttaaatggcatcctgtactgtacccatcatgaaagcaggctgaggaaatgaagctttagcagttgtatctacctctttctttctgtattaaaatggaccaaaaaacctgcctattctatccttggtgtctgctataattttatttttatttttcagctcataggcagttagcgaagataaatattaatcttttttgagctacctatgacaaccaacaacttaatgattctcatttaaaatttgccttaaaacctttattttctgaaacataaataagactatatgtctaaggcttgcgtatgactagtatgtaaacatttctgtagctagaaggactgtttataaacagctaggtaaaaattatgatgataatatgtaatcaaattaaaagtttaacttgaaaactgctaagggagtagattttaagtgctctcactgcaaaaatagtatgtgaagagtaatgcatatgttaattaggtcaatttagccattccacaatgtatacgtattttaaaatatcatattttgtaccaaaatgtataccatttttaattgtcagttttaaaaaagcttagcattattggtacatttcaacagcttttagatttggaagtatattagaaaatatgtggtctagtagaaatgtctccgagtcctgtccaggcaagcatgttctagtgttattacctagaaaacaaacaaggagccattaagaaatgataatcctgtgataactttacttaattcgagactagcagtcaccttgaagaaatgcttacacaaacacgatgcatggatatttgacagtcatcatggcgctataggccaagaaacctcatatatcttgatattcaggaaaatcttatatcccattattatgttttaaatgtgtaaagcagaactgaaatctgcttcttaagttcagcaggattgacttcattggttgaatcagtggtgcattgagccaaaatccagcaaaaaatgcatttgtatacaacagtagccatttaataaatatttgagtgagtgaaaaggtagtgtgctgatggtaagacaaaggacaaaatgccacactgaacaagagaatgggattcaaggaatttttcttcaggttcataaattaaacatctcataaggtctttaaatatgtatagaatggaataacttggctgggcgtggtggttcatgcctgtaatcccaacactttgagaggctgaggccgggagattgcttaagcccagggattcgagacaagcctggcaacatagggagaccccgtctctgaaagagtaaaaaataagttagccggacatcgtagcgcatgcctgtggtcccagctacttgggaggctaggatgggaggatcacttaggcctgggacgttgaggttgcagtgagccatgatcatgccacggcactgcaacctgggcgacagagtgagactctgtctcagaaaaaaaaaaaaggaataacatatatacacacacacatttttttaatttaaaaatattatgaacttgaagtcaaactctaaattcaggctagtggaattatttggattccattaggaaaataatacctgccctttcccccatagttttacttttttaaagttatcctacacatgatctatcaaaatagcagttaaattttacgtataaatagcagtgttttaacttttaacaagccatttatgatatggttgcttgacttattcattctttatggcacaatacagccaagtgtatgttatatacgaatatacttacacctactctactaaaacctgggaaataattgtattgtcctaaagtatcatgaaattataccatgctttcccttcttgggatctcttttaacaccttcttcaaatagcccattaataattttttgaatagctattatctcttgatcattactctccttccccacaacaatgtagaaaatcctgaattttaaaaaaaaaaaaaagggtggagaatatttggcaacaggagatcctgtggttaaattgaatcttatctcagaactattacatggaggttatattaaaatttttgtataatagatcaccatataaaacacatgttgaggtatcagtaaatgtttataagaaagagaacctattactctttaatggtggcttatttatgtaattgatttctattttattttttatttcatttttattttataaacaattttaattttatttaaataaaaaaattctgcatgctgatttatagttggattagtctgtactgtttgatccttgacctttaaattttatcacaatagtcattcttctgttaattgggtgcataactgtgatatttaataattacagaccttccatggctattcacttttaatgtgaagttttatcctcctgatccttctcaattgactgaagatatcaccaggtactttatatttgcatttttaaatgaacctttccttacagctctcgtttatttttgtgccctgggagcatagtggtaatttcaggattgaaaaccaaaacagtttttcttaagttttagaagtttccttgaaaatgggtacatccaaatagtttgaaatgttgccagtttcaaaaattttattcactttctttaatatcttcatttatattctagtaatgaaaattttaaaaatgatactgctgacaactttgttttctatgttatacttttaaaagtcactaatatttaatatttgagattttaataccaaggtcatttttattgtatataactcatgtgtgcttatatactagtctcatattacaaagatgatatgaggttagcaaaatgaaattattttaaaagtccaattgaactggtaatttctttctctcttctccctccagaaccaaacaaggtaggatttcttatgtagagtcaatagctagttcatttccatctccttggagattgtgtgagctataagaacatacacttgaattgcaaagaaaggattctgtttaggagcaagagaatatttattgattctgagtacctgaatggcaaccaagaaacattgtgaatcaacaagtaccttgaaatcttagcccagttagactgggtaccagaaacattgtgaatcaatcaacaagtagcttgaaatcttagcctgattacactgggtaccagggatagcatttcttagctttggtgagaggaagtataaagggttgatttttttttttaaaggatgatttttatataccatatttttaaaaggttacttacatggtcaagtacaactgtgtgcagtgcatgacttttagaaaactagaggggcttagcaaaagagtctgcttgtctttagttcctgtatctttgatgctttctgctgggccagttttgttgtcagacatcaagttgtggaagtggttaagagttcataatatccatgtgaaatagcaaggatggaaatttctttccaatattgggtacatagcaggccggccttttttttttttttaaactacttgttgctgaatatgaatgcactaattaagctctgaatgaattagcttcacctagtaaataataaatagtagcttttgtaactgcacagtgagctacttagagcataaaacctgaccgaatggcatgtgtaggatgcagagcttcactgcaggggtgcctctgaacaatgcatgtaactggggctttgtgacccaacactctgtacatacactcctcctggcagtaatttgtttggagaatgataatcctttggtgattgcaagtttgtagcatcagtactttggttttccatataaatggaacttgaacagtctccctgtctagtgggaggaacaatatagtctgctcagctaactaaagttctcagtggtgcagcctgagaccagccacctgcctgtacttgtggcctggaagcttaaatgtcatgatcgaaatcttcaccatgacttgagtgaacatttagaagctggggtaggcttctgagaagggcaagaacactatttcgaataatgtttgaagaatgcttcatagtgctgtgtgaaggtacagttgggtaattcaggaagctcatgccattttttgtttgaagtttttaggatttagacttaggctttgaaaacagaggaaaggaccaatgtgaaaagcagagacaataatataaaaggaagcaacaagatgaaatctttgtgtttaggttctaaaacttccataaaatgtggagaaccatcactgttgtttattagagaatttgaggataacctggacccatggttgaaaattcagttgtctgaagtatgtactgttaatgcttatgtttttctacgggtcaaggaaacatataatcctccttaaaaggagatctgcaaggcataaaatactcaaaatactgtagtgatagcgagaagactttcagtctctcaattaccgagcacttgtcatgtggcaagccctccagtaactgtgggactatagtgatgataaacagagtccccgccctgcctgatgatgtatttgggtggtaatccaggttctgaactgacctggccccatgtgctgggttgtgctctctgacccagtaacaacaaggcctggaccagaggccagcactccccatttgattgtgtagggtagagagcaggaagaggattgggccctaaaacccaggccaggcaagtgtccacaggactaagatggccagctgccagtatgaatgccagtctctaaaaggtcttaaagaatgaggactctgctgttgatttgggaggatccatggtgaccatagcaagtggtgaagttaaagagtagaaatcacattttaaaatgttaccaagaggaattgatagtggggcttaaaaggtgggggaaacccacagggtatatatgacatgtttctgcattttatttcatggaaaacggaaattcttttataaccgtagtgagccacatggaacattgaatgagaaacattatagccactaattattatagctactagttattgattcttaagcatgtaccagatattttatttatattatctaatgttcatgctcatcttcaaagggaggtagagttcttagcgtcttataggtgggaaattacccttaggcaagtaaattaacttgctcaaggtcatatagagtcaggtcttcctggcttcaaagcccaggccttttctgctaaactgagctagctactgctttaaatggggtaaatggaaaagtaagggcttcaaagtagagatttaccaataactgttgttaaaggtgtttctggaaaagaagaaatgtcaagatgataaagggtgggtgaccttagcttttcttacaaatgattaagactagtttttttttttaatctattaatccttacatcttttgaggggcgtgctaatttttattacagtttgaaatccaaggagacagtttaagtgattgaaatttttacttcagttataaaactcttatatatatacacacacacatataaattagccttctggactcagtttctataaataagccacaagtttagaagcccaaggagcaagttgaggctttttattagagaagatgatttttgctgtttatatgaagagtgcctatattgtatatttgttttcaaaggggtactagcttttaaggactgtgagtgctccaatctcacctaatggttctcccctgacccatttctccctctgctcctcacagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggtctgttgccttgcttactggagagaatggccatgggagatttaaatagcttctcttgtagcacttactagacatttgagcatgatttacaggattatccaatttttccttttggagtttcacctagcactaatcaaggcaacgtggagcccttgaggtatcctttcattatttttataactaccgtctgagaaactatacttgtaagactgtatgttttcatgtattggaaaaatgtacttttccccatgacaccttcttctccctatccccctaacacatacacattggagacaaacatgtccacatacttatttgacatttactttatatttcttctgccttataattgtccttattactatatgtggtaagaaagctagggagataaggaggcattgggatttgaattaccagtgtaggtggtgatggacgtaggaatagtaactgaaatgtacaggtgattccgttggaagatgacccgttggtttagctaagattacttaacattacattaataccatattacgcttctagaacatttatatgtgtgtgaaaagaaaatggactttttacacaaatttttataacgctagctacaaaatgataatttgttctatattgcaaaattacagttttattaaatattactaaagtgatctgaaaggaactttcaaaaattaggtttttaaacaggccacattcattgatttttctttaaaaaaaatatggtatttgactctaaatgttttcttattaatttacttaaattctactcaatagacatttgttgtataattctgatgtgaaatatcaggtactgacatgccatggggaatgtgaaaattaatgggacatgatcttgctctttaggagcttaaagtttacttagttgggtatatagataggaatggaaataattttagtatggacaattgatttgtgttacctatcataggtataaaatcaaatacaagtaatttcaatctttattatgatcaactctagtgaaataaaatgaaggagtaagaatgtgtttatcacagaaagatgagatcactgttttttattctccagtacttatgttgtacactattgctggggcttttttcctcagtgaaaataatcaaaagcaactttttaagataaaatgggtaagagtggaggtatacctccatgcagtttagcaggtttacattataggatcttaagggaaaaatgttagaggttgagagttgttttcttaccatttcctacttttctgcaaacttggctgggtaactttctctcctccaaaccctctgagcacagacactcctcccattctgactacatttgctctgcatccattaataagataatactgtttcttttgattctcaggggcttatcgccagcacaagctgattcccagttcttagaaaatgcaaagaggctttccatgtatggtgttgacctacatcatgccaaggtactgtaaatgtaacggggagtagcatcatagtagtctgttgactgaggttttgagagggctccagtttcaggatagcacagcttatttttgggaaaaggatatttgctttcaattgagggtctctggaatatttccttggtgactaattatggggtgtttggttgtgggagggaccatgtattctgtctctaccacttgttttcccagtctttttaattaatgccctttcataggtacttactatgacacaccttgtcagccttttttttttcaccgcttatcctggtttattttgcattgcagcttctgctaggccaagtgctgtgtctgtcccagttccctctcccacctctgtcttgggagaggagagaagaccttagcaaccataaaagggcaaaagtagcatgggaccactttccaaaaagcttatgtttgatgaaggagccctagagttggtcttttccctgtaggtgtgttttgtactttgtgaaagataacgtaggtgggcccaggctctgggtgataaagcaccttcagtctaatttgaaagatggtaaaagagtgggacaatggggacatgggaagccagtcataatcctgaacaccgtaatcccaaaagatcaaaatctcaaaaatataatgctcgaaaaaataattttaaaagttatttaaaagacatttatttacgtttttaaggggggatttgagaaacataaaacacaacagaagttcataggccactttacacgataaattaggcagtagtaacatacattttttttgcaagcataaacgttcggtatactaacgagagtcacagggtatgagttatgaatagacaaatcctgttcataaagaaataagtcaaaaagtgaaatgtgtaagcgcacatcgctatagttggttgccagtaacaatatcacttacatcatggttctagtttagatgattatgtagtggggagagtcgaggagaatgacaagcaaggtgaaatatgaatttggttttaaaaaatatgtccagagtcaacatttccttatggtagcctgcttttaaaagaccctgccaatctgtagatgttgtttagaagcccagattatatgatttgagaaatctctaggaaagctccccacacaatgatgtctttcctccctaggcctctgattaataattcttgcatttgtgttattaatcatacttcatatttacaaagcactctttttctcctcagtggcttcctttatttaaatatttttctttattacaaaactaatacatgttcatcatagaaaatagaggcaaacagaaggaaataaagatcacttaaatctttttatgcagaaataagcattcttaataccttttttcttttctttttttttttttagacccctgggcagttgaattcacatgccttctaaaaatggggtcatactatgagcatcatttttgttagttttttttttttaacttactattataagatttttctgtcagtaagtagtctctggcagcatcatttttaaccactagatgctgtatgcccttaattttaaaaagtactttcataccatctcattttttacaagtataccatctcatttaaagtttgaatgttttttaattttacagctacataaaacagtgcagagaatgacttgtttaaagccatgtattgttaaatggtctatctgcctgataccgtctggtaaatcctagtaggaggtgaaacagattgtcttaacactccagtgtttttcagatcattttctatgtaatggggacaggctaggttagccaagaaacagaaatagggaggaaggaaaaaatatgtttgagaccaaaaagagctcccaaacctctcctcctctagaccctgccattcttaccacatgcaaatcttgcatctctactttgttgattgttagttagaaaccaattcttaaatggcaatgctgtatgtaaggtttcaggattcttgtttttaatgttgtctcttagaaaagtaagaaattgtggactctgttctaagtataatactctttcttgctgtgtagttaggagcagaacactaaaaaaattcaagataaccttcattctgtttatcatccgatagactccttaggtaatatttgataagcaagatatttgtggcttattgaaaagaatatatgtggcagtttaaaagaacttttcatatttcatgtcgtttaaagttttgtgtctttatttttcattgccttaaaatcagatttttttttttaattagaagagtttgtaatgtcatattcatgttaggatgagttggagagagttaaataaaaggaatctcaacaaaggtgcagagaaaccataagagaagcgggacacccgtggtagccccaggatagtatctgcagctatcctaatctctctaggtctgtctgaaggagggagggcagagtggtttccaaaactcccaaggagagatatgtgtggagagggccgtcttgtggggagccattgtcagagggacatagtcagcctgaggtgaccacgtagggagggaatctgggtattaaacaccctgacctccctttcctttctctcctgatcctttgcaagaactccctttatactgaactcatttgaaagccagccatctccatgcattgccccatgcattgctccatggagcagtgagcaatgcagagaaggtgctcctttccattagtttatttttctgattttgataccatgtggcataacttacatgtgaaggatcaaggcctgccttttcctctttcacttcctacccttcatctgtcgtttctattcacacaaatactggtaattctaaaataattacatagaacaacaaaaatcaactgatttacttgaatctgcgttgtgtctatttttaagtcagataaaatagcttccttgtcctgtccaaagattgcttcagactagagatggctcattcaatgtttcaaatgcgggttgcctccccacttgtggtaagaacatgccgtctcgggcaatcttctgccttgctcccggtggccatgggcagtgatggttttggcaaacacaccatggggtctggtgccaagttgcttgggcacctgtgcctgattcaccccagctttttagtctattcctagagagagttgtggctgccaagataagggtgagtaaagcaattgattggattttttaaaatggctcaagttggtctaatgtaattttatttgtatatatgaattactcaagtgtcacagcagagaaagcaactggcatcaattagctaatactatacttttatttataaaaaactgatttaaatggtatcaaaatgttctgagtaataagatagacaaaatgtccttttattaaattgggagttagactaaatatggggtttgttgcaacattttttgtgagaatttgtttcgtattgtttgtgatttctgaaaatgtgaatgtctttgagcggtagtcttcaattttacatatgttgaatgagagccagctctcctcttagagataaacaataatttgtatgttttgaatacatgcatcttagatcttcactacttgaaatgtgaggagacaggttttcacttttgcctgtaaatttgtttggtttttaaaacataatttaggcctgtgattattctagattgtcatcgattccagattaaagctctagggaaagaaaactattaataacttcaagaatagtctgcagtcctttgaaacgtgccagccaaaggaatgcctaatgagaactggatgtcagcattctaagttaatgaaaaactgcttgaaagaattcagagatttcagcactgtcagcctggaagagaaattatctgcaagggattggtgttttgcaaaatattggcataattttaagagctattagctagggtaatccatctgaggtaaatgcacctaaaggaaaatggttgaacacatcttagggtaggccaacagactgtccctgaggctggactagcctacgggaaaagctcattttatttcccgtatcttcaggatctctagttctgcttcctttcttctctgttagctcctacagtggagcttgagaacatatgcattacgccttttgaaggacactgtgtcttatggtcatgttgccgtaactcttcggcaaatcacacctgatccctgaagatgaataaatttaacatgtatgtgtgtgcgccatagttttcattaacgtgcgtacttgtcactaaactttaaatacaaacctgttaaactgtcattcctgatcatgatttgagggagctaattagcttcttgatttgtgtaactttcacagctcttaaccatggttaattgggttatgcttggcaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagaggtaagccaagacatttctaatcagttgttgttagtcggcctgtttacgaccatgaatttaaaaattcttttctattaattctaaaattttaagaaaataaactatttattcttccattgtaaaaggtcagggttcttaatggtaaaattgcagtatatatacgtctggtctgtttttaaaaaaagcaaccatcacgctttttacaaaaaagaaaatgtgataaggtgtgggctcgttttttcttgttgaatcaattaagttgtgatcattaggaaagcaataagatgagttttagtgaacattgaaggatagttggtttatgtgagccgttgttacttgctttttgtagaaaatagtattgcagtctatgaaattcatctttatatgattatattagatatgcaatatttaccttttttgagaagaataattgcttctcacagaaacatctgaatgcatgcttttcagtaacttctagtcagttcttaaggaaatatgctgatttgttttacggatttattccagctggaacagtttgagagtaccattggattcaaactgccaaaccaccgggcagcgaaaagactatggaaagtgtgcgtggagcatcatactttctacaggtaattttaggaaaacagctcggaagccgggcatgatcgcacatgcctgtaattccactgactcaggaggcagaggtgggaggatcacttgaccccaggagtttgagaccagcctggggaacatactgagactccatctctctttttttctaagaaagaaagaaaacagcttggtattgcttttagtaacctctgtgaattaggaggtggtagtggtggggaatgtggcagatgcattaacccactgtctttgaactcttttctcccctccttgcctcatctcctttgtctgcagtccctcccaggtccatttctgtccatgcattgtcatttataactgagctgcccctgcagctgtctagagctccactttctgactctaaccacctttccttccaccacagccacactgcctcatgcctgctaccattcttctttccactatccctcctcttaggtttcacttcgatattctcatcagctgcctcctgacttaacttctttcccaaaccaacttgaaccctatggtctgactgctttgtcaggaacgttctgaccccctcaaactactctcctctttgcacatttaccttctctgtctgctagtcctggattagtcctgtgtcctgacctcaccagttttggacctgtgctgtccaagtgctaccttaaaaatagtacaaccattgtgacacatgcagttactctatataacaaaaaatagcacaactctatggattagtgctattacagataaataatttccagcatgagctggatcctcagtgctgctaggcaagcaatttgtcttttgacttcctttgccactccaaatgctcatggtcctcgtgagtccctaggcacccctgcttcctcttctgatgccctccactgtgtgggtcactgaaagaagaagctgtgcatgagtgttcttggtttcatgcaccttcccttcttcccttttgcctttaatgaagcatcgctcctctctcctcccattcattctttcccacttctcctgtctcaaggaggagataatcattcctctgctttgatccctcattttgtgcctcttaaattatcctgctttgtaaattatttgttccctagtgggtacctttaggttctttggccaataaatatgtccacatcttgctctttaaaaaacaacaacaaatatgtatatatggttatataagattttgtatataaaatctttgatcatctaaccatctttagcttgtatcttgtctctttttatacttttcttcaaggacatgttttttacatgtagtttgcttatctttgttttctccgtttcctcagttttctctcactgcagtttagctagctgtgtatctagatccttcatctttaaggtttttgctctggacttatggtctaatactgttctaccaaatacgagctgtgtcaccgtgataccaacctctctgcttcacttccatcatccatatatgatagtaatactagtatctacctcataggattgttttgaaaattaaatgagataacacacatgaaacaacttagaaccatttctggcatatcataaaatttatcttcaccattatcattattcttcgtttggtatcacagtttgctatttttaatgtgaattatcagctggcacacatgattctttcttgacgttaaattgataatatctatttttcaagactaatatgttaatttttgaggagaaatataactcataaaatatgcttgaatccctcaagttacactgatcatataaatctttgaaaactttataatttttcttggtagccataacaaatttctcctccagacaacatgagccagctcatataaagctagtagatgacatttatgacacaggtccaagctgggcagacaacagctttccctgtcacataatgataaaaaaaaaaaaaaaaaaagcaataatctgttcagaaatggcaagtgctagcattcattgaacacttattagagtcagacacagaattgattgctttatatcgtggtctatttctcgccctaggcaagacaactgatgcttagagatcggtgcctgtggaggagcacagcagccaggcatctgagcagagatggggaccgggcttcctgattctgacacctgtattcctcacctctgtgctgtcctcttcttgtattcttgtagcaggagtttccgaggtgcattagctgtgcaaagcctcaggcctcctcatttttgctaatgtaccatggactccagtttaaaagtagaccaatttgctcctgcaaacttttgatataatggttaacaaaagcagttttaaatttttaaaccttgcataacgctgcttacaaagctatataaaagaatatatctaacacaaagggccagtcatactttgtctatagattgctttgaatcaggtcagtggaatttattctgtttcagtttatcatgaaaggtacaaatgatttctttagaaaattacggtggcttgcagattgaagccattaatctgtaaacagatctattaattgatagccaatcagctagattgatactagtggaataagaatgtagtaataaaactgatatggccgggcacagtggctcatgcctgtaatcccagcacattgggaggctgaggcgggtggatcacaaggtcaggagtttgagaccagcctgacctggtgaaactgtgtctctacttaaaaaaatacaaaaattagctgggcatggtggcatgtacctttgtaatcccagctactcaggaggctgaggcaggagaatcactcgaacccgggaggcggaggttgcagtgagccgagattgcaacactgcactctagcctgggtgacagagcgagactccttctcaaaaaattaaataagtaagtaagtaagtaagtaagtaaataaataaataaataaagctgacacccttgcttggagcatttaatagagcctgtcaccattctgagtgttgtacagggattcttttttttttctttattgcagaagatgatttctaaaaaaattgtacagaaagtctagaaatacttgaaatgatagtgttctttaagaaatcactcttccatagtaaatgataggaaaagtttcggtggaattcttcatgtttttgagttgtcaacaaaagtcttcctatttaataaattaagagctctgagattatgtttctgttaagatatttgtcaacttttgatcaaagagagcaaaataatttcagttgaactcccaaaaagattggtccatttgctaaaaacatgcttttgtataagcctagaaatatttgacatcaagaaagtttgatttcattctttatgaacccagggattaagcagtagaattgtgctggcaagaaggggtgttagccatctctacagatccactgtgtggcatgttcttcatgggaaagaatcacttaatggaacagattcctgagttagatgttttcttcccaggagaaataggcataaatattaagaattactaatggtaatggattgttacttggcgcttatagctagaagcaaaaattcagacatgtgtttatataaatgatttaagctaatacaaataaataacctttgatatactgagaacagctgtttctttgcttaggtggagaagaacattattcatgaatacatgaatgtggatttactcatcaccatcataaagctgtgtgtgtaggagggtttataaataatgttctttagaaagtttagtttttgagtaatcatacttaaaatgagatatgaaagtacatagctttaaagtttttttaaaaaattccgtaaagtctaattttgcttcccctttctctctctctttttttttttttttcctcccataggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggaggtaaacacatttatgataattttgattttcattcatctttctctaatcccatgaggtcagaaaatgttaatccagttaataaagccaccagaaataccctacagggatagccattttttcccgagtaaataaaatgctattacttacacctacaagagaataattttgttgtgttttagagttgttactcttttttgaagctgtcacacttttttctttttttttgttttaaaacaggttgaacattccatatctcaaaatctgaaatgctccaaaatcagaaagcctttgagcactgacatatgctctaaggaaatgcttattggagcatttcagatttcatatgttcagatttggggtgttcagctgctaagtatatatattgcatatttcagaatacaaaaaatattagaaatccgcaacacttctggtccctaacatttcagataagggatactcaacctgtattgtcagtgcacacaaatatttgttaagagttctcatttatgagatgttggacacatatgttttactgatttctcttgatcatgatgtgttttatgtggttcaatttcctgaaccttttaattaatggcaaaatgtaattctaaggattttttcgtatggtagcatatgaaccttaatccagacgaacataaaacattccctgcatcagcaaattttcatgagtgaaacaacttaccaaactttccatcttatgagaaagctttagtagcttcaaaggattcattttaaatacagcattttaacaaaaagtaaatataatgtgtttgtttgttctttagcccaagggaaaatatgtataaatgtgaatttttttctattagaattctaattagctacattttgtagttttatataaactacacatgaaataagttttatataaactacacatggaaaaatatatatataaattacctggtccaaaatgggttaataataggttttctataaaagagctaaggttaaatttatattagaatgccttgtgaaggaatattctttctttgtaatagaaaatgattagtatggatgattttctacccaaagaaatagttttccaacatttttggttgattgaactaaaatatatatataataataatactaaatttgaaaattgtattttactactagttattagcagaaacattttttcttgtctattgtatttttctgaaatatatgctcgaacaacttatattttaaataattggagtaaaacagatcaaataatgctaacagatgaaaaagctttcttaatagtgaaggattcatatggattgccttcatctgctttttctagaagaaaaacttggaaaacaaatgcaggtggacacatagagatatttgccaggatttgttggttgggattttggtatatagttattaaatcctgaaatgtgcaagggggtggtgaactgtgctttaaacaaatttccagaattgtggaaatgatttaaattcagttgattgttaatgtactatcactgctaaagtatcttttaggtcttcaacaactgagcacttttccaagtaaatctgaaaaatgtgccaacccatgtaaatatttcccaagccttgccccttgccacagagaatttatacaagtgccgaataaatgcagtcactgttgtttagtaccctgagagaaatgattgctctttctggaacactgtctgttttcagcatttgtttgaaactgtgaggctgtataactcttatattgcaaagtttagcatttaaaaagagcagtaaaacagcattttctttgaggtatacaaactgtgctcaaggaaatccaccatcttgtatgggcagttagtgcagagggttacaggaggtctgtatctgaaaacaatgatttttccaagtgaaaacaacaaacatggcacagtaatccattatttttctctttgtgttttggaggccgtaattcatcagatgggtaagtcatcaaaaggattattgtgttattgtgaaaaataggaggcttttaacgccaatacatgaccagacagccagtgaactctttgattagggcttatattctccgttttttcccccagagcaaagctaggctgtaacctggcactgagcttttattttctttaccactccttatcaacataccatttgttgttgtagtcttcatgtattgtattttctttttcctgtttactttttaagtaaggctagaataatttaggtatattagcctcactttaaagtttggcaaattaaaataaatcctcttatgattacatagcaagtgaaaagtgggattcaatctaaagatcaaatatcaaaatgaaaatcaatctagaacagctgttttaggacagggagtcccctccgagattagaaaatcaaaccccaaagaagacaaatcagtcatttaagagaaccaacaaccaagatgcatttgggggttgaggaaccaagtgatttcctgaaggtggaaagtaaaatgaacagggacgttacttaaataggatcatcagggaaggaaggcctatttgaggaagaaccaggtcagttgagacttgaaggatgagaaggaggcagccaaggaaaggacaagagatatttaataataaagcattccaggtagcagaggcggcaacgatgaagctataaggtgagggagagctggatacattcctggaacagagagaaggcaagtgcagtcagagcttaggaagtggcgggagaggtaagcctgggtcagatcatgcagggccttggaggccatggtgaagaatgtggtttttatttattccatatgctctaggaaaccattgaagggtttatgtgggtttatgtgcccgcaagagcacagcgttatcttttaaaaaaaaaatcatttgatgcaagagaacaattagattgagcaaggaagcaggcaggctggttaggaatggtccaggtgaaagcgatggtggtcttccctttagtgggagtaggccaattagccatttggtatcttgggctctgccagggcctacaagcttctcagatgtttaagacctgaataaatgtatcggcttcaaaatacaagaaactgcatgctgaaattaataagtgtttaaaagtatgcaaagtcagcattttgtcaactttaataacttttaatttgatattcaaattttaatatcattacatttgaagccatttctaggtcagatttttttcattttgcaaaatttctgagtatgtataataggtgtgtagaaatcataattgtaagcaaaagaattaatcatagccatatactttccaagggaaacttatttagatcttgttagaagtttctttattaaaaaaaactgctggaggctgggcacggtggctcacacctctaaccacagcactttaggaggccaaggagggcagatcacaaggtcaggagtttgagaccagcctgaccaacatggtgaaaccccatctctactaaaaatacaaagaattagccaggcgtggtggcgcgtgcctgtaatcccagctactcaggaggctgaggcaggagaatcgcttgaacctaggaaatggaggttgcagtgagccaagattgcaccactgcactccagcctgggtgacagagcgagactgtgtctcaaaaacaaacaacaacaacaacaacaacaaaaaccgctggaaaataactatacttaatgtaaaatgcaaatttattctaatgttgactatgatttgatatgggcattcaaagtgtgagtatttaagggctgggaaaatctccacaaggtgaggtagtagaattagaaatggaaagaactggccacatttagaaatatatacaaggaccttgttggacttgctggtgttgaggggtgaagagtcttggaagatgttcacgttcccagttcaagcaaatgggagcaaatatgagaagagcgttttgtgaaaagggcaagactggaaaagaattaagttttggacagggcaggtgaaggctgtggattgagaggtagcttgggatacatgtattcaaagtgcttgaggcctctcaagttcagtatggtagttcacacacaatcctgccctccaagagcttgcagtctaaaggtgtttgtgttgaccaggcttcccttaggacatggaaccagagtaaacttcatggtgtccgtagagtactttttatgtaaagtgaaatgaccttgtggtagttctgttgtttggggaggagctacagatggacagaggtcctgccacctactactcactttgccttgctgatgtttgaggtagtcttggtttgatctgcactatgacagaattttcaatacaatgtacatttctgcctatctgtaggagagaagaagagagcacatgagggccaggttttctgggatgagggaggtgtctatgtatagatttaccatagttcgtgttaaggcattgaggaaggggattaaaaaataaaaaatattaaacataaatatagaagttaaaatccctaaaatttacctttactgtcttttatttactattttttcttttgaagggtattcaaattaaaggttcctttatggagcaattcttaaaacttattggagcaaatcatcttaataattgcataatcatttgttgcaatagatagattcagaaataaatcgtaggagaccaaagagttaaaatactgcttaccttgtaattctgtttgccttaactctggtgtttcagctggtcttagagctcctcctactggccagttccatgatctgagtttatccttccaatacctgtggtttgagaccctggtgtagctcagtgcattaaaattcagaatactttcagaatttggtaaacgtttaaaaattagtttattttatatggtgggtattttcagagctcaagcaatgtctctgttcctgttcactatttatatgctgcctgtttatctcctgtaagggggaaattttccataaagtttatgattcatatgtcctaaaataatccaaaattgtcactctttactagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaaggtatggtaaattagcacagtatgtggttttaaacatttacttaacctagagggtatctgttgtattttctgtttcagaaatcaagtatttaaaattagttgttctatgttctctgctggtcatttatgttttcaaatatgcatagtggtctctaacctttgattgttgttcaaagcagaatatttcaatgtaagttattttaatgcaagtaagtaatttactggcctttttgactgtcctcataatcaccttatctaattgaatcctcaaagtagaaaagctatgatgatttgaaatttatttttggtttggtccaagtaaaatttaaaatgtagcttcttgattattttaattattgacttgaatttttttacatcaccaaagataatctttatgaacaaatgtattcattaatgatctataattaatgaaattctcaagaaaaggtaattgttttgtgaatagagagtgagaacatggtgtgttgcttttggctttatcttgtgcgtacaccatggtgaaatggagaagtaacccatattgtgttctcaaatgtgtcactgttatcttttgttaccttgggcagtaacatcacttgaatattgatttgagaagcctttgaattcttcagatctcttttctgtgtctgcacaaagcgacttttttttgcatgcaacattggaagtaagcacagataaaaacaaatgaatccatcatattgatttcatagtgttttctattttattttttttattttttcgagatgaagtttcgctcttgttgcccaggctggagtgcaatggctcgatctcagctcactgcagcctctgcctcccaggttcaagtgattctcctgcctcagcctcccaagtagctgggattacaggcgcctgccaccacgtgcccggctaattttgtatttttagagagacggggtttcaccgtgttggtcaggctcatcttgaactcctgacctcaagtgatccacctgcctcagcttcccaaagtgctgggattacaggtatgagccactgagcccggccgtatagtgttttctaaattttaactttgaaaatttttaaaagacataaatgtataaagacatgctagatgaagtagctgccagtgcctcaggaattcctacactgatagcctctgaggcccagcatggagaaggtctcagggaccaccacatgggcccagtcttgtgccacaaggtcaagtgctacctgtatagcaagtgacatcaaatcatcgacattccatcgttaaagaatttgtgactgtcatatggaaaaattatttggtggggaattcagataaaaataacagaaattgtgaccaacaaggtttctttcaattgctgacaagttgtcaggatagttctttaaaaattttgctaacaaggcacccaggagagtgactgcttacatctgaaacagaagagctcagcatttcagaatatctctgttccattttgcctagttaacttgacatatctagttattttccttaaaaaatgaaaaagttcttttaaatttcaaaggaaatcctccttgtctgcggtgaacaactgggtacactggcatttttgctaatgctttgaatgtctgtcagcaaccaggtttaaaagtaaataatgctgtttgagtttcatgggatctatttgcaactagtttgaaaataattaaatgagtcatatgtataaattttatgtgacacaagtagtctagtcttttctctttaaaaatgggtcatttaattcatttctaactacactgtgttaatatggtccctcctttaaagtaaacgttttcactaactactcattttttcttttgtcctctttctctcttgcatctgtttttcctttgattgtatctgttgtgtaatttcatattcaatcatgggtttgcacttgagaatagactgtttccatgtgcccaccttcacctctcatccaccgtacttcatctttttccccaaacctattgcctgtccctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatctttgggctacttctgtctgcttctcagtcagttcctttttctcttgccttttcccttcctctggctctatccctctgctatctggaggctaaagccgcctcctttaatgtttcttatgactgtgacttgaatgacaagctcgaggaagaggaagtagttgctggcatgcctacgtaagctcagtttgtggagtcaacacaatacactttatcttaaacccttcctaatatagagtgtaaatgtgtgcatacatttcaccactgattaccctcaacatagtagtacctgcacattttcacacacacaatattttagtgcatgagaaataagtgtagacacttctccttcattgataccattgaccagttccacacattctaagttaggagcgaaattgtaggattattttacaaatatctagatcaaagtagatttgtaacagaaggtgtgggggaggagggaaggaggagggaacctgtattgcccgtaacaatccatacagggtctctccattttgcaaacagatattaatgctgttcctttaggatgacatctttttgttttgatatagaatttaggatgcagtggacataactgttcctgatgtatattagtagaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctgtggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggttggtaacactggttcaccatttaagttcaaatacagcttctttgcactgatggtagagtttccactaatactccccttctttctggccgtttgctgtgtgacttttcaggcgaagatggaagaagaggaaacgcagctggaagaggtggctgagttttccctaaagttaaacatctcatgactgctgcctgccattagtattgtgtggggagggtccactctcagggtttatttgtgagttgtgtttgttgtggctttaagttcataagatttgtattcctcttttattttaatgtcttagactgtcgaactctgggtcattttggtgcttgctgattgatacacttatgtttatttgccttttcccccctgtgtgtgatttaatttcacagaaaaattccttgagagtagaaggggataatatttatgtcagacatagcaatttaatgttggaggtttgtataatctaagaaaacaactctgtcctaatggctgcccggctgctgtggacgggaggtcacgcctaggctggctggcaatgttcttcaagcacggtgcatgcagtgcatgggggaattcagctcgggagtgcatgttaccagcctgacggtgttcctttcaagtggcttaggcaggactgtatctactagaagttctcaaagtgacaagtgggaaaaaaaagtttagtcaaatgaatcaagtttttatccagtactcttgaagttgttctacaagtaaacctattctctcctaaagggttaactctagggcatcaacctgaggtaacacaatctcatccttaatatgtattaactagaacagagatttgtttattgatctggcattaaatcatgtgactcttgatcttgatctgtgcccactttttttgtttttttggttaaaatccatgattgggaatgtggtccactttcagtattctgtttgagaatatgctaattaaagaaattattttaattagaaagaacaagcaaaagtgagagagaaggaaaggagaaaaagaaagcccaatcacccaattatgaatgtaaagtgtaaaatatgttccccgtgtcacgtgagaacatttttttttcccttcttattttacagtagtatgtggcaatgtattcaatggagaactgcagctctcagtaatctgactaatctgtttggttgcttttggcagcttggtaactgatggaaatgtatttttgcttaacttactaaaatgctgtacagtgtaataagtaacattgctttgaaccaatgcaagaaatgtgcctgatctcaagccacagtcatttttccatgccatgcaaagatttttagattttcatgagtttttgcaaatggctatagaagctcatagatgagctactatgcttgtgcatgaatatggaatatctaattttattggttgcatgacctgttccttaaagtgggatgaaagctataatccacaggtggccctatgatttttgaaatataaataaatatttaaaatttggttaaaacaaatactatttatgagagccagtcgaaaaaaattccacaaataccatttatcagggcctgctcccatgaaaatggacctggtagtttttcttgtatatttgtctgtataaggacgatctggcagttgcggaggctagaccccacttttgtgcttggcaagtacatgagaccagtctgtggtttatttattctataaagaggctaaacagaagcagcctctggaagcagtaatttttattccttaagaattaaaagccatcactggaatttcctgaaaacaaacaaacaaacaaaaaaccttggcttttccagctgggggttgatcctggtctggctttttcttccagccagtgtgcttctgagtctctaccttcctctattttgtacttgatttcctatattcacagaatgcaattttaggagtagtcctaatcagaaaggtaaatttgctggaacaaagtcatagtctgagtttcaaatccaggtactggaaggaagtgttattagccattttgatgatcagttccatgtcatctttctgataatgtaaataattattcctttaaaaatcctaaatagagaagaaatcagaaccctttaaaatgtaaatcattgaagaagtacgcattgactttattttcaaattttgatgaattcatgaacttactcatagataataatatggctttagagacttggcatttttcttgctttactatggttttttttttaatcgtaagtttgctttgtcttattttttggttttatttttgtcctactgggttttttccttttggatttttcccccctttgttacgttacatattgctaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaaggggtatgtcattagctatttgttggctctgtctcacttcagttgctcaataaaacttaaattgttaatctctatgttgagtctagggaagttacaaaatgttcccatttaattatttttatgtaattactaacaattttgtaaatactaaatattaacaatgtaatagttattggcctagttcttaggtaaattgcatgagtttcaaaatacttttgaaatagttttaggataatttcactattttactcaggtaaattgtagtaatgaattgttatataggacaatttagaaactaacatactgtatttaataagctttttagttactgatatctgaaatagggacatttacttagtataaataattaataaataaagaaatataggctatctttagagtggtttaaagttattactgtgaggaaaatgagtttaacttagctttaaagaccgatgagccctgttgaaagcttgaaaaatattatatataatatgacttagtattgaaacttccttataatgaaatgttagaattgtgttttaaaaacgttttttcaatcataacatttctcctcacttactctatttcttttcatggtttacttctccccaccactgatatgagtacatattgccttcaggatatattctcaatacatttctccattcattgtcatccacatctgtgcctctaggattcttccaaatccctcctgttattgaccaagaacttccatgggctcgtttatcatacttgagcggacagtgatcatactatatttaatctgtagtttaaaaaatggtataaagatgttaccctacaatttcatctttttcctttcagcatctagtctggcttgaatgttgccaaattgtagacattgatttagatattctagtgctatttttattcacctttccttaaaaagaaaagctgttagttgctttaaatttctaagtttgtgccattgaaaaagaaagctctttaagaacagatgagcaaaaagaattgctgaactgaaacacagaacttttgaaaatattaagacatgcttggtagagtcttatgaagttgaatacaacttcagttcttagtttcagatttttctgaagatgataaaaaatgtcaatttcagcagtctattccagaatgttgtgttttctggagaaagggtctgatgccatgccaaggttttcaccttccattatgtgccacttctcctggtgtgtgtcattgacccacactgggtcagtattttgtgtttgtgttgctataggtgtaatgtatgtgtcttatttgttgattatgtctattgtttaaaacaatagagaaaaggagaccatcttttcaaggatattttatccgtgaaggagaagtacctgatgccgacaatatggacagttgaagaaaaagctcaggagacggacaaggtgttcaccttgcacccttggatctactcttgctttttccccctttccttttgtttctatccacagccataagatttcttttttcctgtgtgtcatactaaaatttttttgaaatgatttttgagcatttaaaaagttaaatcccctgtgtatagaagcataggattgttggatgagaaataccatattgcagaagcacttgaaaagtcaaaatttgaaatacagaaacatcaaccaatttaggtgataactgattcctaatttgatgtatgtggctgacagttgggaaactgatttcatgtgaaagtgcactgtttgtacaatacttatgcatgtcgtgttgttaaaataaccacttatgtgccttagatgatgagtttactaattacatatggaaaccttttgagttttcacttgtaagatttttaatgggaacaaagattttgatgcaccatagcagcccctcacctctctctctgctcctgcatgtgtgacatttctgacactggtgaggaagttcactttccattgcttttacatcctcattcttctctttctactgattttacttagccaggtggtcagtctgttatttgctgggactggagagcttggagtctagtggaggagacatggaaatagttaattagaaaagtttcttttttttctttcttcttttttttttttttgagatgcactcttgcacattcgcccgggctggagtgcaatggcatgatcttggctcactgcaacctccatctcctgggttcaagcaactttcctgtttagctgggattacaggtgcctgctaccaagtctggctaatttttttgtgtttttagttgagacggggtttcactatgttgaccagactggtcttgactcctgaccacgtgatttgcccttcttggtctcccaaagtgctaggattacaggcgtgagccaccacacccggctggtgattagaaaattttctaattggtacttggaaagtttcagacactaggaagtaaatgttaagaaggtgaaatacaatgttgtgttaggaggggattaggaagaccgttttgtcattgtggtcaggaggagatgacatttgagttgaaaccttaatgataaccaggtggacatgtgaaaatgtatccacgtgtaaggacgagccacaacacaggaactgaaagaccaaatgacaggggcttggtgagcaagggggagcacgaaggaaggaaaattcaaagaggttagaccctaggtcatgtcacgatcttaaaggccatgctaacagtttggaattgtacaataagaatgatgggaaagcattggagagtttgaaggtgagtagtggcagaatcccacctgtttctgacagaagtccccctggcactggatgaggaatagattataggggctgtgaatgagaacagagattattaataaggaaacagtgattcccttccacaaagtagattctgttaattggtagagagtattcatcagaacacgtagcagggttgggaaaggaggcaaaataagtagaaataaggagtttatggtctagttgagatgaaatattttcagaacattgcaaatgagaaagataatgtcatgaagctaaaccaagtgacatatttatatactttaaaggttagcctgaaaccaaagccaattagactccatgtgtataatgaggactttaatatcacatgctttgaaatattacgtatttttcataacctgtccttcagaagcaatcacatggtatcattcgatcaaatttaaagtgatgtccttggatttttgcagtaggaaactttgacattttagtggagatgtttaaaattattatcatttttctggatctcatgttttaggaatgtacagtgtaaaatatcttgtcatagaagtcacattaaagtgatgttaatgtgaaatttaaatctggaaaagcccccaagtggtttatctgtacttgaagttacttgtttttctgttcttttcctctccaatacatgcaggaaaatacatacttttttgacattcatatagattgttcttattacaatcatccattcatccgtttgcccaacaaacatttattgaccacctacattgtatcttttttgtttttctttaaataacatactactattagttgaaagtatgtgagcatttgtctacgggagtgttttgactttaccagagtaccttttcaatttctgtctttgttgtatcttcattttactgttaattctgcaggggttctcgtttatctttgaattgtaattcttattgaaagtaaaataaaaaaattatgcataagtatataatttgaccacttttccaaatttctataatatgggcttttatagctttttaaaaaagcaggaatagtttctttttaaaaaaaaaaaatacattgcattttcaaagtggctgtagtttgaacaattttgagagtagagcagaaaattggaaaccaagtcatttaatctttaatgggtaaataactctattgtaatcctcttaacgtgttgtatgaattatgatgacttaaatttgcatagactattctctcctgagtctaagagattatgtacattgagttgtaaggtacttttgaaggtatgtcattggataacgaaatgtgtggcacttctttaaattccccagtgatctctcactgggaagggcatcccacccacccccacttccccaagggacgatgtaatcatagagatggtaatgaagttaagtcagtccaaaagctttttcctctgctgaatattgcaagtgcctactcccctcaccctcctcacctcactttctgcgctcctcacccttcttagctcacagtatgaaggggccccttaggagcgtcattgatttttctttaagatttctgaatagtgactgggtgcggtggctcacgcctgtattcccagcactttgggaggccgaggaggatagatcacctgaagtcaggagttagagaccagcctggccaacatggcaaaaccccgtctctactaaaaatataaaaattagctgggcatggtgctgcacgcctataatcccagctactggggaggctgaggcaggaaaatcacttaaacctgggaggtagaggttgcagtgagccgagatcgcggcacactgcactccagcctgagtgacagagcgagactccgtctcaaaaaaaaaaaaaaacctgaatagtggggtttattaggaattattctcacacttctgacatgagggggtgcttcatgatgactcttgaatattgacatttcaagtttctaaggacagttctgctgtccctcaggcaggttaggagccattgtttaagagccagacacagcaaagttaaatttgctttaatggtttaatttagggagaaataattttcacgttgctcattgagctttcaactctgagtttgtcttcctattttgaattgtttttctttacctgtttctttttgcaaaaaaaggggacagggtaatttactctgtggcatatttagcacgcctgagggaatgaatgtgggctgctgtcagaatgtttgttgtacagagagttaaggtggtattgaggagggagattgtaggagttggagtggtgagggaaggccttacagaaaatgcagactatgaagtgggcctcagggaggttagaaaactggaaaggcccagaatgtgcagataagggcaaagaagggccttggaggcaggagagggaggactgcccaagctgtaacacaggaataagcatttcaagtgtaggggccactgaagaggccattccgtgcagagaaaggccaaggaactacctcaagaatatatgaaatggcgtttgggtgggtcgattgtgctcagttggtgatcagccaagcagttttcactggtttctggaggtcgcaactatcaaagattctcaagcagggtggaaaagctggcgctcacaaacctcttcataagcctgctccagaatctgtcagaattctcatcttttctttcattttatgctgttctgttgttctttcttgtgtaacctttcctttcttccaataggtcactgctgtctgttctgacttattgctaattctttgctcttccttttctgacctctctagagcctagaagaggagataacatcaattttgtttagtgaaaagggcttttctgatagcatgaaagccaccttcacttcagccaccacttggacagcagagggcgctgttgtgagcgctaatgcaccttctgaaaagctttcttcctcgcccttctcacacttgcttgaggtgcattttactttgtttcccctgttactaaaagccacatatgagagagattttcatttttttaaatattcaggcaccattccctccagtgctttcattggtgaaattaattcttcctgggagaaacattcaagaaacaatgactgaattggaacatgaagaaaagatatagattggatgtttctcctgcttctttggtcaaagaaaaaaaaaatctgcctaaattcagagaataatttaaatcattaagttccagagtctgggctgttaagcagagggaaaccctcaaccagatatgctttgcagagttgacattttcaaaaccccaaatttcaggcatcctctgatggcatgttatttttaaaattctgtttatatggaaaaaatctgaagtgcctcccatgctccatgaaataattgcttttgaatgaccctaaggaattccctgaacttgggcagaacctatccagctaattgaggttaagatataacaataataataattcactgatctataataataatgaaatgtgtgtttcagaaatgttctggtcactggatatgtttattatatgtagtcatggttaaattttacctgcttatcaaaatagattgagagttttttcagtttaatatctagaaacctctgagttttcaataaaactggaaagatagctgtcttctgttagtaatgtgatttacatggtattaatttgggtcaatgaaaccatgcccttaccatgtgtttaagaataatagggcaggtccaagagagtttgtgagtagacgttgacagtgctgcagagacgtgtgtgtgtgatgttaggatcttcagctcatggttgtccaagtgtctgggagagatgaactcagccctgctgtctattagaggctccagtccagttagtaccttggcagcttcacaacaatatccagagggctcagtggtgtggtgcccttctccatccagaatggagtcactttcgtgaataaatagggctcctggctctagctgaattatttttaagttagatcataggcagtagtaccacctagaagtcaaaaagttggccatgcttgagttatatcattgtaaagcagactttttgtaagtgtgagaaaaatgtgaagctttaaaaacccctctgtacaaaaaggtttccaccctagttaataatatcataacatagtaatttgttcctaatgtattaagtcaacagatatttattgaacatttaggtgctatattactcaactggagtaaattactttactcccaagaagtagatgtctgaaggggataggagtgaacatgtcaaataataaacttgactgagtttagatttcaaagatgctagtagaggagctaaattgtaaaaggaaacacttggagtcaccattgacacccaccctattgtataatatagcctttgccaacctatgatacgaattggaaagttaataaccatttctggaatgaacattttcatgttaatagccttctgaggctaactataattttgccaattaaaactttttttttttttttaaagaaaaccagcaaaaaataaaagtgccatctccttggtgctgtgttcatttaagaatcagcgttccaggctagactttatagtctgattaaaaccaaaactgttactaggttttaaaagttaaatttttttctttaaaatgatgagtcagctttggtataattcaatttttgtaaactgttttaactacataggtagagcttataggtatatctataataaaagcattttacttctttgggaggatgctggctgtttttgtgtctttttgtaagctttttggcatttgtcttgattgtcctctatgtgaccttgagcagaggtttctgtagatgttgattcttgctgttttgtctttgcagtgtcagatgtttgtttcagtggttgttgaggtaaaactgtattgattttgtgtcctcggttgctttttgttctgcagacacgtgctcccgagtcagaagggccttgcactggagccagggatgctgttaaggttctcccctttttccatgttaacaccattgcctcacgtttctcattgccctcacgtttgccccgcttccctttcagtcagccatcataatcatctttgtttttctccatgacatgaatctgccatcggttaatttgggtttccgttgtttttatttattcatatatttttgttttccctcatccatctttttttgtacagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagaggtaaatgggagtcccaggtgggagccaaactctagagctgcttctcagatggggaactcctgcctttcttctcctgtcctcccagttcttcagcttttttcaacaagaatctgatttttctctctcatgggaggaagggggaagcactgctttgtggattttctgcccgcccagttcatgggttccagcttctctgcggccactggacacctgtagggtaaactttcctagaagcaccacatcaatttttccttcccttttcacatttaaatttttctttgcatgttttgggtgttttcaactgttttgtcttcagttgcactgcttcctcacactaaatgcctttttttccccttttggtttaattagaaaaatgtatatgtaatgttgaaaaaaaaaatggtcactgctgagtgtgtgtgcccctgatgtcatgattgggtttgacttcttggctcattcttcagcttcagagttttagaaatgacagcagtctctgattaccgtggttctctgaatgcagtatccagcagtgatgagaatgttatttcttgaatgccactgtgatttctgttttgggattgcaggggttgtatggttttgttaagagcctttcttttcttccaggcagccagaggctaggctatttgataggaggatatcctcgcttctcattctatcctgatgtcaattctggagtatttgccagatgattatatgttttgtggattatctatacattggacatgaatctttttcttttcaaagaagagaactttttggtcactaagtgcagtgtctctcatttgggagttaggctgagggagggtttatttccttgggaatatttcttgattttaatattaaatgcccacagtacagagatttattttgttctcttcgatgggatggaaaatgttgaagtgactttgtcttaaaataattaagtggattttaaccatgttacttttaaacttctgtttcactttagagaagatttttcaagagtctttgaacactttgaactattctgtatttaacatatcgttactcctctttaaataattatgcctgttgagaatgttctctcaaagaaagtactgcagtattttggtagtagtatagtctggtgttgcattaatattaagcatgcatactcggcagactaaaatgttaataagccgttgaatatttcctttaatgttttaaattgttcaaagcattggtgtaacattgatggagtaattttagatagagcattttaacttaggtaatacagaagaaacactgcaaattttagacaggtataactgaaaacagtaatacttgaagacatcctttctgaaaatggtgtgtctgttaacaataaggcagaaaaggtattgtgggcagaagaacaaatcttagcctacctagctggcatgccagttaaaggcagtgagccttcacacaaactatgtggtcctttaaattataataaaaatagagacaagtcacttcacatagttcattctattttcttttcaatttattattacttgcccaaagctaaggagggaggaggagagagagagagagagaggtgtgtgtgtgtgtgtgtgtgtgtgtgtgtcactatacactaggcttgacataaaagtagtttgggaccatcttaatttaaagagtaacataatttaggaagccatcatgtcaacttatttttcatatatgtgtatgtacacatacacacattcatatatatgtacgtatctatgtgcacatgtatgtatgtgtatatatgatatatttgaaggaaaatttttcttttatttcttttgtttgttttaggttgtttgcttttactcttttcttttgtgcatgagtgtgtgtttggatatgtttcttactattatttgtgaaggttccattaaacacttttactttattacctctagaatttatttttcccttccttttccacctcagccaccagtggtaaaaacagagatggtaacaatttctgatgcctcacaaaggacagaaatctccaccaaggaagtccccattgtccaaactgagaccaaaaccatcacatatgagtctccacaggtacaaaagctctagacttggactgttcgagctcttttttcccttagtgtatctatgttttcattctttcttctcttagtttacatgtttctggctttgatgtagctttttgtatctgcactttgtaagtgtacttcaacaacataatttgctatgttctcttagattgagacagagagctgcaattaaattggtaacccagtaattataggggaactgtacatatgattatttaggacagacagtatcaatcttgttcatatgattgaaagccatttctgagttgacatatctaagaatgtttgtgtacacttaggaaacaaattgtcttgcaaagtttatctgatataattcatcgattaataataatccgatctaattgtggatgtgatttaggcttctttccctctctaactccgtgaagattgacccaatcaactcattcttgcttgtaataacacacatacacacacacacacacacaaacacacacaggcacacacacctgtgcttctccttcgtgtggaattattttctaaagacctatgtagtcattcatatgtgaatggtgataccatgtgtctaaataattatcagatttgtgtgtttgattttaggttttcacacattggttctgtaaagatttggaataagcattaagatgtttaaccttaagaataacaaaaaaagataaagcattcatgatttcaaaatagaatataaaataaatattttctccacttagaagatgaaccttctgtggtagaattgtatcatggtggaggatgtcaggttattgacctctcagaatattttttaaaaggtttaatgcatgcatgtgtgaaacacatctgaaaattattttggatatggcatccttgtgtgtgccttgatcccacataagcacaaataggtttcttatgaacagcttggcgggggagcattagtgatgtgtctgtgctgtgataagttgccagaatgaagacatacaggtgcatgacccaagtttgaaagagatttcctcttacagtcagaaaggctctggaccgtccagttatttcctcgtgtcagtgtcaggaaacagagggcaaatatgtttcgtgatcttaacataaactgttaggctattaatttgcttcattgattccccttggaaactctagaatcttctgcatctttcaatatcaaagcaaacaagttaaaatctattttaacatatgtatgggatttatatatatgtaggagcacatgcgtatgtgcagtattgaaatatatgtgcccgtatatatgctcacaacatgcaaactattacaggaacaatgtagttgatgaaaacaatcgctagaggtaagcagataaccaaatcatgcagattcagtttgtcctggtcaggttctgttgcttggtaatttgataaaatgtttatctatttttacccacctgtgcttaaaaaacaacaaactcagcgcttctggtcactgtggaaacttctctgcctggctctctagtttcattttctagcttgtgcaaaagtccttcagacaaattctgtcataattcccttgtagctttcagtcccacctactatgtccattctcctctcttttctccactcacacagttgagtttgcttctccatgtgcacctagccttttgcctctactcggtttcaaataccagccgctctcctggatggtaattactactgcaaacacgcaaaccacatggattttaaaagatgcatattcgatggggcggggatcttctctgacaacataacagaagttaagcattactttgtatttttcccccaactatccaaagattgatggcggggctggtggtgattcgggcacgttactgaccgcacaaaccatcacatctgagtccgtgtcaacaacgacaaccacacacatcaccaaggtaaagcaatgcaggggatcatatggagaggatggtacattacagacagaatcttttctgaattgtttctctcttcctgtacacacttccaagtaagatacagacagtgccagcggaatcaaaatgccttggtttaaagtatccaagaaattaggctccattgacaaatgcattcaagccaaattgcaattttgtgaagtacaagggggtaaaaatatgttacgaatagctatatgtaagatagctacaaaaccataaataatttaataaaatttataatttataaaaacaaacttgtgcttctacttttattaaaccagccctcctgactaaagcgaatgaatgaaggccatcattcagaattttcagcaagttgttcaaataatgtagaatttccctcatttaagatcgctagtatactgatttggggcattcccctgttcctccctgcataattctctaaatgtttagcactgggtaaccagtcatccctggatcagcagcatcagcttcacccggggcattgttagaagtataaatagcgtggccccactccagtcctcctgaaaccttagaattgtcttaagaagcttccagtgattctgatgcatgctgaagtcatcagctttctaactccagccttattttccactatttccttcttctgttttttactttggataagtgtctaaaggtcttaaaggtgtcccttgtgcccttcccaacccatgtttcaacaacaatttaaaaaacagcaaaagtaatttgtaaatttaaaaatgccgcataaatgcaaggtactgttggtgctcattttaaagcatatccagttattaagcatagtgataagcctggtttgttatggtaaaatgctgtcacttgtgactgagagtgtacatttatcagagttgtaaatgttggatgtgcgctttcccaggaccgtgtggtatttgcttattgactgtttagaaggtcacagccagatgatctcctcagcctcatccagtgtgccccaggcactcgcagcttgtacggagcccataacgctgtgaggcagttcccccaggagctccctcctccagccccgctcgcagcctttgtctagccatgcgccatgtctacgtgtatgactacttacgcagggtgtcatcaaatcaaacattcaacaaaaatctcatccatcttccgtatctgaaaccaaagcaaatcctttttaaaattattgcactaaatgcaataaacaaaatcagcaaataaatttgtatgctcagaatccatcagtcaaaaccatcacatcatacagaagtcttctgtgatgggaaaaaaatatatatcacatcaaacagtttctcaaaccaaaaacagatacctaaattcttataatttcttgtaattctgcaagtaactgatttctccctactctcctttttaaaaattggccagctaggagtaaagaaactcgggaaactataacagaattcccttaaaggaactacttggattaaataatatctgtcctatcttaatcaagtgagattaagatgggacagatgccatcttgaatattgataaatgagttttaaggttgctctcagctgagggatacttgtggatgctataactttagtaataggattctctattgagcctaaaaataaagcacaaagtgtttctagaatatcagtcttttgctgcttgttgtgtgtggccttacaatgatccacaggtctaggtggactcccatctctgtttgctctgactgtgtaaacgtgcttcagtgattgctgttttttcttcttctcctttatgacctttagactgtaaaaggtggaatttctgaaacaagaattgagaaacgcattgtgatcacaggagatggagatattgatcatgaccaggtaaataagttaagttctagttttggaaatggccctgtttgttttctaagtttcacatttgtcatcatgtcgcatacctgtgtaaacctcttctccccaaacctcctggatgaagtccacctcctaagcaggacataaagacacagcctggatacaagctttcctacctctgaatcagaataaaacacagatttctctttatttcccactggctttacatgcacttttgggtcaacgtaatctggaggatttctggaaaacataagattcgtgtgggcctggtttaaaggcaagtgatcaaatatttaaaaatgaatggcagttcaatgcaccagtttccaaaaaatgaagaaagccactaagcttgacctatgcctacttttaggaacttttcaagtatatttatggcattagaaaagttgagctatttacttccaggtgttttctcctattgcgattattgggggaggggaggtaatacaaggtttcttacaaagtgaaaatttacattgattctgaaaattttttaaaagaatcatgcctccattctaatgttaaatttggcagcatgcatggctttgagcaggtgatgaatggaactgctggagactttgagagcagttttaattttagactgcagtcccaagtgatgctgacaatttttttaaaagtgattttaactcagctttaaaggagaccaagctgttttccttttataacaacttgaagaaaaggaaaagaaatattcaattgactatctcagctggggagtaggagctaacgatagttacacagctttggacacaatactgagctcaggaaagaaaattttagagaacaaaattcctcatttgagaaaggcagcctatatgtgatcagagataaatggatttttcatgcctaagaagaaaattactcccaatttttttgacctttgtaagtatgatttgacttacatattcgtaatgtacttttaaaattttcttaagagttattagaggttaaaaggttgccttgactctggattttgacataggacataggactggagattcctagagaacattagtacacttgtctgcttaccatgggaaaatgagtgacttatgtggaaacaagcctccagttttccagaggggatttattctactatccactggaacagtcttgagtttcgcctgagaaattggagtaaacctgcttctttctctctgggactcttctcaataagcactcattgaattcctagaatatgtgaggcacaagctcacattttttggcatggtggaaagtgcaaactagggtcttctcccagccattgtttcttccacccccctctccccattgaacctaggccctttacacactttaaaatgccacctttccagtactcaggttttacttatgtgtattgttttgccttttataacaaaagccaaaataattttgttataaaaggcaaaagaatattttggcctgttttaccccaaaattcaaatctagatagtactgcttctgaaaggcaaatattaaaaacacaatctgaaatacaagtgccaaaataacatatacacctgactcttaaaaaatcatgatgacccagcagccttaactgctgctgttgcaaggacagtaatctccttttttgtatatgatgtcatgtttcagccctttctaaaactgaggtcagatatccaaatgaagagaacagagattttgcctttttatgtttgtgagatagcataaactttttttttttttttggggagatggagtctccctctggtgcccagactggagtgcagtggcacaatctggactcactgcaacctctgcctcctgggttcaagtgattctcctgcctcagcctcctgagtagctgggattataggcacccgccaccacgcccggctagtttttgtgtttttagtagagatggggtttcactgtgttggccaggctggtctcgaactcctgacctcaggttatccacactcctcggcatcccaaagtgctgggattacagtcgtgagctaccacacctggccaacatttttgagtaaatgtgattgtggcttttggtctgcttgtcaccagaagctgttgggggttcactttctcctttaagcctgtaatgagatgacagagctactttaaattaaatgatgaaatcgctttgctgtcaaaatccgatgttgatcatagagtgaccttcataacattgacatctttttcagttccttgcctacgttaaaaggaatcttcaggctgggggcggtggctcacgcctgtaatctcagcactttgggaggccgaggtgggcagatcacgaggtcaggagatggagaccatcctggctaacacagcgaaaccctgtctctactaaaaatacaaaaaattagccgggtgtagtggcgggcacctgtagttgcagctacttgggaggctgaggcaggagaatggtgtgaacctgggaggcagagcttacagtgagcggagatggcgccactgcactccagcctgggcgacagagcaagattccatctcaaaattaaaaaaattaaaaataaaaaaggcatcttaaaatggaaggacactttcactgggccagacagaaaacaagaaatcttttttgtgttggcaaatcaaagaggcatgcttttacagaaacttgctttgcagattcttcaccctgtgctggtcatgatactttcagctccataccaaggagaggtaaaatacactgcagtgtctcttcagagtgtatttctttctaagaaataattgctcaatttggcagtaagagccgggcgcggtggctcaagcctgtaatcccagcactttgggaggccgaggcgggcagatcatgaggtcaggagatcgagaccatcctggctaacacgatgaaaccccgtctctactaaaaatagaaaaaaaattagccgggcgcagtggcaggcgcctgtagtcgcagctattcgggaggctgaggcaggagaatggtgtgaacccgggaggcggagcttgcagtgagccgagatcgcgccactgcactccagcctgggcgacagagcgagactccgtctcaaaaaaataaaaataaaaataaaaataaaatttggcagtaagatgtgatgttttctcataatccttattattgccataataaattaacattttacagtatttaattttgcatgctgatattatggaatgaaaggagttttaacaaactgattttgaatgtgtttcaagatgactgtagcagtttttgcttttcccaatctttctgtgaattagagtgtatttcatatgtgttgccttcccttgggcatcatctacattttctcttgaacagttgccctgctttattgtaggcagatctttgtagatcagatactcaaagtatttgatcatttgtctgtagctacgtttggctcccatcagagcttgtccttgtctttgacttttcccagtgtggactgcacaaaccaacatgtagtaaatggcttggatcattccaatctccttccctctgaagacacacacaaacacaatgtagaactgcacccctgtgcctcctctccctttcctattcccattccagtcaacacgttgaaaagcttctctgcccttccctggaaccagatacctgctcccactcctgctccacgctagccctccagccattcactctcccgccttgacaaacacttctgctactgcccagattggagtctggttccatgttttatttctctattgtcccaacacaggtcactcacaagagtttgttccctggtggaaatttaagcaccctcaaatgtcttccaagtttctgtgcaaaaaattttctgtatgaaaatgatgtcttttttttttttttggtagctttacctttttttaaacgaaacgaggcttagggtttctgtttagtatccttacagctgacagaaactatcatgcaaacaagaaatgcagttgtccccttaggcagctgacagcaaaagaaaaaattgcatggctttatttcaaatgcagtttccttatgagatatggtattctctgtcctagtaaaattttctctttgttttagcattctttcctagacttttttttttttttttgagacaaagtctcactctgttgcccaggctggagtgcagtggtgcagtcttggctcactgcagcctccacttcccggttcaggcaattctcctgcctcagccacctaagtagctgggattacaggcgtgcgccagccaagcctggtgtttttagtagagactgggtttcaccatgttggccaggctggtttcgaactcctgtcctcaagtgatcgcccgcgttggcgtcccaaagtgctgggattacaggcctgagccaccacgcctggcctttagaattctttcctagacttcaagggttctctgatgttttgttttctcacccatactttaaaaacaaaatgagtaataattaggaaagctattttcctcctctgaaaaataggatctttccattgtgccacaacactcttacagtttactttctgataaaacacagagaaactttgctttcttaccacgtggtccaaggaaggaccataaaccactggagtcagccctctgggtcctccctgctcctatcctgctgctcacaggctggatggccttgagaaagacccattaatctttgtgcctgcagttttgtcaactgtcaaatagggacctgtattttataacctgaagattagtcagtctctgttctttagctttactaattgtatgttgttgctactgctctttagttctgtgtcttagaggtttatagacatctttcctgcagtcttttagttcagcaaacattttagttcaaacaattactgagagcctaagaagataaagatgagcaaggcctggtcctctgccttgcagtttcaggcaattgggtgacagctagtatcacctgaatgtctagatcaggcactgtgctggctgctttacagcattactttagttcacacagaaaaccttaaaatgatcgttacaactctgcattagtctcaggttacaggtaagaatgctaagctccaaagaactgttttctccaaatctcacagtgagtataataagcctgggattcaaagccaacatgtttcctctacgtgtcattatttgaaagtggactgaagaattgggagatttaggaaatgagaagcagtctgtaaaatgacagtgaacccatttcaaatcttcctgctttctcaaatacagaagtgagtgcctcttggcttgaggttgggtccgaggtgatcagtgtgtgtgtgttttgccattgtgaggtggaggctgttccccagctcacagccgttctctgtcctgaccctggcaggcactggctcaggcgatcagggaagccagagagcagcaccctgacatgtcggtcacaagagtggtggtacacaaagaaacagagttggctgaggaaggggaagattaagtaaggtaagagagccctcattgtctgtggcctttctagtgactgctctgtactcctgaacttgtgaaaggatgtgaaatgaaagttcatatcagtgtcttcttcctatagtacatttgactttctagactgttatcatccccaggtgcatctgctcgggtgtatataatctctgtgaactgatggtcatgtggtgtcaataactctgatttattgaggggctgctaatgattgacattcatatattgctttactgtttatcaagcacattactgtaagttacattaattaatattcacattgaccctttctggaagatgctattaaccttctttggatgagagatttttattgtaggagagataagagggagatgagctgattccacctatctctactaaaaacacaaaaatgagatgggcatgttggtgcacgcctgtaatcccatacttgggagcctgaggcaggagaatcatttcaacctgggaggcggaggttgcagtgagccaacattgcgccactgaactctatcctgggcaacagaagtgagactccatctcaaaaaaaaaaaaaaaaaaaaaaaagatacatctgagaatgaaccagaaaggaaaagatttctttgactgtgtaaaaatggaaataaatacttcagttaagccaatagaaacaaaagcaaaggattaataaatgattaagtttaatgtgcttggcagagaaaggaatagtatcctgagtatattaagaactctactgtgtcattaagaaaatttaaacacttttgtagaaaaatgggcagagaattaaatgagtaaactatgtgcaaactaaaagatcaataaacaaaaaatgtgcagcctcactattacttaaatcaatgcatactaaaaactcagtggacaagttttcacctataaatttggcaaaacttatgtttttaatagtgttgggaaggctgcaggaaatatatactgctgtataaattagtaatattttatggaggacaatttgacacaaatatatctaaaaaatatccacattaaacatgtctaccattaaactacttataagaatttatcttaatcagaaatatatacaaatattcacctacaagggtatttgtcacattttaatatttatatttgtataaatttatatttgctagtattagtaacaggcaaaagatttacacaccctgaagagaaaccagagtattatatttgctagtattagccaaaaaaaaaattgaaataatctaaatggtcaagagtaggggattagttaacacattatgctgtttccatgtgataactaaatcttgatgaagtgggtaaatgtttataattatctattagggctttaagaagcaggtcttatcacacaataacacatactaagattactttctgttgttaaaataatctgtatgttgaacagtcaatagataggtaacccacaggaatggctgggtcacaggttacacattttcattttctaccttgcgtggcacagccacctgctgttgcatccactaggaggcaaggattcctaccattttacagctgcctctctgactttttaatttttgctagtttggtaaatatgtgtaactgtgattataattctcactttcttcattaatatattttcatatggttattagccattcttgttttctcttctatgaaaatacagatggccaaaaacttcaaaaccttaaatgcttgttcacctctcttgcctgcttttgctttcattctttctttcattgttaattgattcttgatagattctacatactgatcctttgtcaattttatatgttgcaaatatcttcaggcttgtggtttgtctttcattattaaaatagttgaatagggttaatattgttgaatttatcaagcttttcctttatgacttatgttttttccatacccctaggtgataaagatattttttatgtagaaatttaacattgtttttcatatattcttaatccatctgaaatcattttttctaaatgatgagaaagtttcctacataagtagccagcattccagcactgtattgaagagcccttctttcccccatctcatctgcagcatcctatatcaagtttcttatgtgtgggggtgtttctgacactatttctattggtccatgcgtctatccctgctccagtgccagaattactataactttataatgggtcttgatacatggtatgcatgtctctatccccctgcaccccctccccccaccaccgatagtgttctttttcttcattcttggctcttcctgttacatacaaattttagaatcagattgctgtgttctaagattaaatcctgcagtacttcagttggcattgtatctactctgtagttcaatatggggagaattacatctttttaatattgccttcttttccttgaacataagatgtctctatttgtatatatcttctttaatgtctttcattaaaattatatagttttttaatcaaatgaggtcttacaaatcttttctagcttttgctagcatagagagatacagttgacttttctatatttatcttatatctagcaacctgactcttcatatctgagattctattttaaacacagggtatataatgggcccataagcagaaatcattaacaattttagtaaaaataaaacatccagtggcctgagtaaatgtactgtgctgtatgtggatattgatctttttatctttgagatgtatttccctaatggttttatttattttttatttttttgtgacggagtctcgctctgtcgcccaggctggagtgcagtggcgcaatctcggttcacttcaacctccgcctcccaggttcaagcaattctgcctgcctcagcctcccaagtagcttgaattacaggcgcccaccatcacgcccagctaatttttgtattttttagtagagacagggtttcgccatgttggccaggctggtcttaaactcctgttctcaagtgatctgcctgcctcggcttcccaaagtgctgagtttacaggcgtgagccactgtgcctggccccctaatggttttatttatttatttatttgagacaaagtatccctctgtctcccaggctggagtgcagtggtgtgatctcaacccactgcaacctctgcctcctcggttcaagcaattcttctccttcatcctcccgagtagctgggactacaggcgctcaccaccacgcctggctcctaatggttttaaatagggaaggctaaaagcattcttacttaggagtcagaaggctgaaggctatgttttcatcttgccagatatccaactatattgacattaggcaagtcagtgaatggtatgatctacctttcctaactcataggacttattctaaggatagaataagataatgaatgagaaaagtgagtgttatacaaacataaggtaatagcactggattttttttctctaaattttatgaatcagttgcttcttaatcaggaatactagcaaaaaattggtgacactctaagcgttaccagtagctccaccttcacttgtggcattttaataagtttttaaatgaattcattgtatcacttattcctagcaccttatgttcatttttacaatggacacacacagacacacacacaacttttgaagtttgcccatctcagaggctaacttttatgagaagccttgttaaacagatttaggaagttaaagtataaacttacatataaggtgaacaaactagataaatttggaaagattcattcatgcattcaaaaagtatttttttttttttttttgagacggagtctcgctctgtcgcccaggtgggactgcggactgcagtggcgcaatctcggctcactgcaagctccgcttcccgggttcacgccattctcctgcctcagcctcctgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacaggcgtgagccaccgcgcccggcctcaaaaagtatttaatgagtgcctaaatgtgctagggtagggctgggtattgaggattccgtgatagacaaagcaaacatggtccccctccttggcagagaggatgtgctccaggaaggtaggtgtgaatattaacaaatgaacaaaatgtaaatgtgatcagccctctgaaggaaataaaatgctatgagagaacaaaataggagacttgaactatcataaatttaaccaatttcctttagaaaccagtttacttgagaaacgaagtttgagtttaaaatctgaaggatgactaggaatgacctcagtgtctcaaagtcattttggcatctccaccccccactggctgcagctcactcttaaaaaatttcctttgctggtgactgtcagatctgggaagagtgtgttttcactgcttcagctactgtctggctgccctgccagaatcccacagaggcagcaggtgggctgaggcaaagagcaggatcaggacaatatcggaatgtcaaaaaagaaggggaactgtctgcaatgtatctgctccgtctccctttttcaggcacataaagctctcctcctgacctgatcttgccctttggagtagctctgagcttttgatcaagtgttgaaagtagggggaggggagagcaaacagaaagatggtaaaagaacaacctgcagaggacgaacctcccaagtccacctttctcagtggatggcagccagctgtgaggcagagaggagctaaatgcaaaccccgttaaaaagaaaacacacttcagatgaggacttcactaaatctttgtaactttttaatgtcctttcaaggactactccctcctgccggcttagcccaaatgcatatttatgagccctcacatggatgaaaaatattgctgaccttatcaccactgcagtggtattcccaaacggtcccgatcaggaggaagaagggttccaggcttggtggtgtgatctgtgtggtctcagaaagaatgagccacaggagagggagctctcccaacccagacttcacaggagcctctctgactcttagagtaataattgatgtcaggtaaaaaagtgaatgaagcctcctgttcatccaaaatcagtgagcacctgaaggatgaaacgacagaggagtggctgctcatcctttcactcatccattcatttatttgttcattgcataaatatgtatggaatgcccactgggtatcgtctgctgttttcccatggaaatatcaaataaaataaggtctgctcttcagacaataaatcagtggtagcagaagaatttcaagttttgtgataatattctgaacctcgtgtaatgggaacaagaaggagagacctctgaatcagaatagagcatcagagatgtttcacttaagcttcgtgctgggtaggagttagctctgtgaagaaggagtaaagggggccattccaggcaggattggaagcattgaacctgatgctccaagaacagtgcaaaatcagatgtagctggattgtgggatacttgtaggagagcgatggagatgcaggaggaaggaggcagaggcccaatgttaaggagtcttctaagccaagctgaggaggctaaactatcctgaaagtgatggggttgctcctcctgtgtttgagagatggtaaggatgtaacttaccttctttgtgacttgttgacggtcagcatgaggctgtggaagttagtgcattgggaagatgggagcagaggagaatcacacatcatatttaggtttttggcttgggcagggagttgatgttggcacctataatttgaatcgtgcaatacatgagttttgtcttttgcatgtcatggccacgttactatggctggtcttctctgcttggctaccttaaagcaaaggtgtatttttggttctgcggtactgccggagagaccaactgtcatgggaattctggaggaaacttagaaatgaatctataaggccccatcttataacatgacatgattaattggaagttttctggatcatctgcatgttaagagggagcataggatagcagatttgctgggttcatatctacttcttagttgtttgaccttggctggtctcatccctttgtcccagagctgtcatctgtaaactggggatgataatagaagcagaagggcttgtttccaaggcaggttgttaagaactttttataacttacaaggtcggccatgaaccctttttgctcttaagagtccaataaaaatgagaattttctaccccagagataatgagtttgagatgcatgtgaaatgcagaaatggcacatttgggagcacaagagctttgagagtgcaacaggcttctgagcaggagagagatttgtgagtcccctgaatgaattgtgtactgatgaagcctgtgttttgagctgtgttatccagggctagctcagagctgaggtctgggaaacagaggccataaagaaggaggagccaggaggcagaaaggaaacagggaaaaggcggaggtgacacaagctgcaaggcaagataacttcaagaaggagagagtaaccaagtattaaatatggcagaaaaaccaaatgagcatgtttttggaaattgatgaacagaagtcagcctggaggctttgtcagagctgtttcagtgtggtagtagggagagagccctgtaacaggttgaaaacacatgaaaacatattaagttgaaaacccagtgacaggaccttttgctcttccatgagctctgcctgccttcatctgagaagatgggagaacattaggtgtcatggagccactggagctagtgctgtgattattaaaagcagggtcagttcaccattcactggaacctcttagacatcccacccgttaacctgcagtgaatacctctaaattagtcgtgttgctttttccactgttgtgggtacacgaatgccaatttctaaacaaaacaatcttgtgtttgtttcaaagtcagggtgatgtgcagggtttcaaaacatgaactcataagccaaacaggaaattaacattagctgcctagctgacttgatgagagaaaagaaccctgttggctgaactgagctctagctaatcatgagccactcatttacatgtgggccctgatgagtgtcacccctgaccttcaaagagaacaaacctattgacttccagatgactatttcagttctgcaggcatatcaggtgtgttgcatttttattttattctgtttgcctagttgtgttagtctcatacctaaaattagcatcttattactgcttcattttcaatatagattaatcacacctcagatgaggactgacttctgcatagaaataaaaagctagttttggtttagtgagttttaggcatagccagttttcactctgaaatgctgtggaatgttctcatttaacattgctaaatctaccaggtgttatcaatgagtcagttacaatctatttgaactccccccacacaagaggtgctgggtaccactgctctaatgcgtacattaagaccaggcagtagtcactcattccccaaggcttgctcttggacataaccattactgactattattttttcaaatgaaactatctttattgtttttttctggtaataaaagaggggttataactttttaaaagggagagatagtaggaaatgtcagtgacccataagtcccatgctcccagagatagagaatttctttccagtgtgtatgtgtgtacttataaatatacacacatgtagacactcacatacacacaccccccctttccatataggctgatattgtgattcttgctttttcctccacttaatagtactttatagttattggtccttgtcgttacctcatcatttttcagcagctgttgaatggatgagtgatggtttacttaaataacccctattaatgggcatttaaattacccctcagttttcacaattattacacagcttcaaagattatacttgtttgtacatttttgtatgttgatctcattgtttctccagggcaaatatgtttaaaagtggagttggtatgccacgaaggttgttttttgtctttgtttttttgagacagagtttccctcttgtcgcgcagactggagtgcagtggcacgatcttggttcactgtaacttccgcctcccaggttcaagcgtttctcctacctcagcctcccgagtagctggaattacaggcgtgtgctaccatgcccagctaatttttgtatttttagtagagacggggtttccctatgttggccaggctggtctcgaactcctgactgacctcaggtgatccacccgccttggcttcccaaagtgctgggattacaggcataagccaccactgcttgcccaccaagggtttttgacatattaccaaattgtcctccttaatggttctgcaaacatagaccgccactagcagtttgtgagcatatgtttccccacagccttggcaacaactaaacattattaaacattaaaaaaaagctttgctagtctgatcaggaaagagcatttgtttctcccttgtttaaactgtgaggaaagaaccttctttgtgttttttcaatgctagtgaagttggaatacatgcatacatatgctacacacagggacagacacacacatataatttgcatttcttttggttgccagtttgtgtcctttgtccattttcctattcaggtgtctatttttttctcttatagagattagttgaatggacgcatgatggtttacttaatccctactaatgggcatttaaattatccctcagttttcacggttatcacacagcctagtaacttgaaaagatgagtaactaatcttttcagattaaagttattaacctcttagtcacaaatgctacattttccctccaatttaaaaaattggcaccaaaagtggggagaggggcaagacagaactgaccgcttagagacaagcaggccatatccacagttttgttttttgttttggcctaaagggtatatcttagaatttgaatcaattattagtgcttaaacattagaagatagtcagcaattttagaaaaatcagaagctctgatgacattgagcctgctctccctgtggttactatgctggagcttagtaggtgtggccagcatcaggctgggaggagctctctaggtcaccacagtgctactgcctgtcatatcctgtctttatgttgaggcccttggggcccagtctccttatgcatatatgttacccatctggcctctgaccgtgttggggtggtggttatgactttgttaccctgtcctaggctgtgtttgagagtctggaaatgtaaagaatatttaatgttaaactgcctgtagagcatcttcgtgtctctcctctaaccttctttataaggaaataggatcctagacattaacgtaactgtcataggtcacctgtgctaagtatagattgatttatctcaaggcttttctgttagataccccagataccaattgtttaaacatgtaaattttgtgggtggcatcagaggggaattttactatggcaactaattaacaagtttgtgtatgtgtgtgtttttgtaaagatactcctgtccttacgaggattacagtccaaggacatattgatgctttcttgcatcaaaatagttgagttagcattagagcacatggaagtctggacctgttctgtccagtatggtagccaatacccacttgtggctattgagcacttgaaatgtggctagttcaaattgagatatgttgtaagtataagatatttactggatttcagacatgagaaaaaagtaaattatttctaatttttaaattaattacttattgaaataataatttggatatattgggtttaataactacattaaaattacatatacatgttcctttttattttttgaaatgtggcttctagaaaatttacatatgtggctcacattcattgcttgcagtatatttctcttggacagtgttgatctgtggagggtaggagggatgaagtgagaggacaaccttaaactaatatggcacgatgcagtttagattctgtgtgtgtgtgtgtgtgtgtgtgtgtgtgtgtgagagagagagagagacagagagagacagagactgttagggggcagggaatagtgttttaagctatctttatttaactttgaggaaaagtgatttttttcccatgttccctcagataaaaagtgagaaagttgggtctagaaatttcttttgattcccactaaccttccttttttctaaaagatgaaagctttgttagtttgtatttttaagctcttatttgatgctacagagaaatgttttctcattactacccatcttatgaacctaagtgacaaaagctcagctctaatagagtatactgagtggagcctgaccatagttcatttgttatttaaaagaagctttaagattttgtagaacgcttttatatcaaattcccagaagatttgacctagcagagtgaaccagaagaccttaacagctttagggccggcactactacttttagaaacttgtgttacggcttcagtgatttgaggaaaccagttttttaaagaagtaagagtcctcatgggatatcatagatatagttaatcaacaaaagagaacagaaaaatgaacctgatgtttttctacttaaacaagaaaattggcagatgagagtaatggtaaacatgggaattagtgcttcttcctaaagatataatgcaattctgttgttttttttccctgccgtttcctcaagctcttattcttcagtcttacgttacaaattagtccctgatactttcacttctggattcattaatctatattatgagcctgttatgttcaagggactattatagttgtgtgtgagaggggaaggcataggaacatgcataaaaataatgttcagggcacaaaaatagtatatttgaagagaagcctagataaagggctgtggaagttgacaggagaaatgcttctgattggccaaacaagacaaagctctccagaaaggttgcaggaaagctcctctgtgcaaagcaccaagggcaatctggatagttggagattggggagggaagaaagagcacatgggaaaacaatgggaaggatgtcgggaaaagcaaacctccatcgtggttatgtatagagttctcagcacagctggaaacatttgttgaaggcaaattgcagatggtcttacatgccatgtcctttagtaatatgaatttatcagtagtgtgtatgattgactgaaaagcttctagattagatgaagtaccctgtaaagaaatcaagatactggttcagacagttagtaatggggatactgaactggacatctctaagagtaagattgaatttaacttggaagcaaagccaggagtaaaatatcataggaacatctataaaagttaaatccgatatttttttgcttttcagtcagatgaagctcagtatctttattactatttgaagtaaagttatattagcatgtaggcctttgagagtaatacagttcattcagaggacacagggctcaggaaggtcaacccagtcccaaaaggcctgaagatgggacttgggccttaaaggacccacagaagagcctcctaagaaggtggggtctccaaacagcatgaacatgttccagcaaaccaggaaaagcaaaagcattttgctgaattatttgtagaacagatactgtgcttcatttgactgcagagaaaaacactggatttaatttctccctgtactcagcagatacacaaatatctgtgacagaagaaaacggcagtagtttagtgatagcagattggacataagcagttctcaaactgaatggtctcaggaccactttatacacctaaaaattattgaaggcccaaagagattttgttcatgtgaattgtatctattgaaatttatcataagtcaaaactgagaagttttataaatatttattaagttaaaaatcatcacatagtgaaagaagtctgtctagaaagactatatatgttgtatgatcaaactgtatgacatcctggaaaaggtaaaatgatggagacagtaaaagggtcattcgctgccactgatctcctcaagagtcttaatatcgggaagctatcaagctcatggtggccaaaacaccattttccaaattctaatgttcacctaaaagcttgcattttatcattggcaacaagtactgtcaattgtttctcttgaggcgacaggctcaacttcattttcaataaaaggtttacctagtatccaaattgaataacatcccttgtctgtcagtgattctctcaagtaagaaaggtggttgatgaaaaagcagctgcttcaactcacagttcagacattcccatagatgcttttcctctagacattgttgtacttctgtatgcagcgggaatggcgtgtgcatacttcccatttcatcacacagaatattaaaaagatgcactcaggcttgagatgtaggaaaattaatatttcttctgtgtcctcaaggacttccttaagtgaaactgtcttctctattttactgcaagtgcacactggtaaagaataaggtgccaggccaggcctggtggctcacgcctgtaatccgaacacgttgggaggttgaggtgagaggattgcttgaggcctggagttcgagaccagactgggcagtatagcaagagcttgtgtccacaaaaaactttttaaaaattagctgggtgtgatggtatgtgcctgtagtcctagctacttgggaggctgaggcaggaggatcccttgagtccaggagttcaaggctgcagtgagctatgattgcaccactgcaccccagcctgggtgacagagcaagaccctgcctctaaaaaaaaaagaataaggttacctcaaatatagtttgattcctctgcttcgacttatgtaggctgagctgccagtaggtttactcaccattatttgtttacaccattggtgaaaatgccaacacactgaaaaggacataatgtcttagtatgataatgaaaacagttttgactctatggtccccttaaagagactcagcagtcctcaggggctgcaggctacacttcgtgtatattttaatggtaatacagacattttaagaattgacttttttctgggtttaaccaaatggaaatttagcatgcttgcatttttggctctgggatttttattttatttatttatttgtttatttgagacagtctcgttctggcagccaggctggagtgcagtggcatgatctcagctcactgcaacttctgcctcgtgggttcaagcgattctcctgcctcagccccccagtagctgggattacaggcgtgtgccaccatgcccagctaatttttatgtctttagtagagattgggttttgccatgttggccaggctggtcccaaactcctgatctcaggtgatctgcccttctcgacctcccaaagtgctgggattacaggagtgaaccaccgtgcccagctgatttttataatttaaacaatggaaattctgtttagaaattaaaatcaaatatgcaaattgaggataaaagaagaataaaatgaaaagttcagcatttgaaataactgtcaaatccataaagtatcatatttaaaatttaattttacacctgagtgcacagagttcatttttgcttaggaaatgcagtgtcttaagacagtcttgctctgtggccaggctggagtacagtggcacgatcccagcttgcgcaaccttcgactcccagcttcaagtgattctcctgcctcagcctcctgagtagctgggactacaggcgcccaccaccatgcccagctaatttttttttgtatttttagtagagacgggatttcaccatgttggccacatggtttcaccatgtgaaacccctgacctcgtgatctgcctgcctcagcctcccaaaatgctgggattacaggcgtcagccaccatgcccagccttaagtaaatatttcattcccgttttcagaatatttgattatgttattgctctgtggtaattgaatgttcattaatctgaagaaatgttgttttcttgtattatttgcattgttgtattatctgggggaaaaccacatttttgcatttttattgagacttctctctagatgagtgctgtaccacttaaaggcagcattgctagtattttctgtcaaatgctttttgaaatcagtttactgagtcaatttctggagtagagcactcaagattgagatcaatacatgagccctttgtctctagaaactcaaagattgtgcttttcgggcaagatcatagaacttgtatgtatggacttttttcaccactgctcattgggtgcactgagagggtaaataactctctgatccctctgtgagtgcttaagacaaggcatgcaaccaacatatatccttgaagaacttgaacatagaattactcctgtgattagatgaaattgagccacattgatctattctcacattggccaaaagagggggacatagactaaggaatgtgactatagtagttagaatgtttactgacattgtataggccagggtggaacagtgacacttggaaacagaacagtggtatgaatgcttttatttttgttgacttcaccacaattctaatacataaagtataatccatatgcttaacagctatgatcttacccaaactcaggatgaacctgtgatagtgtaaaagtgaaagcaggttgaattaatgtctataattaatgcctgccaatttgtattgacaaagatgcccagacttctatgaatatgagtagaattcaagcttagagaaagaaaagaatgttcttgaaacttttacagcttttacatgaagagccattgcctagttttcagtttggttggaatatgtaataaatcatttagtcccaaattctagcctgtaaaaaattgtcagatattaagtttatttctcacagacacctgccagaggacagaaaagtacagtatttctgatgcttatgtagcagtgacattggtgattctgtctttatcttttctcttttctagctcaaaagctaactgtttagtacttaggaacgtatttctacatgtgtttaagtgcaagaaacagtcaaaaaagataagtggatatgtaaataaagtcttcgtacaataagttacttcttgttcatccacgccaataaggaactgggatgttttgacacaatatctaattaactcagagttaaacttgatttactgatttttaaagaatgagaaaataaataagttttaacattaaaatggcaataaaatgattctgaaagctgtttggaatcctaagagcacatgaaggttatcatttataatattcattaccagaaaaaaagtttattaatggaaataaattacattttgagtttatttgggtaactatgtctttttctctatatttagctcagtaaatgttgaagttttttgagatcaagatcccttcaattccaacatatgcttagtttcctgtaataactttgaaacaagtttaattttagcttttctttacaaatttatgactcattacaaagtgaaatttttatttttgatgaaaacagatgcaaagcaataaagtgacatagggcctagagaaaatggagactagaatcctaaacattgttctctctgtaggttttcaggccctgatagcatcaggggtttgtttttttaataacataaactaggcaaaatggcagctgtgttcaacaaatgatgcatatttactaaacaaagcaaatggaaataccagctctgaaggaacaagaacaggttccatgactgaaggtgtcatataactgccaaatccaatttgattggtaattgtatccatttcccttcatcatcccccacatttcttttcataattactaacctaaaaaaagactttctattttctccattgatttttttttcccccagcctagaatcaaacagaagtactaatgagtaatgaaataacctaaggcagacaacagggtagaaaacaatgaagttgattaatcaatctgtcctgaataatcaagaggctttaatattatctgtgataaatctaaatggtaggaacttttttcattaaagcaagacttaattttacctaaccaaaagagtgtacattctaattgactttgggagcagtgtctcttggaaaagacgttaattaccactctgcactgtcctttgtgattacctatcatttgccaaaacttccaaccaagttcaaatataaaatgaaacaattgccaccttaaaacccttttctctttcagggccattgcaccatcatgggttttttaaaaagtcttctccacttacctttgattgtggacttctgcaagactctgtggctttcatttattcctatgctcacatgagacttagttctatctgttggtttcacttatcccttgttctgatgcccaaatctatatccctaggtctaatgcttcacccaggctgtaagccttcattctctcctttttttgaggtcccagactccaaaccttatcatcctgtcttatacttacttcttaaccaccacactctgattattctccttagtggtgcctctcaaatttctctcccacctgatttctgtggtgaccactcaagtctgggtcctggccatctggcaggaatgcctgacatttgtcatcttcctcatccagctggactcctgcactggtctcctgactgttgttcctgcctctactccttgccggcttcagcttattcatcacactgaagccacagcagtgttttcaaaacgtaaatcacaccatgacaaacccttcctcaaaaccaaagaagaaacgatcccaacctcctttcctgggcttatcatgccctgcatgactggccaaccccaagttctttgaccagtcttctatctctctgtggctcttgcactctgccctggaccattgtagtagattgccaactggtcttttcgtccaaatgttttttcttaattcatttttttttttttttggtcaattagatcaagctggtacttctcagtctattaaagaatagacctaatattttgtacctttatttactactcactataccaatgctcaactttagtaatgtccctttcttcaccgtcctattccttccattcgtttctgcctcctcccccaacatacatcttactgtcataatactgtgtacttcttcacctccatgcctctttcctcattgtgtttttccacctgaagcaccatttccattcgttttagcacaaagaaaatagactttgactttccctttccctgagtatagctttaaaacctaccttggtttctgtctttaaattcttacatatgaattgtctctgttttatgctaataaattcttttgcagtgaactcttatttgccagttgcttctagcgtacttgtcaattctccaggtattttaaggccctcgagagtggaatagtgtctcatgcttgtcttctggtaaacatactatttaatgtaagactaggcagacagtaactgttgattacttgattgaaaacttgatgaatgttacttaacatttttttcaagcctgtgtttttggaatatttaagccttctgttttttttttttttttctcttctagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaacttgtcacttctctttttctaaagggttaaaaaaacaaacttgagtgatatttttcatcagaagtcttagtattttgtgaaaagtagcatttcaaaatctgttttcagctcttctgtaatttgatgatgctgccaacatcactatttgaaacggtgaaagcgacgttgaaagtttgtaaatctaatgttgagagtgccagattccttctgcctggttacataatccattccagcttttacgaattctccgagggatatttttgcttgttttctttgtgcatttttcattttgttttcaggaaatattttagctgtaccatctgaatcttgctcctctgcttcatgtccttctttactttgtgtccactggccctctgtatatcaggcaaactaggccactgaggggctgcatcccagtctgattgggatgctttcttgtgaaacttttgttggggcacaccaggttatggtgttattatagagcaaataaccaacagggtacatttcttgtaaagtgttatatagaatttttttctctagtcatttaaagtaagtacattaaatacaatttgcataactgtcgtctttgagatctgtttccactaaattatctctcgccttgtgaaaggcctttctcactttctctataattattacaaaaacaacaactccctggagaatccgattcagcaagccaagccttagaaatattgtggaaccaaatgtgattttgcaaatgtatgcctcatcagaaagtttgtataacactcacattgaaatcataggttgcgcttccctgggtgttttgaagaccatatttgcagtgacaggaagaaagtttgtcttcacaggtcccatggactaagaaaggtggtgtgcggggattagggctcggttttatttagctgagacagcaagaacagggtttagggtcctgggggcattgagagaatctatgggaattaatacccacagagccacttgaaacaatgtttatacttattcccacctgtagctacaggagcaaggctgtcttttaaaaaaatattttgtattataaagtatttctctggctgttataatctcatctggtaaattgggctaaatgatagaataaataggaaagtagatcaaacaaggttttggaaattggatttgaaaaatttgaaaagtggaaagaatatttttaaatccccaatctgtttgatggtaattatacattggatggtatttttgaatacatgttttctgctgtcttctgcttgtcactcacatgttagactgtatgtcattgaatacattgtgataaattcagaggcctcttctgactggcacaccaattacaaagtcagaaagtaagaatcttgtgagcatgctttgaaaattctaacaactttttgataaatagaaatcagaaaatttatttccaaaatgtgcttaatgtcatgaattctgagagttatcagagttctgaattttgatggttatcagagttgtgaactctgatttctgatattcagtcttgccaaagaacttgagatttcaccaaaaagctgttcttattgtctaggagtgtttacctcttctgaattttccaatcgctaaattatgtctggaaaattctggaggctgttacctggccagattatttttaaaaaacttttgcaaataacatttcagaaaacataatatgggctttttcttgcccaaattgtttttcagctaggtttaggatgtgcagcagtcatggacctgcagtttcccaacaccaaattgccaaattaccaacatgattatcaagagagatgaaaagatagtatttacagctttgagttcattctgttaaatttttagctggtcacagtgggtcacacctgtaatcccagcattttgggaggtagaggcaggagcatagcttgaggccaggaattcaagaatagcatggtcaacctactgagaccctgtatctaccaaaaacaaaaaacaaaacaaaaaaa

SEQ ID NO: 11951 - DNA, 7890 bp, Human
cgcgatgacccgcgaaaacacccctcgcccccctcttctcaactcggaaccctggagggagaggccgcgcccggccagcagtcgctgcgagagcagcactcacctgggtctgtgcgcgccgcgatgcgccggggctcctgcgctgtcctgcgctccgctctcggcaccacctttcgtggctccaccgcccccagcccgcacccgagcgctgaggtggcaagggcaggtctgcgtgcgagccccctgcgggctggcagccaggtgcgcgagggccgcccttgccggcgctcccagcccgcgctgtctgctctcaggaacctggcctggcgcgcagtgtcagaggccccgcggcggcggcaggccgagcccacaggggcattaggccaactcccccctcccgccctgcgcacgcggaattctctattattattattaaagaatcccccagaacttgtttacgttaaaccctgtaaacttcctgccagggcctttgccatctctcgggaaatcggaacctgcgctttgaaaacggggccgcggggccaaataggcgggttttcagtgtgtgttgggggtgggggagggcaactgaactacgtgtgagttcagatccgagcgtggcgtgtgtacgcgtgagtgggagtgagtgcgaacttaagctcctgtgggccttaagcttccgtgtcaacgagtgcattagtgggtgcgcacatgcctgagcgccctctgcatatgagtgtgcacacacgcatgggtgtgtttacacgtctgtttgcgtaatttaccgggtttgcatgtgcatcaagacatgtatgtgtgtgctaatgtgtggacaagagcgcgagggtgtgcgcgcacgggtgagtgactgagcacgccgcttattcaggggcctgtgcggtctgggtcgcctctgggccagcgggttctcactcgcccccgtcaggcccgcggcgcccgagacaaagcggccgcgactcgtgctgcgctttcgttttccgcctgcgctctgccccggcggctgcccgcccgctcgcaagctgctgggcgagtccgaaaaatcccgggagcggcgcagttcttcccggggcggggagagtgggtaggcggtccctcgcgggaacttagccggccggccgcgaggaccggagtcgagccggctgtgcctgcgatggtcacgaccgggaggccgccgcacttgcgatttgctacagggctgtgcgcgtcggggaaggccccggcccagggagcgtttcccgccgcgccgcccgggcggggaaggcggggtccagcgcgcaccggggctgaaccgcgggcggagggcgcattaacacttgctcgccaggttggtggaggcggggcggattctgctggcggccgcggggcggcgagagtgggggctctttaagcgcccaccaacgcgggggcccgaggggggcagggacggagggagggaactccgggagggtcttaggccgacccgcgagacgcagccgagcggagatggagtgaaggctgcctcgcccggaatctcggagccgagcgccgcgggcggcggggactcagggctgctcccggctggggcgcacggccgtaagacctggaggtggtgcctccccccaaaaaataccggcgggggtagcttcctcacggccttcgcccgggctgccctcggcctcagctcggctcctttccttgtgggagggcgagaaagaaagagggaggagagaggtgggggaggcgggagttggagagagaggggctctgagccaaccgccggcggatccagcagctcctcggggagggcgggcgggagcgcgggggcgggcgcgccgcggctcgctcgggagaagtggccgccgatgacggcagaggtgcagccagccccgcgcgcgcagccccctccccttcgccctcctcccccccgtcgtcctcttcctcctcctcctcctcctcctcccggcccgtccgcggcgcagagcagcggcggcagcggcggcggcggcagcagccacccgatgtcttcggcgcccgagaagcagcagccaccgcacggcggcggcggcggcggcggcgggggaggcggcgcggccatggaccccgcgtcgtccggcccgtccaaggccaagaagaccaacgccggcatccggcgcccggagaagccgccctattcctacatcgcgctcatcgtcatggccatccagagttcacccaccaagcgcctgacgctgagcgagatctaccagttcctgcagagccgcttccccttcttccggggctcctaccagggctggaagaactccgtgcgccacaacctctcgctcaacgagtgcttcatcaagctacccaagggccttgggcggcccggcaagggccactactggaccatcgacccggccagcgagttcatgttcgaggagggctcctttcggcggcggccgcgcggcttccgaaggaaatgccaggcgctcaagcccatgtacagcatgatgaacgggctcggcttcaaccacctcccggacacctacggcttccagggctcggccggcggcctctcgtgcccgcccaacagcctggcgctggagggcggcctgggcatgatgaacggccacttgccgggcaacgtggacggcatggccctgcccagccactcggtgccccacctgccttccaacggcggccactcgtacatgggcggctgcggcggcgcggcggccggcgagtacccgcaccacgacagctcggtgcccgcctccccgctgctgcccaccggcgccggtggggtcatggagccgcacgccgtctactcgggctcggcggcggcctggccgccctcggcgtccgcggcgctcaacagcggcgcctcttatatcaagcagcagcccctgtccccctgtaaccccgcggccaaccccctgtccggcagcctctccacgcactccctggagcagccgtatctgcaccagaacagccacaacgccccagccgagctgcaaggtgagtggggaggccgagggcgccctggtccccgggaagtcgagtctgagtggcagcgggacccagctggggcgagcccctccacttctgtggtcggaaccccaaggctgaggggaggcaccagctccccaaggtgtctcttggccccacctctcccccttcgaagagtgactaccgctcttgaccctagtttgggccaatctgtttctctttctgttcgaactccagctgccagctgctccaggcctgaccaggtaggctggtcctgagccagatgtcccagaccccagtgccctaagtccttttgtgtcccttaagtcccctcacagcttggaaagatcctgggatggacccaaggctcccagcgctggccagatggctgtccctccctggtggtggccctcaggctgcctggagggctgcctctgcctggggctgggcggaacggaaggtgttaggcccaaagccgctgggccagcgctcagaggctcagccccggcctttcaggggaccagacctggcagacccacagctgagtccaggggcattttgtggtgactgaggcaggagggtgccgtggccaggccccggagggtcagagctgcagaccgggccatgggggctccttgttttttaggatccaagttttcaggtccccacacccccaacacccctgataccccaataccccgaacatgcagaagcatctgccaagggagatgcagcagcctcgcctcctgattctgccccaggccccccgcagcctgcaggcccagctctggaaaaagctggagtgagcttgccagggccagtccagggtcagctgtcagcagccccaggaggcaggagccaggcctggaggccttaggcagcctctctgcgggggactccccggctccggggcctgttctctggagaagcttcttctcacccctgctgctggcccggcgctggccctgcactggcctctccttcaaccccgccggcagtcgtagcctctgaggttgggggtggtggtagctgccctggcggtgacggccatgggcgttaggggccctccacttggtctccctcaccacttcccctatggctctggaagccctgggcccctgcacggtgtccgaggctggacaggcacgcagcaggcaggcaggcaggcaggcaggcaggccgtggcaagtgttctggagtcttttccttgggtgcgcagctggaaggccgggactcggggaggagagcggggaggcggccgtgctctggagccaggctgacaggccctgtgcgccccacgggagcactgctcctctgcctgaactctgagccaccgtggctaactcttctgctcccccaacccctcctgtcgcctcgccttgcaggcatcccgcggtatcactcgcagtcgcccagcatgtgtgaccgaaaggagtttgtcttctctttcaacgccatggcgtcctcttccatgcactcggccggcgggggctcctactaccaccagcaggtcacctaccaagacatcaagccttgcgtgatgtgaggctgccgccgcaggccctcctggtgcaggcaggcgggtcacagggaccctggaccggcacaagaaactgctttcttctcgaggtataaccgtcggcagaagaaaagggttccacctctccccaaccggagtttttggcaaggagtccccaatgcaaagacacagcgctgcggttggcacctccttcctcactccttcaaaattgttaagaaatgttagtggtgggtctgatctgactgcagccatcggtaaataaaagtttttgatcctgttgaacccgcctgagacggtgctgtgcaggggaaagcccccgcacccacacaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcgaaggagccacgaagcaagcggccgtccgggcgtccgcctccgtccccttccatgttcctcctcttccttcgcttcagcctcttctgttatgttttgtcttgaattttatttagactttttcagtgggtatttttctgtcttccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatcaactagaaataaaattgcatgagtattttattgggactgagattgtagaataccttccagactcccaaagatagaggggggaaaaaagaaaaaacaggctttggatctctagacgcttaaaaatttacaatctgggtgattctgagtacttttttcttttttggcaaatcctcctcttttcactcttcattccactttgaagtaaacgctggacaagaggaactatttttcttggcttctgttttttaagaagagccctttgcccctctaaatgtcattgatcgttttaaagaaataaacttttaaagaacactatagacctccttcccctagggaacaccaattaaaccatatatgtgcacatacatatggatatacatatatatgtatatacatatatgtacatatatgtatacgtgtccatgtacataatatatatttttttgccactacaagaccaatgagagttttactttgggtttccgactttcttgttctcttgctgtagctgttataaatcgtgaatcaactttaaggtttttttgtagttgttggtttgtcttgttttgttttggctttttggtgccttgttcttggttttccccgatagaaaatcaagcaaaatctaaatgaggcaaaagggcgcttggtgggccaggtgacaggcacctttccaatcctgtaacatttatctcctaagtcacagttcgtcctctctgggggaaaaatattttttaacacttgtaccttccactgaccaccctctttctattccagttcccggctaccgagaaaaacaaacacagtaagtcacattgttggtgcggtccttccagacccaccgcagtgtcttgcgtcgtggggtcgtgagtctctgaacctggttcttctcagagttgacattttggacgtgggggtaatttctccggtgctctgttacatcaaaattatcaataaactcgcctgggcaattagtgtccccaactaacagctgtctataaaatcgagataaaggggacaggaaaaggccggcgactccatcccttggggtctccggggggccgaagcgtcaggccaggctctgccgggcgcacgcgcctggccctgcgctccgagagcaggttcgcagcaggcggagaaggcggtcctcctggggcgaagggtcttctctgcactctccgcctcccaccagagcccggaaaaccagtcctgagaagagcccccaggcctcctagcgcgggaacgctgcgctcgcgtccggtcagcctctgcaggccagaggagccgggagcccctcctctctcccgcagaggctgcggcccagttagggcagaggctccggggaagaggggctgattaggagaaacccaactgcgcgctcccaggttttcttctgcggagtctccagcccctgcacccactcacttggcgccctggctggccagaggcccccgtgcgccgtggttgcgcgtggctttggcgccgctggactagcgtccagggcggcggcaaagcccggtttcctgttcatctccttgccttcgcttcagcgggatctcccagcgcacccatgtccaggtctagcggggcgggaggcacccaggggggcttgtgcaggaaaaccggtccggattgcccgaggacggtgaccggcctcggtcttccggcctgacttgcggcctgggaatgagagggaaagtccagccttcccgcaaggagatcctggctccaggcaagcccggaagggccagataacgcagcgaaacggcctctgcgcccgcgtccgagatttcgcgctgccgctgctgcagcgccgagactgcgctcggctgggctgtgtcttcctcggggtccattgcgtcctgggctcgcacaggggtcgcgagtgaagctcccacggctgcgggacgccgcaaaagcgcgcccagcatgtgcaagtcacaagcttaaaacgcaaagggctcctgagtctggtgcgaaattatgcgccctgcgtgcatgaaggac

SEQ ID NO: 11952 - DNA, 8255 bp, Human
gtgtatactgcttgtgccatctgtgtacccctctccctggagtacacttgtggtcacactacagtggggacatcaagaatgcaatatttatggattgctgcatgattcttaaaaatgaataaaactgtttacaagggaaggagagctaactgcaaagtgagcttatctgtgaaagtttctgtctgactttcgccagcactctttaatacttttactcaagaggatctggagttggaggagtgggagaggcaagggctagggaaaggcatgttggcgggggagtgatgcgccatagccgggccttcttcatggtctgggcaccagcctccccgaccccggctctccagctcctgggcagaggcggggtaatcaacccagcccccaccactgcctctgcagccgccttaaaccggagaacgtccaaccctgcagctcctcaataattaaagagcaggaaagctggtgacaggagggaggccaggggaagggaggaggaagggacacagtccccagagtccctctactcttaatccctgtgacttaaaggttggtgaaattaattgggcaaatgaccccgctaggagaatttgacaagtccatgacttcagagttttacccacgggctctgcttcatcagctgtctccagaggagtgagtgcgcttctgcagaagcctctggaatgtcagcttcctggaacctcgaggatacgggtggggaaggagctgcttactgggacacactggattaccctacccccttggtgtgtctgccgcctctgtggatgtaagcggcaggtggcatcggaaagtcagacctgcctgggacaccagagaaagaccctaagagtcgggggagagggaaaggctgcagaaacatgagaaagtgccactcgtagcggagaggaaagaaaacctcaaggatacggttcccgagcctgagcccgctcccagccttagccccccaaccccaggctccgtcccaggagcagtcgacgcctcaaagcgtacgggacaggaagggggtgggggcgagagtcttggttccccagaacgaacggatccatagcggttcccggtgccgcaggccgcgcgcttctccgaccccagcgcggggccctcgggcgggaatgagccgagccgggacttagcggcgggtagggggttgggtggcgcgggagagggcggcagaaggagggagttcgaagagagttgccgccagggagagtggcaagtgcccgcggtctccttggagacgtgctggccaatggcagaggcggaagctgtttatgggggcggagcgtcgccatggcagcaggagaagcctttggagcggctacttaatgccggtcccggggccgcggtagctcagagaagcgccgtcgggcgggggggcggcaagaggcgctggcagggcccccgagctgggggcagagagccgcagggggtgggagcaacttcttccagaaccttcctctggcccgggctgcgctctgagccaggtaagggatggggagggctgcaggccagggggaagggtgggcaacggtaccaacccgctctctcattcgtccttaacggaagtggtgggcccagggactgacatcggagaagtctgggggaaactcgcctcctgccccccgttactgttccgtccccttccttcccaatgatcccctatcataatattccttttcaaggatcagaggacctccaccgcccccgccccgtcgtaccgccctcccaaacttctcgccccacttccatttgttgcgaggaggaagggggtcctgatttcctgctcttcgggagaaaaggatagcctcggatgcccctaccctcttcatttggctaataaaacctcgaagaggaaaggaagagggaggcagatctgatgggggtgggaccccagggccttgcttctgtttcccatacctcggcactaaaagatcctccccagctgcggggatgatgttagagagggcgtccccgtacacacactgtcccctcgggggtggggtagtgctcagctcccaccgtggtcctcgcaggcaccacatacttattcggaggaggcgcccccggggtcgcgagatggaagcgcgcgtccgggaggccgtgtaacgggagctgcgggactcagcgggccagagagcgcggcgggccacccccggctcagcccgtggatgctgaccgccccctcggagagtccccgcagacatggcggagagctggctgcgcctctcgggagccgggccggcggaggaggccgggccggagggcggcctggaggagcccgacgccctggatgacagcctgaccagcctgcagtggctgcaggaattctccattctcaacgccaaggcccccgccctgcccccggggggcaccgacccccacggctaccaccaggtgccaggttcagcggcgcccgggtcccccctggcggccgaccccgcctgcctggggcagccacacacgccgggcaagcccacgtcgtcgtgcacgtcgcggagcgcgcccccggggctgcaggccccaccccccgacgacgtggactacgccaccaatccgcacgtgaagcctccctactcgtatgccacgctcatctgcatggccatgcaggccagcaaggccaccaagatcaccctgtcggccatctacaagtggatcacggacaacttctgctacttccgccacgcagatcccacctggcaggtagaggaggcacgggcggcggccgctccctccccattccctcctcgctccccacgctgcactggattcatatcccaaatctgcaggccaagtaggctctgcggtgcggccagcgccccagaagggagccctgcaaaggagcccagttcttgcaactgcccctcctttgacttccagagagagagagagagagaagggagaatgtccagaggtggagggctttaggggtgcagaggctgagattcaaggggaaataacctgccattcatccagcaggcccaggccaaagaccagggctagactctgcgtggacagaatctccttggggagagcgatgaactgaaggcgcattcttgtcctaagtcctagaattcctagacactgccctgccccgggatggtttgtcggggccgggagtcagaaacggaaactggaacgtggcctccctgccaggctctacgtcctgcccttttgcagttggcttggggagggtggaatggaaggggtgccttagcatgtgagggccaggtgtgtcccaatggagggtggagggggtaaggggccttcctaaagctgctgtcccagccccccacctcaacctctgctcagtttcctgcctccaacccccgctgtcagccaacctccctggggggacaattacctgagccaggtgccttccactggggctctgcctaccacactcacttcgtgttccacgtctctggaaccaggcactgagcagccaaggggcccaggccaccatgtaaacatcccagccttgctgccgggcattatccacccacctgccctgccgtcccagcccaggacccctgtcccccagcaggctttggacaagattaagcacctaagaatggacaaggcaggaggatggtggatttgaggctgggtaggcagtgccctaagagtcttcagccatcaccatcaagggctagttggagtcaggggccccccaaggacgcccagactcttccctgaagcacccaaagcgggcaggccacaggaccgcagtcccaagccatttccaatgcccctgaccctagagcagggtcatttgcagctgcaccgaaaaagcagagaccctcagccccaccctaccctaagcctgtgcagctgcgcttcgagaaacgggccccaggaatgagtgctatgctcttagctcttggctgggtaataatcaactgagcctggagtggggggagggggccgtggggggtgaaggcccaggccagcagccggctcaacaaacaaggaaagtcatcagatcccccacctctcatccctgcgctctctctctctctctccccgttcctctccactctcggctgcccacccccctccctggacccactcactcacagagagggccagccaggcccaggcaaagggagacggtggtccaggccctgggggagccgagggctttggccagaggctgtcagcggcagggtgagggagggagggcaggcgacgggggtggcaccgagagccaccctgcggctcagagctcggatgactgagcaggcagatatcccggcaacagggaacaaaagcctccgacagcactccgggctcccagtgccctgtggctggtgtcccagagctgcagccgcctgggcagaccagtgtgtctgtcccccccctcctctcccctgccagagaaaagatggggggtgcgcagcagcgccaggtgccatttcatctccccgtccccactgacctagcggttcctctctctcttgctctctccctgcacccagaattcaatccgccacaacctgtctctgaacaagtgcttcatcaaagtgcctcgggagaaggacgaaccaggcaaggggggcttctggcgcattgacccccagtacgcggagcggctactgagcggcgctttcaagaagcggcgactgccccctgtccacatccacccagcctttgcccgccaggccgcgcaggagcccagcgctgtcccccgggccgggccgctgacagtgaataccgaggcccagcagctgctgcgggagttcgaggaggccaccggggaggcgggctggggtgcaggcgagggcaggctggggcataagcgcaaacagccgctgcccaagcgggtggccaaggtcccgcggccccccagcaccctgctgcccaccccggaggagcagggtgagctggaacccctcaaaggcaactttgactgggaggccatcttcgacgccggcactctgggcggggagctgggtgcactggaggccctggagctgagcccgcctctgagccccgcctcacacgtggacgtggacctcaccatccacggccgccacatcgactgccctgccacctgggggccttcggtggagcaggctgccgacagcctggacttcgatgagaccttcctggccacatccttcctgcagcacccctgggacgagagcggcagtggctgcctgcccccggagcccctctttgaggctggggatgccaccctggcctccgacctgcaggactgggccagcgtgggggccttcttgtaagaggccaggccctgccccacctctggacagtgcccaagtcagggtccagaactgccccccaacacaggtccacagacaccccaccacctaggcaggggctgggccagggctccaaggcttgccccagaggccacatggccaccagccccagctgccatcagattcaagcccaggaggctgaaaacgagggcccaggaccagaatcgctgcctcctctccccagccccaccttgtacacacagtgtttcattgctccgcgtcttcccagccccagaaaccggctaaaggaccctgcaccatgagagccgaggcctggaggagcccgggtcaggctggggaggaacagaactgggccctcccagagcacctccgcttcccccctgcttccccaggtctctatccagagagagtccccaggtacaacaaatgctaattagatgacagcaaattaaccccctggaggcttctcctggcagagcctccctggggccggggcaggctgtggatggggcggagcagggcagaagatggactgggggagggggcagagagaggagaccaaaatgaggtggtggcacagggtggggcaaggagatcctctctaaggcctctggggtctttgcctggccccatccctagggggcggggaggggacgtaaatccctaatctttaagcccgacttgaggctgagagcagctggaagtttgggtttggtggtttgggggccggggcagccaagctgtatggggcaggacagacagactaatgtagtgagtgtagctgtagctgaggcttaactgggagggatgccgagcttgctggaactactgggaccaagaagcggggtaccccacgcccctgcctgcactcctcgggggcgtggggcgtgccttgctccacccggactccctgggctgcgtcccacatccaccctcctgccccgtggggcaatttaacctttttcatgaaagttatttacaatgaaaagtttttaaaaataaaatttttaaaaatctaaatatggacctgctcaaaactttctttgggaacaggtgagggctcagtgttctggagaggcagcgcttctctttgctggagggagggatggctgagaggaagatgcgggggcacttacggcctgcaaagagcactaaccaactccccatgacctcagcatccccggggaggaaggggctgaggggtggctctcggttgtcccctgcagcctaggcctcagtgcctccatctgtgcaatggggagactggggtccacagccctgggggatcaggagacaaagggaggaggagtggcctcagtccccagacccagggaatctcaaaggctaagtgtgccctgggctcggcccctgctgtcccctactgcgagggcctgcccgggcccgcctgccccagtcagccatccccggcctgggctggtctccagcacctccctcgcttggtcctctcctggagggacccagctccagggcccccacttgccacacaacctggcccaatgcaggtttggagaggaggaaggccaccagggaagggagtgagctcagacccacccctcccacctacactggcaggaaccagactaccggagttctgatggggaaactgaggcatgggaaatttgtgtctgggtgacactcagccagcacctttcaatcccccgccccccttgctttgcccgggagccaccttccaactcagtccccgccacatatacaccctcatgggtgcacgacgcctccagaaagccacttcctcgcacacgggcgcacacacacaggggcacaaacaggcaacgtcccaagcattcctgcccagcctccacggacccctttctcccaaagcccctttctttcttcgtcctcggggttggctctaggccaacctggcattcccctgctaaccggctgctttcacttgctaattattctaaatactgcaggagggcacgcagcctgcagggtccaggaaggcaggctgagggctgccccaattcccttcaccccgcaagcaactcccctctccttttccccactgtccgcccccttcctctccatggaccccagcaatgggggaacaagctgggctccagccttctccccacaggatcagcctccagctttggactgacaggctgggcgtgtagctgtgtgccccaggcctgtgctggggggaaggggggcaatgtctggggcaggcaggacaccccactgggggagcaccaggcctgagaagcagatcgaggtttgccccagcttgacagtcacctggaggctcctgaaaaatcccactgctgggctgcaccctggaccaattagaccagaatttccggggtgggacccaggcatcagcatttgtaaggtccccagatgtttccaatgtgcggcaaaaccgagagggggccctggagagggcatgactttcagcaggccaagctggggagtggcgagagtgtgggctaggagctcctcactcctattcacccctgccttgcccctcagtggggtggctttttcgtaaaaagatgttcatttacctctttttttttcttctttttttgagtcgtctggctctgtcgcccatactggagtgcagcggcgcgatctcagctcactgcaacctgtgcgccccgccccaccgggttcaagcaattctcttgcctcagcctcccgagtagctgggactacaggcgcccgccgccacgcccggctaatttttgtagttttagtagagatggggttttaccacgttggccaggctggtctcaaacttctgacctcaagtgatccacccacctcagcctcccaaagtgctgggattacaggcgtgagccacctcacccagcccatttacctcttatttatttccaggttcaatgtaatcccaaccaaaatatgttttgcaccatttgacagtacgttgaagacctgactccccataccactaaatacttcagtaagtatttccttaaaaca

SEQ ID NO: 11953 - DNA, 29965 bp, Human
tgggggtgatgacctggacagcctcagagagtttcccgtcaagggtagggtgggatttgcagtcatcagagggtctgggaagggcgtgtgcaggaaaatctgagggcctcagggggttcttcctgggaagtgcaggcagaggagacatcgggatgcaaccaattctaagtcaagaataagaaaactgagttgctccttaaggatggaatggcttgcaagcagtatatgctgtataacttacaatcccaacatgattgagttacgaggaaaaaatatcaacatggaaacattcctcagtgtctatgacaagtagatgattgttcactgagctgttaacgttatttttttatttgtatttttatttttatatttattatttttttccaagacacagtctagctctatcacccaggctggagtgcagtggcgcaatctcagctcactgcaacctccgcctcccaggttcacgcgattctcctgtctcagcctcccgagtagctgggattacaggcgcctgccaccacgcccagctaatttttgtatttttagtagagaccgggtttcactgtgttgaccaggctggtctcaaactcctgacctcgtgatccacctgcctcagcctcccaaagtgctgggatccaccacgcccggccttttttttttttttttttttttttttttttttttttttgagacggagtctctatcacccaggttggagtgcagtgacgtgatctcggctcactgcaacctctgccgcccgggttcacgcgattttcccgcctcagcctcccgagtagctgggattacaggcgcctgccactgcgcccggctagtttttatatttttagtagagacggggtttcaccatcttggccaggctgttcttgaactcctgacctcgtgatccacccacttcggcctcccaaagtgctgggattacaggcatgaaccaccgcacctggcctttttttttatgtttagtgacagggtttcactgtgtgacccaggctggagtgtagtggtgaaattatagctcactgcagcctcaaactcccgggcttaaacgatcctcccatctgtctcctgagcagctgagactaccggtgcacgtcaccacgcccagctaatttttatatttttggtagagatagtgtcttgctgtgttgcccaggttggtctcaaactcccgggctcaattaatccacctgcctcagcttcccacagtgctaggattataggcatgagccaccatgcccggccaatgttttctttaagatcagaatcttcttaatactaaacaaacttaactttctcgtccccctgagcgatcctgtttctgctgcccaccccaggccagacctggcagcgcctgatccatggcagtcaggttcatcccagggctcggagccctgcagtcccgtcccggggccctgcctgacgtaggcgcccagccaacacctgcaacgacctgttgcccccaccccaggaaacaatcccggcttgggacagacaccaggggctgtgactgtgggtggctccttggagaaggtggccttgggcctcggcctttccacctggggtgcgcttggctcccccagactcagacacgcaggatccttgtgattgggcctagacacgagccctgcagtccctgtgggcgctggaggcgactcccccacgaagccctccctcccccagggcctggcggccctcgccggcggtgagctcatctcggggggcggcgtcgccggcggcgggtcgctggagctcacggcgtgcccccgcacccccgccccccacgcacccgtcccgggctcctgggcaattttaccaattaaggctttctcgccgggccgggccgggcgcggggcgggcgcggggcgggggtgcggccaacaagaaggcgggcggcggcggcccattcgcgtggaggcgcgtcgcgcgcagcggacgccgacagaatccccgaggcgcctggcgcgggcgcgggcgcgaaggcgatccgggcgccaccccgcggtcatcggtcaccggtcgctctcaggaacagcaggtgaggtctccgcggcccggcttcgcgccgtagggtcgccgcgctcctcgtcggccgggggcggggttggagaaggcgggcagagaggccggaaaacgcaggcgccagctcgcgcccaggtccgggccaggttcagctgggatgcgtgagccgatggaggctcccctggcatctgggagtgagtgtccagagaatagcttccctagttgacccacgagccatgtctgtgcccacgaatgtgggagcctgaggccatggggggtccccgagagagagagggtgtctgggcacttgcccatgaacggaccactgcatgcctgagagagaagggccctgacaccaggaacttgtgtggactcagggcgagtggccacctggaaggacacttctcagccagtgtgcccactgggagggggacagcgtgtcccttgctggctcgagtccacagggcaccagctgctttgggcacaggggagctggttctggggctgctctactccatgggggccatggtgaggatgagaccaggccaggttccttggttgggccctgggccctatgccaggttggctctgagttggatgcgcactgccagccaggatataaccaacaatgtccccagattcccgtgccacctggggccaggcaaaataggttaaaatccactggcagacccatttgtaagtgctccgagtgcaccgtcaaggtgggagcttgggaatgggcgacctcacctgccgcacctggacttgccagcacaggtctcttctcaccttgccagtctgcggcttccttccctcctgcgccccctggctacgcaggcctggaaacagctccttagggatcccagctgaacagctcctgggcttgggctatacctcccagtgggagggtctggcctggggtctgagggccaggggtggtgtggtgggcggggtgtgcctaacatccaagaatctactccaaataagggaaaatatgaaagagctggattttggcttcccaggactgcccgatctggtggctttgggatcgggcgacatctggcggttgatactatgttctagggacaagaaccctctacacgcccattccttgtttcctctaaatagggaaaagctagggctggaagacacggcacccacctcctgacactctttctgctggaattgaccactggtcactctgactcagtttccctgagctctgaagattaaggaatgaacccagacaacccagctcaatggcccttagtggagagagagtcaattattgatggaattccgtgcctgggaacttgctttccagtggggcagggggaccagaaggacaacttcaagcccgtcttgaatggggcccgtgcagggaggggtctgtatgggttcccccttcccagccctccctcccacctccaccccagctcccagacgcccaggcgcacttggtgcaggtgtgtctcaaagtggtcaggagaggggacaatatacaggggttggcctcagtactggaaaatgccatttgcaccccctaacaccactactagtgggaaaaaccagtggggccacaggctgccccgaagtgaatgtgctgggcggatcacagccccaccacgtgtcatgtagacacccagggctacaggagagtcaaccatatttgggcatgacgtgctggccaacccagggcctccatctctcactggtctttagcagataaattaattattactagaattgaacaggagggacagatacctgccttcctagaaaaaaaaaaaaaacactcagaggaggaaacattctggagaggggaggtaccgaggactgagagggaggggagtgcacaatggggaggaagccataggcaggctggcttctgactgaagatagtagcagtgagcgtccccagccgtcccctggtcccagtctacatctcggcacagcagccactgcaccatctccagagttatctaccagaaaattttgagtgaagagcccccacagctctggggacacaaccccccaggcccctgatccctgtcctcaggcctcctctgcacctgccaccacacctgaagcccacccagacccaggtgctcagagcctgacaagtcttatgggaacctctgagcaggcccctctgggtctggaatgccactcccgtgtttgccccctgccctggccacgctgggctgaggggactttccgacaggagaggaccccccgcttcagctccccccagtgccccgggtgaactggcatgaagggttaggcgggcacacgtctctgcatgcatcgcacggcgccctctgcccgcgcccactggcgtgcccgtgggcatgcccggaccccttcgaaggctgcttgctcctggagtgccggcggcctcctggcccagtgccccatatcctcccgggtggagggaagcagagagggaggcggtgggaagcagcgggcacaggtgcgcgggcgagggccctacggactgggaaggcgggcccgtggcagggggtctgcggggaccgcgtaggcgcaggccttgccctgcagccgcttcccaggtgatgagcacacaaagcgccctcggcagtgcctggtccggggctgccgctctccaggggttcgctcttagggttggccccttcccgccgctgccgggccggcggacggggatgccgccggggaaccctaggccctgggggcccggggaagggggatgacggcggggggtagggatgtgcagggacggggcagagcccaagtgacttagggaagagagccaccccaccccccgcaggggccctggggaaggaaagtcccttgtaaggcgcgccggctgcaggccaagcagtcccgcgccagacactgctcagcctttcctcgctctagggcgcgtttcctgcagcgccaacgcgaggctgcggggctgggagcatccttgcccaccccactgcccagcgacccaccctggagcccgggtttcgcgtctgatcagccgaacccgggggcctagtgggggcattccaacgggcggggcggggtggggcaggcgcgccctcgaagccccaccccacggcccctccccgcaggaggcccgccctctggccccgccctcctcccgcatttaaagggctcgctctctccgcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcggtgagggacgccccgaagcgccgggcgggcgggggcggggactccgtgcgtccttccatctccccgggcggacccctccaaaccacccccttccgggccgcagcgcaactcccgaggcctccggctgctctgctccacgcgggcctgcagaacaaaggcgcgcgggctggctggctggccggccgggcgtgcgaaccgctacgcgcccccgcccgctgcgccccggctggccggcgcccaggctgaactcacatcctccgcaggccgcgcctccgcggctgtgctcgcggtgggagtgggcctggggggtcgggcactgggcaggctcctggccctgcgccccgtccccgaggaggaggaggcccgggctctccccccacagctgtttagagagggccctctggccttcagaggcccgttggttctgaagtgtgggttggagctcgtgcgtcccattgtctggggctctgggctctttgtgtccctggaggatgggtcgcccatcggagatggctccaaccaccagtttagatctacccccccacacacacacaggcaacctgggggccagaaagaagcatagttagcaaaactgcacccggggtgagttgggcgtggttgactgagagacctggcttgtagactacttggacgccaacttttctcttcatcttgggccaaactcttgcttccatgtaggccttgcttttctgcgtgtagcacgcaggagttggttggtagatgctccagcgtgcattgtgccagcccagtgtctgtgtcactggactggagaggctggcattgaccaggcctgctgcagcagcccaattcgttctcaagataggggctgcatgagagggcaggccccagaatgggtgactcgggggtgatgtggaacagggagaggagagggatgatgagtcttctcttcttcagaattgagaggccttccagttaccctgcagccctggaatggcccttgctgaacccaagaaagtgagggaccaagacttgggttcccccagccactcagagggcagatcccaagaaccaaagttctttctttggaatgccagttgaggcgaggggcaggcccacccccacaagtcccagcctcagtctagccaagctgagtcatctcagtcctggatggtagggggggcgaccggatgtggggaggcgggccacaccccagctctttagggggggtctcctccctcctcccagctcccctcctccttgtgagctggctggagcaggcctagttcccagagctttgccatataaggcaaaaaaatgttggaaagcagcagtgattaggggagggaggggttggctggcccaggggctggggaaaggggggtgggatggggcggggccatccagccagacagtctcccagccctgggccctggtccttccctctctcttttgggagggggatggggacggagtaggctggcctaacatggacctggtgggcctggttgctccccgtgtgggggtcgttgaggggtctgaggctggactggggtgggggcctgatgggaagccctggctggccttgttccctggccctgcacccttggtcctctccgagtccccctccctgctgccatttggggagagtgaaaggcagcctcgtggggccaggaccaacctgggaactggggaggccactctgagcggctcacctggccctccaggtgctgcctgctgggctgggaagcagctgccatggacagcccagcccctcctcataggcccgccccctagttgactcaccagagaagtattttgtctgattatgggggaggctgacagggcttctaaagatgagccatcctgccttgagcctgagacccagaagtagccttgggtggggcccagagcccagcagggttgccatggtgatggggggtgtcagggacccgccctaaccacttcccctgtggcgagcctgccgaggcccagaggcccgttaggtggcaagtgggtcaggcagtgggtggcaagggggttcccagtgtctcctgctgccaccccggcatctcccgatgggccccagtgagtcagggccatgtggcccaactgctggttcctttgggctctgggcccctcccctggctaggcctgtggcctcccaactccaagcttgagtcttcgaggtggtagaggaagtgggggtggtggcgggggtcacaatccctcacccaaagggcgtttgcccaactcccccacttcccctgcctcaccccacccaccctggaacaacagttgtatttcccaaccacccagggccacccaccttcctcttcctcagccccagccccactccaggtcatgggccctggattctgggccagctggagtcagcctcctcctcctggttccccataggcccctgaggtgtgtggcggacccctgctctggcagctgtggacactgtccagctgttctccagagctgcccatctgcaggctgggtctgccctctgcccttcctctgggcccagggcttctggcagtaatcataccctgctggcatcgtgtgtgtgtgtctgtgtgtatctgccctcaccccaaagtctccttcacctctgaacaccccctgggaccctgggcagagagggcctcatccacatcctaccactggccaagagggggtgtctacctcctccttggcccctgctaccccgtgctgccagaccctgaccccaaagcctgggatcggcccctcccgcacagccgtgtgcccagcgtggccactcttctactcacagacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggtgagggggcgcagaggcaggagagactgggctggggtcacccatgggtggcccttgagggggttctgcggcccccagactcacagcctcccttgcgccacaggcctgtgtcctgactgggactcttgggacgccagcaagcccgttaccaatgcgcgagaggccatgcagcaggcggatgactggctgggcatcccccaggtacacccgcccggcctggctacagctgtaggggaccggatcggcagttgggagagactcggaggcccgatggctcctgttttctgcctgtgacaggtgatcacccccgaggagattgtggaccccaacgtggacgagcactctgtcatgacctacctgtcccagttccccaaggccaagctgaagccaggggctcccttgcggcccaaactgaacccgaagaaagcccgtgcctacgggccaggtgagggagccccaccaggggtgcacccgtgtgccaacgtcttccccataagacagtgtcccatctaaacgtggcggtccccaggggtcttgggttacatggcggctaggtgatcaagccacccaagagtcagacaagagtgggtttttgggactagtgaaaacgacaagagaatgctaataggttcctccagtcacagaagcctgctgcgtggggtcctcggggaggtagcatccagcggtctttattataaatggagatgaaccaggtctcagtaacagggacctaaaacccagtcaaggctcacacaggaacaagggcccagtgcggtgagaatgaatgttccagaaaacaggctgggcctgtcccagcagcgagagcacagctgggtcccgaggccaggctctgtgccacagctcacactgaatgaacttgcccagtttggaatgtgcctgacttaggggccagcagggagggctgaagggtggaggggtgaggctgtggccttaacagctggcccgtggttggctcgccttcccctgccaggcatcgagcccacaggcaacatggtgaagaagcgggcagagttcactgtggagaccagaagtgctggccagggagaggtgctggtgtacgtggaggacccggccggacaccaggaggaggtagggccagctgctggcagcagaggccccgcagcgctccctttcagtggggctgctcttagcaaaggctcacaggctccttcccactgcaggcaaaagtgaccgccaataacgacaagaaccgcaccttctccgtctggtacgtccccgaggtgacggggactcataaggtgagcccttggccaggggggaggcttgtgacctcaggcagtggctggaggcccccagccctaccctcacggcccacccttctggggacaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggtgaggggaggctgccaaggcccagctggtctgtggggagagccgcactggggcctgggagctgagcaggtgcctcgtggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaaggtaggcccggccctgactgccctctgctgtggcactgcagtctgggcctcccacaggagggggaccccctgggccagtcccgctgcagcccgccccggggcccctactctttgagcttctactgtctgggcacatgctgtttttcctcccctgctggggcccttcctcctctcctctcctcgcccctctccatctctctcctcacgctttcaccttcggaagagctcgctccagctgtctagaaacctgctgctctctgctctgcccacagggtcaacggtacttggatctgtcttcttcttggaagggggagggtggggggctctgggctggtgtggagcaggtgggaggaggcctgccatgtcctggcccaggccacagttcctggggtcacagtcccttccagttctgtcttgcatgtccccctccagccaagctctgagggacccaccaatcctgacagcccggccctgtgggaggcaagggaggggtcgcccagccgagctgctggtgctcagctggcccctctgcctgcagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccagtaagttggcctggagccaggccaggatgggtggcggcagcccccgggttcactgctgggcaggcctgaggccctccttgtcttggcagagggagaggagcgcgtgaagcagaaggacctgggggatggcgtgtatggcttcgagtattaccccatggtccctggaacctatatcgtcaccatcacgtggggtggtcagaacatcgggcgcaggtgaggcccccaggcatccctctcccagctctgcacactctgcctcttctcttccttctgcctccccacctgatgatgaggggccacatgggctcttcctgcctggccgccacagtggggcccacgctggctcatgtggtgatcctcggtgttccctgtgtggctctcgcatttgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggtaagttggaggctgcagcatgggcacctggggacagacgatggcaaggacggcccaccctgaggctccagggcactgaggggactggtggctgttgtcaggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtaaagagcaggctgtgatggcctaagtctcgccctgctgctcctgcttggggtctggtggggatggcactctgtgtccctggccaccctgcctgggttgtagctctggcagcctggacctggccccctgacagctgggtggtctcccgctaggtgaaggcacgtgggcctggattggagaagacaggtgtggccgtcaacaagccagcagagttcacagtggatgccaagcacggtggcaaggccccacttcgggtccaagtccaggtagagcacccacgggtgttgggggcagggcaggtgtgggcacccaggcctgggcactgaccagcaggccacctgctcctatctgcctgacaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgagccaacctccaccggcctttagtccatctcgatagcattcacgtagcacacgattcgtccatttcaagtggttgtggcacaccatcctgactcccctgtcccacagctcctggtgaccactaacctgctttctgctgtggctttgcctatcctggacatgttctatagatggaactgtgtgccatgtggccttttgtgtctggcttctttcgctcaccacgaagttttccgtgttttcgttcatgtttggcatgtcttggcactttgttcctttataattattttgtttatttatttatttatttgagatggagtctcacactgtcgcccaggctggagtgcaatggcgcgatctcggctcactgcaggctctttctcccaggttcacaccattgtcttgcctcagcctcccgggtagctgggactacaggcgcccgccacccccccggctaattttttgtatttttagtagagacaaggtttcactgtgttagccaggatggtgtcgatctcctgaccttgtgatctgcccacctcggcctcccaaagtgctgggatgacaggcatgagccaccgcgcccatcctggttttttttttttgagccggagttttgctcttattgccaggctggagtgcaatgacgtgatctcagctcactgcaacctctgcctgccagattcaagcaattctctcctgcctcagcctcctgagtagctgggattgcaggcatacgccaccattcccagctaattttgtatttttagtagagacggggtttctccatgttggtcagactggtctcaaccgcctgaccccaggtggtccgcccaccttggccttccaaagtgctgggattacaggcatgagccaccacgtccggccgcttcatttatttttatggccgcataatactccattgtgtggccagaccacattccatttttccgttcacttgctaacagatattgaggatgagcttgcctttggtgatcatgaacagtgctgttaacagtgagtccaggtgtttgcgtggacatttgctttcatttctcttgggtagttgcctcggagtgaaccggagcatcacacagtccctctgtggtcaactgaggaactgccagactcttcccaaggcagctggaccattttgtgtgcctgccagtgtagctgagggagcttctgagtctcctccaggctgctcatgcccttgcccttgcccctgtgccctgcaggtgaatgtgggagctggcagccaccccaacaaggtcaaagtatacggccccggagtagccaagacagggctcaaggcccacgagcccacctacttcactgtggactgcgccgaggctggccagggtaaggcctggctgtgggtgggagggcaggtggctggggtgtccctgcgaggtctcagcctccgctcctctccccgccgcaggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggtgggtgctgcgctcctggccgctaagatgtcattgcggatgacgtctgccctcctctaaggccttctcctcccactgcctgcaggccacgcccaccagccccatccgagtcaaggtggagccctctcatgacgccagtaaggtgaaggccgagggccctggcctcagtcgcactggtgaggacaggtaccccatggcaggttgcggggcatcaagggtaggagggcttggggcagggtgcccctacatggtccctgtgtgttcctcaggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcaggtagccacaccctccactacagtcaccgagtccccagcctcctcatgcagcagcctaggggacagctccgagggactttctgcccactctcattccttacctgggagaggacaggcatggaggtccaggagggggttggggagcaattctggtgtctctaaatacccccttcccttctgcacccttcccagggtccagtaggcgtcaatgtcacttatggaggggatcccatccctaagagccctttctcagtggcagtatctccaagcctggacctcagcaagatcaaggtgtctggcctgggagagagtaagtagttggggcccttgtcgcaaaggcctttgtcacatccagggattggctgagctgggtgtcatgtctctctccttcctttcatcgtttccacagaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtaattggggtatgggaggccctaagggtagaacccactgtgctctctgagggccccaaaggtaccccatcttctccagacctgccctaaatccttttttttttttttttttcctgagacagactgtcaaccttgaccctgtttaagtgagagtaaaggggaggagggaaatagaaacccacaaaaagtcatcagggttgaagaatttccttttttttttttttccttcctttttttttttttttttttttttttttttttgagaaagagtctcactctgtcgcccaggctggagtgcagtggcgcgatattggctcacggcaccctccgcctcctggcttcaagcaatactcctgcctcagcctcccaagtagctgggattacaggtgcccgccaccatgcccagctaattttggtaattttagtagagacgagatttcaccatgttggccaggctgttctcaaactcctgacctcaggtgatccacccaccttggcctcccaaagggctgagattacaggcgtgagtgaccgcgccctgccctcctttttgtccttatgactgatggatggcccatctggcaggcagcctgggcccgcccgtgtccctgtttggtgagggcaggaagccagggcaaggggaggcaggtggaaagtcaagcaggaggtctgggatcggggcatagtgtggccttggctcctgaccccttcttccctcaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgagttgccctgccgtggggtatgtgacgggggacagggaccagaacccccgagccccaagcctcctctctgtgcctttgcaggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggtgcgtgctggggactcccacaggctggcagacggggtgggtggggtggcccgggctcctcctgacctggcctgcactcctccaggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggtaagggagcccccaggagcccgtgtggctggtgggcctgggaaccccaggaatgaccggctgtctgtttggaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggtgaggaggtggcggccagggcagggctgggactgtctgctcgtccccaccctgtctcatacagccgccatccctttgccccaaccctcaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggtgagtgtttgcatgcctggagccaggggtcaggagggcagtgtcctgtttgagggccgggaaaggaaactggaggcccaaagtgaggaccagagtgcagaggtggtgcaagtgtgtaggtgtttttggaagagcctcaggtgacagtgcagccaggtgggggacttggaggaggtagagcagatgggactggtcactgagcagatgtggcaggaaggcaggcaggcaagggtcccagctggcacccagatgggtgtctttcgtgccagagggggtcaaggccattcccagggtcgggtggatgaggataaagcgaggtctaggcctggggctgggtcctggccgtccagtgtggtggggtaggaatggaggcccaggagactagctgatgctctgtccctggggctggggccaggcctggtggagccagtggacgtggtagacaacgctgatggcacccagaccgtcaattatgtgcccagccgagaagggccctacagcatctcagtactgtatggagatgaagaggtaccccggaggtaagaggcagggcctgctgcctgtggggagtggcccaggctggatgctgagaacctgtctgactgctcacaacaccaatccctcacagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggtgagctccgggcacaggcaggggaggcaggggggcctgggcggctggagtgtgggctgcgggtggctggtgtctgatctccctgcggagctgcaccaaggagggcagggaaggacagggcccctgtctttggtttgctaaggttgtgactaccttaggatggtggtgacaggcacaggcttccccagacgtgcacttgctgctaactttgagcacgtcaccaaagccttctgtgcctcagtttccccacctgtaatattctcatggggcaggtataggatagaagcttgagatcaccccggtgagctcctcctagtgctggccaggccctggggctgaggatgggtgccaagctggctggccgcgcctgttgtcatgtgggaagtgtgggatgttttagtctccattctggactctgccaggtgcaggcagcccttttgggccatagcagttaagatgcctgaggcccagagactgtccctgtagcagcagcgctgggcactctgggagcgcctgaggcaggcccggggctactcgggcttgggccaactgcctcccctgcctctgccacacaggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacaggtgagcccgcccgctgttggccgctgcggcgctcggcacggggcttgggttgtgcctgtgtgcaagggctcgctgcttggggcggcgtgtgggagtgggggccgcccccttgagtgactcacctgacctttctccttgctctctgccctctcacctcagtgtcaatcggaggtcacgggctaggtaagctgcttgctggggccactcccaatgcccctcctgcccagaggggcagcttcctttcctcttggggccgattcccaggacagttccagctgcagctctaggcagggacagagttgggtggggtgcagaagatgaggccgtgggctggagggcgagggcccagggaggcttccggagctgagcatgaccgctccagctcttcccctctctgggcctttatttccccatctgagaactcgggttgcagctgagagctttggggtgaggtgcatcctgagaggcaccccactggggactttggggtctcgggatcttggcacccagggaggcacaagggctcctgcgtgggctgagggaacaaggggtctccccaactcaatgggagccccagccctggccagatccacagacccccatccccaccttccaggggcctctgcgtcccgggccgggggaggtgcatgagcgggtggggctggctggtagtgcagtagcgccagtgtcgactgcttgggcggccagcatggcggggcccggcccagcctcagagccccaaagtgcattctgtggcccgtctccctccttcccccttcccctatcccccagcagtgacgttattcagacattccccaacaggcatggagggtcacctgccccagccagggacacccagggatgctgatgagaggctacaggcctggcacttgggcgaggtggctaaggaaagggtgagagggtggctagagttttgcggcaggagcgagatggctttatagagcaggccgtaggatccgatgtgtgtgtgacaggcgtgtgtgcgcagggcgggggaggctggggagtactgattgcagggccttgggggctttgagggtgggagcaagactcagtaacctcagtttccctggctactgtttgcagaatggagacagggagcccggggtggggaagggggcgctgaagttgctctctggcaagcttgacggccacggggcttcagtgagagccaaattaggaggcatactttgaggatggagtggctgagacctgcggttggctgggagccgggcagggaaagtgggggcagtcgggtacctgtgaggttggggcccaagccactaactagatggcatggggtgcacatgagtgaagcctcccagggcagcgtgggcagccggcagccaggtctggagcctgggagagctgcctggccgcggcaggccagcatggagcctagtgcagcaggagccctcggccgatagtgggacttggtggcagggcccctcgagcttggccttcaagtaggtttcgtgctcctggctgcttccctggcaggaggccaggctgcagggggcactctcactgccaggcctcacagcccacagccccccaagcctccacggcggagacccagatcataacgtcactgtctctcccctttcctcgggcactctggggccctggagcctgctcagctgctctgccctcgcaacccagcagtggtggctgtagcttgggcctcctgttccctgtctccctgggtgctatccccgctctgccaagcctgctgcgctgcgctactcgggtgctaaccccgctgcctcccgcttccccgctcccactcctgtctgcaccgggctgcttttcaccgcgagccttctcagttgtcaggaaactccggtttcaccatcaggcctggggggtggggaggcaagtgtcacatccccccacgctgcagcaggactccgcctcaccgcgtccacacacagcaatgggggccggggccaggccagaagggcgcaggcagccgtgtgcccagccagatgctggcgttcagcagtgtgggccatggtgctggacgaggctgagtaggcaagggagtggctgtcaacacttaggctggagtgggcccttccttttcctcccaggcacctgggtgctactgtcgggcctctcccacatgggcacttgaggtggtcaggagaaaccttcctgccttctgagaaaccactcgccatcccagcttggaggggcagggcggggcaggaggcctggcggcctggctgtgcttggtggtggcaatgagaggcctgtgtgggcggcaggcggacgggaacaacctgaacccgagctcacacgctggcccccctttggggacccaccctgccccaccaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggtgaggaggggtggggggtaggtcagcaggggtgtctggcaggtcccggcctgttcccctggggcccctctgtgacaacagactctccagcagctctctgctttgccctgcaggctctggctggggaccagccctcggtgcagccccctctacggtctcagcagctggccccacagtacacctacgcccagggcggccagcagacttgggtacggcctggccagctagggacactggggctagccagctgggtgttctgtgagcccctagtttaccatgtgtgaggagggaccccagatcctcccactgtccctcacccatgccctgtgtctccactgcaggccccggagaggcccctggtgggtgtcaatgggctggatgtgaccagcctgaggccctttgaccttgtcatccccttcaccatcaagaagggcgagatcacaggtgagtggggacttgggaaggagctcgggagccaaggaggccagactgtgccaatgagctgccctgacctcagccccactgccccacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggtgggcctgccctgcctctgcccactccaccgccaccacctcacagagagatggggctgggggacacacgaggctgccattccacaaggcccttcttcctgcctcaggaagccccttgcagttctatgtggattacgtcaactgtggccatgtcactgcctatgggcctggcctcacccatggagtagtgaacaagcctgccaccttcaccgtcaacaccaaggatgcaggagagggtgagcaatagctctggtcttgacctgctctgtgcccgggatgccctcaccggggtaagggctggactcaggagatactcctgaatggggctccctgccctgctgccctggccatcggagctcctcagtgcaggccaactggagtgtccccagcatagttcccatgctcacccacggctctctccagggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgggtggcactgggagcagtgacagaaacgggtggcagggtgggcatggtctcccatggctggacgcacactgatggctggcctgtccccaccaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtgggtaagcggctgaagggtccagggggttcagaaaggaggcagcctgtggggagccatgccctccctgactgacagccatgccctgtgtccagggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggtaggcagtggctgcccaccagctggggcgggagcactgtgcatagcaccgaggctcaggggtatccatcccctaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggtgagtgcagcagtgcctcggcagcccccctcactacaccagggcccacaggcagtatgtgactggaggggcgtgggccgtgctttcttcctgcaggcagccccttctctgtgaaggtgacaggcgagggccgggtgaaagagagcatcacccgcaggcgtcgggctccttcagtggccaacgttggtagtcattgtgacctcagcctgaaaatccctggtaggggctgtgggaagcctggggaggggtcctggggctcaagcagccccaagaggaggggtggagcccagggctgctgctcactagcccatccccaccctgcagaaattagcatccaggatatgacagcccaggtgaccagcccatcgggcaagacccatgaggccgagatcgtggaaggggagaaccacacctactgcatccgctttgttcccgctgagatgggcacacacacagtcagcgtgaagtacaagggccagcacgtgcctgggagccccttccagttcaccgtggggcccctaggggaagggggagcccacaaggtccgagctgggggccctggcctggagagagctgaagctggagtgccaggtaggcctgctcacaccccgagtgctcgctctcctgcgttggccagggtggggttgggggtggaggaaagagccggcaggcatgtctaccttggctatgcctggagggggccgaggctggtgaagcagccttcagtgaggacaaactgttctcccacagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtactgggaacccggctggggttggaggaggtggggcctgagtgtgggtattggacccagggctggcacagatagccctgcctggcactcactcttcactttgaggtcacagggccacccaggctgttcgtgggaggtgggaggcccaaaggctgatgagccggtcttacactctttccctgcccaggtgactacgaagtctcagtcaagttcaacgaggaacacattcccgacagccccttcgtggtgcctgtggcttctccgtctggcgacgcccgccgcctcactgtttctagccttcaggtgaggcaccgagagaaaccgcccacctggggctcctgggcccggacagaccagagccaccgcagagaccaggccttggccctgtgttcagtgacccccctggcccagctctgggttccaggcctctgctctggccgggtgcagcccacgcttggggtcggcaggaaatatcctgcccaccacgtggagtttttctcgtgtctcaggtctaaaggctttgaacagaagcctgtgccccttgagcaccagggctgcggtttaaagagggacagcctgccaaggctgggtgctgcccacagggtggggcagccctcccttcctgccacctgggtgtgtgcgacggcagagtgtgggggcaggggcggggatgtgcgcctgtggcttgctgccccttgcaaatcagtggctctccctctttaaaccaagttggacgccagatgggtaagtgcgacccgcgggcctcttgctcctggggcctttccgtcctcccttgccctggctcaagcacccccatctaaccatgtctgctgtgcttccaggagtcagggctaaaggtcaaccagccagcctcttttgcagtcagcctgaacggggccaagggggcgatcgatgccaaggtgcacagcccctcaggagccctggaggagtgctatgtcacagaaattgaccaaggtgaggccctgtccctgcccggccgccctgccctgctggctggaagcaggctgagagtacaaaaggaaggtaccgcttctgtaagcagccaagacggggccccaactcctgggccccctaagccaggcaaccctttcccaattggtgacccaagccgctggggatgtggctcgccacccacagctattaggaaggccttctaccctgcagtaccatgccatctccacagggaaagactcaaagtccagcctcagtgctgcccggcccttcagccacggccatggtacttgtgcacaggcctggggcagccttgtgggtaggaggagcccagtgggcttcatttcacggcctagtcctgcccttcccagctgcatgacctgaagcaagttcctgcccgtctctgagcctgttaacatgcaggggatatggtgttcacggtaacctttcttaggaggcagcaaggcctgggtttggcttgtaaaagatttccgtcccaatgcaccctgacggtgggcagcttgagtgtctaaaccttcggccctcaggaggtctgctgcggggtgcaggtgcccagcgtggctgggctcacactgatggaccggcaaaatggggagggccagggttgaggctgttcctcacagacaccatctgctggtttgaggaggggccccaggcccacagcatgactccctgctcctcagataagtatgctgtgcgcttcatccctcgggagaatggcgtttacctgattgacgtcaagttcaacggcacccacatccctggaagccccttcaagatccgagttggggagcctgggcatggaggggacccaggcttggtgtctgcttacggagcaggtctggaaggcggtgtcacaggtaagtctgtcggtgcggctgcacgtgtgcacacagctgctaggcccttgcctccaagctcttggtgacaacaggaggcacctggaggtgacaagcctgtgctgggtggccgaggacagggaggcaggccagtctggctctgcctgacctcctgtgctcccagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggtgagcctggggccaagctattggcatctgcccaacgcccggcaccacagccacctcttagccccacccactctgccttgcaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggtgggcaacccgggcccccggcccaccttcccaccaaaatgaggccagaaatcacaggatggccagtgtctgggagagcagggaccgcctttggggcgtggctttcacttctagagccacctccctgccacctcctggacccctcaaacaaagaccagggaggagctggaatctgctaagctggcctgggttggggaggtgctggcagctctttaggaagagagaactgtcaccccagaactggcttagggacaggagaggagagcaggacaccagcgggaggaagggggctgggacctgggactgaggacccctcttgcctcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatggggggacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagccgcccctgccctgtgccgtgctgcgctcacctgcctccccagccagccgctgacctctcggctttcacttgggcagagggagccatttggtggcgctgcttgtcttctttggttctgggaggggtgagggatgggggtcctgtacacaaccacccactagttctcttctccagccaagaggaataaagttttgcttccattctcctttgcgtggctgtagctttgttggggttgggggaccagtcaaggccaacctgacaggggtgccaatgagcagatcaaagcatgggctgagcacaggtcacctccctccagggctcctgcttcaccccaccctgactccagaaggcaccatctatctttgcttcctctgcctccctgagttcaagccaacgtaaggagaggaacatgtagcaacctggaatggagcccaggcagcaaggaggcaaagagctgggcaggagagcccattactgggtagggtggtgtcaggaaggctccctggtggaggtggccagataatcaacagcaggcccggccgggtgtggtggctcacgcctgtaatcccagcacttcgggaggccgaggcaggcagatcacaaggtcaggagatcaagaccatcctggctaacacggtgaaaccccgtctctactaaaaatacaaaaaattagccaggtgtggtggcgggcgcctgtagtcccagctactcgggaggctgaggcaggagaatggcgcgaacccaggagacagagcttgcagtgagccgagatcgcgccactgccctccagcctgggcgacagagcgagactctgtctcaaaaaaaaaaaaaaaaaaaaatcacagcaggccctggccatctgccaggtaacttgaacatgccaccatgccaccattcccccaaacaagggactgggatgaggccccctcccccaggctctgggcctcagggccctttagttaacaggtggcaggaggtggatgcattcaaggtgccaatcccaggtaccctgggccccctgctgaatatcccctcattggtacccctgccgtggattcccacaccaacctatgtgtctcccactgtaaagattgcccccaaacacataacatcccaagtcgtcctggctcctggtgctgcctgcatgctatcgggacatcccaactgcagcacccaaagctgcctgctccctgggccaaaggctttggccctcgatcaaacccctgacaaggacaccaccacctcagacatctgcagacaagggccaggaagcaaggctctcgggggcaacgctcagctttctcgccacatcctccctcagctccacagcgtctgacacgaccaggccgtagcctgcagccatggcacacgtcaaacccagaccttctgagacctcaacaccacgcgtaccctccttgacccctgttgagagggcaaagtagaaaaggcagcggcagttcaggcaggatggctacttttatttctcactggggctgggctgctggccccaggctcagggcggccactcactgggagacacggggcaagcaagacacagaaaggggaagtcccacccccagccgcagccactctactgctccccctgggcccaatggcatagaggtaaaggggccaagcacactctggaagcctctaaaagccaccagctgaacggggctgtgaggcagcagagccaggcccagaaagatgcagtgccagttgggaggacgggaggtccccctgaggctgcgacttgtccgctcagcccactgtgtgcccaggattctgaacctctggggcactccctcctgtcccgagtcacccagggtctcctgccccctccctgtgtctgctccatcacatcccctctcaagccccatgcctggcagggccaccgccctagggctgggctaggtgaaccaagggcaccggtcccccaaacctgccgatcgtccccaggctgcagggagggacacatgtggggcggcaagggcagaagataaactagggggatccgggcccctgaggacagccctggcgggaggccacaggcctcacagggtggtgagctggaggccacccaggcaggcaggcaggcagcagggaaagagactggcacggtcctggccagggcccc

SEQ ID NO: 11954 - DNA, 48920 bp, Human
cggcagatgctgttgtttaccacagataaacactgactcttcagagtatgaaggagacagactaaggtagatgatgtgttaaaggaactagggtggtgatttagattgttattcatattgccaaaatgatggagcttctcgacttcagttgatgttttgggctggatcattctctgttgatagggttgattgtagcagcatccctggcctccacacactagatggcaacagcaccatcttggaatgacaaccaaaaatgtctccagatgttgagaaccactgctttacctgtatgataaaattatctgaagtcccagcaagcctttttctcttcccatgcaaaggcccaagctgggttagtaataagtgaaaaaagaaaaaccacgcatcttcatattcttcattcaacgtatttactgaataccttgtgtgccaggccagtggagacaaagatgataatggtagttactgggataactcagtttggtgaacacatgatgtggtttggttattagtagagttacagaaaaggtagcatggaaactgagatggcctcgtgggtgttggaaggcttttcagcaaggggaggtgaatgttattaggtccaacctgaaaggtgcatatttcaggcagatagataggtgtttggcatcttataactgctcactttccttttccttagtaatctgaaagtaattcactgtactgaatagttaatggttcccttaatagactcttgtccttggaaaaataaaatgaaatgactggggttctattagtaactgaaaaattgtcaacaattaaaactctaaaacctactcatgagaaaataaagctcttttgtttaggaataataaaagccgacttaatgacttctgaaagaagtaagtgtccctgtaaaggccaggtgaaactgccattctttaacctgttactcggtgtacttgactgcggaaagaacccagaaacagaacaggccaggcccaaaggatagaagtgtaggtttcctctggaagcttactgttctgctaaatgacctaaaaattgctagaacactccagataagtcaatttctgctataaaaatcattgcagaaagagattatttttagttgtctttatttaaaaaatgaaacacattagttacaaaaaccgttgctccaaatagataccgtgtatcttacaaatgttttttgcttggttttgagtgtttactgtagaaattttcaatatcataaataaatgattatttctttctcagaaagctgatttttgtagtgtagtatttacaaataccgtaagtgaaaaatgatagtttataaatttgtaccatttaggaaaaaatgttttatgtagtgttgtttgtgtaacagcaaataaaaccatttaagattatagtttttacaagggtggtaaaacctttaaaacagagcataatgtgcatcgtatgcctttctgacattagcatgcaaaaacaaagctatttgttaaaatagacttatttttgctccaactaagtaaacatgtaaaattatttttaataagctcaatagcttagaaggcatcttgtttaaaatgaaaataatttaaaacaatatctagcactgcaacccaaagctaacagacaactgcaatgccactgtgacatatttcagcaaaatataaaaaatgaaaactttccaagttgtagaacattggtttttcaaatgtaagactgttcacatgtgtattcacatgttcacaagttttccaaagggaaaatactaattttttattggcatcatccatatccaggcaggctgtagttgagtcacctgaagaaacacaaaattgataaagaacttcttaaaataatacgaacaagaaatattttataagcgggatgctctaatggggaaaacgcctatgcattctaaggttacattatgttctgtactgacgatccaagttaacagcaagtgaaaatgcacattagataaaataggtaattttagtagatggttacttcatttagtgataatttaggaattcctatttatgccaaatagcaattccacccctaaacaaacactttaaatttatagcatgaagtatgtaaacaacagtttcccaactgtttcccttagacacaaatgtcaatatttgccatcaacaactccaactcacatgggaaagttacataaaaagtgttcttaccaatagctactcctaaatggagctgctattttttctatgttttctataaagttatttacatctgtaacaaggattccattattttcaaagacttctctggggatagtaggcttgtctgttaaaaaaaaaaaaaaaaaaaacttttggttaatataattaatgtacttttatataacaggacctggttttttattttaaaaaatctgtggaacttcctcgtgtggggggtagggggagaaaaggtgttgggttccaaattaagaaaagatttgaagctttggaaatagatgcctccatcgggggtggtggttaaagtactgaaaaaaaatccctgaaaaatgataactatggttctttacgtaaatttttcttaacacttttttttttttttttttaaagatagatagggtcttgttctgccacccaggttacagtgcagtggtgtgatgacggctcactgcagcctcgagcaatccttctgccttaacccaagtagctaggactataggcacacatcaccacacctgccaacttctgtagagatgaggtctcgctaagttgcccaggctggcctcaaattcctgggctcagtgatccacctgcttcagcctcccaaagtgctggcattacaggcgtgagccactgtccctggctgccccacaaattttttaaaagcaacctctgcctccggggttcaagccattctcctgcctcggcctcccaagtagctgggactactggcatgaaccaccacacctgactaatttttgtatttttagtagagatggggtttcaccatgttggctaggctggtctctaactcctgacctcaagtgatccgcccgcctcggcctcccaaagtgctgggattacaggtgtgagccactgcacccagccccagtattgatttaaaaaataatacggtataactacttatactgtattgagtattataagtaatctagaactgacttacatacataggaggattgtgtagttacctgcaaatactacattttatataagggcttcagcttcagcagatttgggtgattctggtatccatgggatgccaagccatttagatacctgatactcttcatcaggtatctaactttgacattcctagagctgaccaattttggcattaactgagtaaaatgcgcctgtgaattacctgttaggaggacagcaaacctggcatcaatatgctgaatttgcaggtttagcaaacatttcagaatttctgcttttgttgatgatcgagagtcacactggtgataatgaagcaattcaatgatatttgcactctgaaatgacttcaacattatgttcttcttatgtgcagttgaatccactctgtgaaagatacataggcatattaaaatatttttcagttttattcttaggactttttcttgccttcagtttaaccattcaaactcatgagttcctctgcctttcttcttgacgttctttttcatgacacactttggttacctcaaaacatcacaattgtacctactccttttgtaaatgtggattttaaacatgggcctcattctaagagggacatcatgcatctacctacgaccaatcaagccatgtggcttggcaagcctttcatgaatttcgagtgggccttattgcgttgtatatttgtagagcaatgcacatctatacttctcataccttgtgggcagataatcgccaacttcattaaaattaggtagcagccagaattttcttggtttcttgcttccctgaaaattctatcactactaggaaaatgtgttaactcagtatgtttaaatttttagcatttctgtctctgctcgactcccgtctctctagttttcatcacttacattctcatgcttgttggagaaaacccaaatcacacccattcccataaccctagtgataatcactcttaacatcatgaattaatttcctttcactttttcctgtataaattttttatgacatcatactgaacatagttacatgataccaacttttatgccatccctctttctatgaatagaaactttttacatgcttctattgtgtaagttttgggtgggcattattttgtataaactttaaaatatttaactgtagtctgcatatctccctcctagagatggaactgaggttggttttgcaatgactgataaccacctagaattttgggtaaattccacaaaaggtcaaaggatatgaagagttttctaatgagttctcaataatacataacgcctgttacataatgccagagtggtataatatgaagagcatactgcagcgccaacagcagtgagtacgggcatgtaccacataatgatgtttcagtcaatgacggaccacatatacaatggtggtcccataaaattatactactgtaatttactgaaccttttttgtgtttagacacacagataccaccattgcattaaatctgcctacagtattcagtacagtcacatgtacaggtttgcaatctaggagtaggctctaccatatcagtttgtgtaagtacactctatgtctgcacatagacaaaatcgtcttatgacgtttctcaggctgtatccccgtcgttaagtgacatgactttctctacccaaagccctagaagtgctagattgatttatgcttattttataggtgtgctgtggtacatcagaaccttaaatgtgcttctctacttaccgaagttgacgtttttcccctcaagtgctggttactgaagtccgctgtgaatggtcatacccttgacctgctgaagcctttgcaccctcctttcctgccaaggaaacctctgtgctccttctctcctttgctagctccacttcaagagaaaagctttctgagattctgttcctcaaaggtcacatacagctaacagtcgtttcgtctttctgggattgaaacccagcttcataacttactacttgtttgaccttggtcatgtttgttatctactctgcttcagttctgcattataaaagtgaggatttgctatctagctcctggggatgaagtctgaatgaaaatggatgcacctaacagtgcctgaaatccttatttcacaagggcttgtcaggtctgcttttccaattggtcctgcttgtgagaatgtggaggaatctctcagccccagctctcttcagccaaggaatcaaacatgtatttttttcttttataaattacagctttagacttagtgaagtttgcgtatttataagcctcttcttttagggtacaactgaattaaggatagattatggtcttaatttttccattctccttaaagtggtggcaacttataagtatccaaaaaagcattaatggtacaagttccatatattttttaaagtttgtagtagtagggcttaaatagaatatggacatttcatgactgctaagtttgactcccttacttctgttagtctagataagtacatgcctcatactgttggctacggtcacagcacatagcttccttcattgaatacagagccagcagccctcatgctctttactgatgaaggccattccactgcagcactaggctagagcccatggaacatgaggcgtttctctgctaccccagcagggcaggaggaaccatacacacagcaagtccttacctttcatcttcttttagctttttattttccctgtagtgaagcaaccacttccatcttccatttccatttagtttttccaggattttgataatttccttcagttgaactacaaaacaataaatgtagcaaaagaagatgacaagtttaaggtacttttggctcatgccaagcccagtgataattatttgtaaaacaagaaaaaaacagactaagacccatggttgagtacacaccatcactgtcacttatgtggttgggcagcatcctgctctcacaagcccctcagcctggtcccacctgctcacactatggtgggagataactctgtagacacgaacacagtggagtggtcaccagcaactagagttctgtgtacaaattgtgtgacagaagagaagcaggaggccccgatgcagtagagaaatgaagtttctaaatacagaatcctttttttttgagacagggtttcggctgtcacccaggctggagtgtggtggcatgatctcagctcactatagcctcaacctcctgggctcaagtaatcctccatccttagtctccttagctgggactacaggcacacactaccacagctggctagtatttttattttttgtagagatgggatctcactatgttgcccaggctggtcttgaactcctgatctccagggatcctcctgccttggcctcccaaagtgttgggattacagacgtgtgcctacaaatatttaaaatcccaggttctgtgtagaagtcacactggttaaggtacatgctgcttttgatctagaagtggtatcacttccaatgtgatcagagccggggcaggttttatacataaaagtgccctgagagaagtaaagtatgagttttcaagtagatgattaaataagctgacttagtagccattttttagatttttgtgacatcaagatggtaggggtgttgacatcagaaatggagaaggttgactttaagcaaacaatttaatatggagctgctctgacttggcaagtgaagagactaaatataataaaatcctgaatttgtgttactaggagcttagctgcactaccgagagggagggaactcagaagcaagtgtggtggtaagaatcagttaaaagaggtgaaaagcattgctataagagaatcactgtatgaaaagagcacagcagacagcagaaattatgcctcagtagggggcaactgatattccttagagttgatcatttcttttggatgaaacagtatttaggtcactgggtgagaagttgatctgacttcaaagaaacaggaaaagaaaataaagaccaacctaatgttacagcttctagtatcttgtcatctgatatcacaaagcctcctgcacgaaacagttcttggtaggtgtgatcaagaacatctccagggctgtctactccagcaaagatgacactggggaaatgcttcagcttcagcaaagaaggaatctgcatgacacaaaaaggaccccggtgaagagaggctcactgggcacattttcttagacactcccttgcttttctatccaagagagtcaaggttcaggaacaactgaaaatatttcaacctggattaccgactggtcattctgccctgcatgaggcatattaactgagctcatcatcaccaggggctgcaaactcaacaaaattagttcattaaaaaaaggtctcaaactcccaaaggttggaaataacacgtcatgagggaagaggacacatctgaggttgtgggcactgaaaagtgaggtcacctcacttcgccgtcattcgtctccagctccccttggtgccagcaccgacgactgcctgctgatgacggcaggtttatgcacccagcctttgtccgtagttgggtcttcttgagacaagcaattactttgattcaactagctggtaaatataatggttcagaaaatttccaaaaggtcttttaaggcaagatttcttattgttagacatcaagtgatgcagatttatatctcagatgaaaaaatttagcaacctctcacctaagtctcccttagttaatatgatttttttaaccatctgccctacaaataacttggtaatattgcagtattctataatacaccatcttcccacttaaaggcccaacagtaatgtctgttagcttctcttctacataaaaaaagagggatgagtctgagcattacagaacaacttatgtgcctggaatacgtttctttgtaaggtatttccaaccgacctgatgcaaatgtgatgatatatcttcatttctgatgatgatgattagtgtatcattctctctgtggaaagcttgacagaagtgctgaggttcaatttctgtatggcctcctttcctcagaaggttctgaaagatttacaaatagccattattaaaaaaagggtacttccacagaactacctgtatagtttattaaaataatgaaaagcagtatagtctaataaggcaaccataaatgacaatttgtcttattactaaataagcaccttttatatataaaataaatgactcaggtattgttaacaactggacttagaagttgatttcaaaggtaaataaagtatcaaaggctgattttcttttagaacatcagaataatctacataaatgagtttcatctgcttcaaggcatgagctaccttgagaataccagatatatactttaaaaatgctacctgtagttaaagcatttctagagctttaaaaaacaatacccatgtatttctttaccattaaaggggactgattttggagtcagcagtcccttgggtctacgtctcagaataagacaggtgatgcagttgaaacagcatgcgattgtacggtgccactgcagtgcagcccagtacaatcaacacacagaatggctccctaatcatcctgactgggagggtaaatttgtgtaattaaataaattctataatcctacactccctatgactttgacatttctttgcttttttttttgagacatggtctcactctgtcacccaggctgcagtaaagtgaaacgaacatagctcactgcagctttgacctcccgggctcaagcaatcctcctacctcagcctcccaggtagctagggctacaggtgcacatcactgggcccggctttttttttctttttggtagaaatggaggtctatgttgctcaggctggcctcaagcagtgttgcccaagctagtctcaagcagttctcttacctcagcctcccaaagtactaggattccgggcatgaaccgtggcacctggccttgacattgactatctggctgaaggattctgggtttctgttatgcccagaagactgcctgaccatcacttatttccttcataaaagtgaagtgttactttgatctgtttcccttggatcttttttttttgagatgttgtcttactctgtcacccaggctggagtgcagtggtgaaatctcggctcactgcaacccctgcctcctgggttcaagtgattcacctccctgagcctccctagtagctgggattacaggtgcccgccaccacgcctggcttatttttgtcatttttagtagagatggggtttcaccatgttggccaggctggtctcaaactcctgacttcaagcgatccgcctgccttggcctcccaaagtgctgggattacaggcgagagccactgtgcggctcccttggatctttaaacaactcaaattctgactatttcaattcattcaaagtatatggtatgattttcaaaaaaattcttatgagatttaacgaagagcttactgaaatatctaggcataaatctctagtcttcatttatttgactaacaaattatttgaatgaatacattttcatcaaatcctgtggtggtctgacctattctgtcacaccctcagatttctctttttttttttttttttttttgagacaagagtcttgctctgttgcccaggctggagtgcagtggcgcgatcttggctcactgcaagctctgcctcccgggttcacgccattctcctgcctcagcctcccgagtagctgggactacaggcacccgccaccacgcccagctaatttctttttgtatttttagtagagatggggtttcacggtgttagccaggaaggtctcaatctcctgaccttgtgatccgcccacctcggcctcccaaagtgctgggattacaggcgtgagccaccgcgcccggccgtgtccactttctcagttgacaagtagttttacctttgcacatttgttattttctgttgtaaacagtgacaccacgtgataaaatattatgaaacaatacattcactatagaaacaagcaagatatctagaagaactcctgctatggagttcgagaccagcctggccaacatggtgaaaccccatctctactaaaaatacaaaaattagccaggcatggtggcacgcacctgtaatcccagctattcgagaaggtgaggcaggagaatcacttgaaaccagaagacggaggctgcagtgagctgagatcgcgccactgcactccagcctgggcgacaagagcaaaacttcatctcaattaaaaaaaaaaaagtacttctgctatgaataaaacttagcattgccatgctctcttcttcatgaaaatcattatcacttcatctggaaaggaagtgagaactaagattactgctctgttgtggagtctcactctgtcgggcaggctgggagcacagtggcttactacaacctccacatcctgggttcaagtgattctcctgccttagcctcccgagtaccacaagcgcgcgccgccacacccggctaatttttttatttttagtagagacggggtttcactatattggctaggctggtctccaactcctgacttcaggtgatccacctgcctcggcctcccaaagtgctgggattacaggcatgagcactgcaccctctgttgctttttgagaagatggaagctgaaagaaaccaagtattttgctcactgtgccaaaacgtgtacgtgaccatgatgctgacttggttgattctagagtcactctatctcatgtcagggtagaggatgtataattaatcaaataaaattaacctgaattcaaggtaaaagaaaaaaactaaactgatttccagattgcttttggaggctgagggccttcccaaagactgaagagagtgaagaccattcaataacttttcaactacagtgctgcttaccgaaatggcaaggaacttggagcaaagacaacagagggaatataaaaccaaatccggcaaccattcattaagaatctcggcaaacaggctgggcggagtggctcatgcctgtaatcccagcactttgggaggccaaggtaggcggatcacaaggtcaggagattgagaccatcctaacacggtgaaactccatctctactaaaaaacacaaaaaaattagctgggcatggtggcgggcgcctgtagtcccagctactccggaggcagaggcaggagaatggtgtgaatgcgggaggcagagcttgcagtgagccgagatcgcgccactgcactccagtctgggtgacagagcgagactctgtctcaaaaaacaaacaaacaaacaaacaaaccttggcaaacaaaaggatcctcagccagggaaaaagaatacaattaggctaaagagcagcttccacaagtttgaagaaaacatttacagtcatagttagttgactcaaaataggagccaccttgcagaacagagctgtgactctagcaacaatggagtttcacgttaaggcagtgactgtcatttttccaatctcttctccatccgctaagatatcgtcctaaaatgcaaatatgatgctacttctttcttaaaggatcttttacaacaaatcacaaccagtttttaaagaatttaaaaaatccttccctactccgcctgcttcacttgaaaaaaaaacctttaaaaacatcttttagaaaacttcatctctggcggtctagtggttaggaggaaaaaacctaacagaacctttccagtggctcccagcgacctcaggatgaagtctaaatagctcagtgtgacttaaggccctgcctctgccatatgaggcgtgaggctgttctctcccacagcccagcctgagcctctggctgacatggctcactcactctgaccagccctctggcacaaggaggctgttccctgtggtgtttgccagctacacacctccatatgagaagagcagggcagaccaagaaatctttatgcagctctgtggtttctgcagtggccttagtactccagatgagaagtggtcttgtgaccctgcacccaggggacactgtgacaataagggacacgtgtccttcattactaagtaactcgttactcagtaatccagcccccatggactcgccacgtgacattctggagttagcgcaggaaatcagcagaagtgacgtaagtgaagtctgagacagacccagtgggcatgtggagccgacacacggcctgcacgtggcctgcaggcccctcatgtgtggaaccgacacacggcacgtccagttttgcacgcggcctgcaggcccctatgctctgctttctgtgctgcagcacttcctgagcaaagacctccccggccaggccaatcaccctcaatgcgtcctcgtggcacctgcgtcacatttaccatcactttcatttcacatttatttgtgtgactcttttaatcagtgttttccttgtcccattagactataagaatcatgacaaaaaagcaacatcccccccacctgcacatgttggggctctgaggtagatactaaacaggactgctgacatctgaatggagctttctgctgcaagggtagggggagggcagctggcccgcgctcaggtcagggagtttcaggaggtcaggattagtgcctcagtgaggggtctcattatacctggggttgggaggaggatgggggagggggacttgggagggacaataagtcaaaacactgaggataaacagagtcaacctcagagaagggagctccacacatggagaaggaggctagcacaaacctggcagtactggactagaattggggatgagtgtgaactcctctgtttttgctttttatacataaatagagatgtagatatacgtatgtacatatgtatatttcttggctttatgtgctgagaggacctagaagcaaagacaccaagtgacactgagttcattcacgcagtgcctagatggtggttctaaatgccattcttcactaaagagtcacagctccttggagaaatgcttgacttcaagactagggcaaggaaaatacacgataagcctggaacattatgttacaccccaaagtaaagaagtgcccgaagaattatggcgaattgtcaaaaggacacagaagccaacttaaagggactcccactggctgggtctgggacaatctaagtattaaaataatgaagaaacagatgataaccctttaagtaaaacaaaatgtgccatggtccatagtgatacagataagcaaatgaatagatgaatggaaaataagggaaagctctattctacagccgaataccaactaataaatgcagaaggaatctggtggaatttcagtatcactatttggcaatcatcatagtaataactgattcagataagaatcaccagtcgatgttaaatctagtggataaaagtctgataaggaataggattttacacagtctcaagttagctcccaacttattactaagttcaacataactttacactggagaaacctggcagaaatcatcttaaccaagtgaaaaggttaatataccagtaaggggataaatcaacatcgggtgcctcctgatacaatgaatgcactgacaagagcactacatgatatctgagtattctcatctaaaatgcctaagtcatggagaaacaacacatgaacacaaacggaaggaaattccaccaaataactggcctacagtcttcaaaactgttaaggtcataaaagacaaggaataacagaggaactattgcagactgaagacatgacaattctagacacctatgatcctagacctagatgaggttaatggagatggtcactttaattaatattatatgaacttcctgatgcacagggttgttctgtggttaaaaagatgaggatccttgaactcaggtaatacacatttaagtatcaagaggtaatgggacactgtgtgtgcaacacatttgcaaatggttcagaaatgttaatattggggtatctgggtaaagggtactatttctgcaacctttatgtaaatttgaaattaaaaacaattaaatttttaaaaatactgtctatgcccgaaatagaagagaaataaattctgggaggataaaacaatgaagttaatggtgaatcaagacaggttcaatcaagacaggctccgcccatgccagaatttcaccatggttccattacttaaatttaaggactatgtactccatgtactcaccgtaacatcagttatcctaacattcaaattcaaattaaaaatatatccaaaaccaaaagaggtcctacttgaccacccacactaacggacaatctacaaccacttttcaaaaaatctgtattttaacatcggaatgtgtttgtatttacacttgaagtatgggcatgtctacactggtaactttttgtgaaaaaaaattagtcattgccctaattctggaacataatactaattttcaaatatagtacaaatggcagatcctgcaggaaaacatttagtatgcagataaagactaagctgtgaaatttaaatactatgtcataccatgatttctttttgatggctaatatgctaaatttattatttctaaaactaaaatcagcaattaaaataatacgtaagacgtggctggcactttacctttgttcttacaaagaatgatttgtcttctgtttcgacaaggtagaacaggaaggtacttttacaagcctctttcacaacacttcttagtttgacgtgcaaattggtgcacacgtctatgattatgtcttcataggaggctgaccgtcctgggaaaggcagatacatctcttgagcagtggcttctccagaaacatcatttagctctttgtcttggaaaatgaattggttgctattcttcatcaccttgttgaattcagcatactcattgagaataagtgaaatatcattccgagattccttcacagtactgttgtatttcagtttgttgaggtggaatgaaacagtgtgatttctttgagaatttctaagatctctattatgactacatctctctctccaagaggaagagctgtccagactgctggctgtgtagcctctcctgggctgcccctgtggtctgggatctgactccacaactgttaccagaagggggcttctgctcctaggtgcaggatgcagaaatggggcctcagagatttttgtcgaagggaaagcaccaatggagatctgggttggtgactcctttggaaagacattggcagaggaggcagaatgctgagaatccccattctttatggtctgttttagtttatgtgcaaaacgcagatactccaggtctaaagtgttctgggtgaggtcgtctgccacctgccaagtgcttgtccaggagctgggcaggccacagtttgcactgaaactcgggtgcctcctcaggccgtgtgaagttctcatggtatctttgagttcttttgttatagagaagttggcgtaagtcctgaggatcccgtggagatctcggatttggacgtaaggcggcacacacttctcttctttctttaccgcagcagtccagtgcccgggagggaggctcgtctccatgcctggaacccagctagagcagccccagtcctcttggttgttgttgtggaagttcaacgacgactcatagccatctgtgggaacatcttttttcctggtgtaactacctcttaaagtataagaatcctccaaatccagtctgggatttctacaatcaccaagcaggtctagatcagaatctccagagagttcatagtgcatgtcggaattcacaccgacctctccatctctgcctagggtttcagaaccagcctcagccctgagcccctccccactgttctcaatttctacgtgctctgtggctattccacaaacagaagtatcaaaggattctgaaacaaaggaggccaaaggctctttactgaggttttccttggtgtctgctgtattttggtagggaccagcacaaagggaggaaaccccgacattcaatagctcctttgtttcacatgttgacacatcttgcagcgtgtggatggctttgcgttcaccttttagagaagatgtggtgttggactgagggccagcagtgcctggacctgtggtttctttatgtaactcagcttcaggctcaccattcttaagcaaactggccattctgcctgctggtatttcctgtgcttgaaacgctggctctgcatttattggtcttacataatgggttaatgtagcattgtctgaggaagaacaaagcgtggggaccactgagcacatgcatccctgtgtagaataagctccatcaaccgaggcagctgtcaaggacttcacctgcagataaatgccttcatctgttttcaaatcaccgggaaagagatggttctgactgcttttagggctagtctgctgttttactgacacattcactataccacttggtgcagttgtggaaaccaatgtgtcagacaaagacttattttcaataacatttctaggaccaaatggaggttcactggactccaagacaagatgttttaagtccaaatttctattctctatactaactggctgcaatggatttcctgattttaccagtttttcaggagaaggactgaagtcacctgtgcatttggcagctgaggcaggctggtttaactccctaccatagcactgcacctttcctgagaaagataaaccctcatcatgctcacttgagacaatttcctcagttactttaccaggaagggttggtctacctgttcttcctggatgatcagttaatattagaggcatttcggcagagacctgcatttgttgtacctgggtaaagttatcttgccccactggatgggtaggaccaacaaaaacattttctttttctgttatgcctaagtcttctgactcacattgggagatttggttgctcttctcacactgtgtaccatgaagttttaaaatgcatggagtcacagcctgatatggtcgtgtctctttaactggtactggaggttcaggactagacgctggtgatacttcttcaattacagaatcaaagggaaaatcagaggtcacattaatttcctctgcaatctcaagggtgcaattttctttagaaagtattaaagtaactggttgtaaattatccccctttctctccttattttctactggttcttctgacactgagggatatactgacacattgtcagcagaactcacttctctgctttctgtgagagccacctcttccggttcacctatttcctcagctacatcctgaagttctaaatttgagaatggggcctcctcaaattgctctatttcaccagctggcatttcttctctgggacttgtaggtggtgatattgttagagctaagtcaatgtcagaatcttcctctgataactctaggctgacctctctactcacagacaggcttgtttgtttgataaatactgaatcaaacgcttccaaattcatattttcagtgtttggaccattcttgtgattcttccttagttctaaagagtcacctgatgtgtggcatcctgacgaaatgcagttaagtgaacactgccttcccaaggtggtagaggctgatgatgagtccacttcaacctgtgtcagttctagaagcccttctgaagataggccgaggagactctgagtctgtgaaaggaaatcctgagtgcatctcacttcttcactgggtgatagatgactagaacttttagctaatgatagtgcctccatgaccattgttttatcagatggtagagagactggaaggggcgtctccttctgtaatgaacacactgctttatcaagtgtctctccacctactgacgaggcacaaaggtacttagtgcccttctgtcctgcaactactagagagggaatgtccctcaggccttgtgttcgtgcattttccgaggtggatacaggatgtctaaggcttgcagcaggtgatacttgcttaatcaactccttcttaaaggttgtaggttcatcagcagtatttacaccttctgtctgtattggtacatgtgcatttttttcaaaggtgagagtaattggttccgggttaatcactgcacaccccatattatcatcctttctttccaaggaagggtgacattcattgtttatggggctgccatgttggataaggtcctgtaaagtacctgtttttgtttgcactgctgcatcaagaatatccactttgttttcaagggtgccgtacacagagctctgacatatcactggctgactgccaggcccatcgtaagtcctggtgaatgtggcttgagtaacagtgccactgtaagaagccactcttgtgctatccagtggctgaacaatttcttcttcactaggaacagaaggtccattagtttgtgtacttccaatacccgaaagcacaagattagaagtctccaatgattcttgtttagcttcttccccagttacctgaaacggccaaagtaaaaaaaaaaaaaaaatcagtcatataaaatgttttttatacgattatatgtacatgtgaagaacagaaaagataaaaattaattttagtttgtgaatgttcttctgaattttctagctaaaagaatatcacagggtacaaatcaagcaagtccctcttttaaaggcagacttaaaataccccccagtgggatttgttttctttaaaaccacacacagaagagagctccaagctttttggaagaaaaataactagaccactgacaatttaaaagactttaaatgcagcctgtttgctacttagcaccgcttaatccagaagtgtagcactagagaaaaagcattcaattttgtttttaataaatgagattaattttttttttttcaagacagcgtcttgctttatcgaacaggctgcagtgcagtggagtgatcttggctcactgcaacctctgcctcccgggtttaagtgactctctgcctcagcctcccgagtagctgggattacaggtacatgccaccatgcccggctaatttttgtatttttagtagagatgaggtttagccacgttggccaggctggtctcaaactcctgacctcaagtgatccacccacctcggcctcccaaagtgctgggattacaggtgtgagccactgtgcccagcctaaaagataatttttaaaaagcaaataacatttttaacatccgttttcaattagaccataagtacaccatcatctgaaactttcccatgaggcaacagagtaaattaattactaccccctgtactcagaatacattgattctagtcaacaaaggcccctcatcccttagctatcttctttgcatgaaactggagattctttctcatttgaatacctcctattgtacatggcaattgaaaactttatcaatgcagtttgcaatcataaactgaactaaaggcactgatttaaacagtagcaagcaggatttaggttaaacattagcagagctatcatctcaggacagttctcataacctcataaacagggtggtatttgttttttgttttatttaaagcctcaagcatggccttgtcgagcatataataaaatgaactgattatacaactgatcacacccctctgcaatgctgggaacaccatgctcacaaactgcgtgccatgtcttgaagcatacatgttggaaatcaggaactgtgttccaaatctcttgttaaaaacatttctgtcttaggtagggcacggcttctcacgcctgtaatctcagaactttgggaggctgtggtgggcggatcactataggccagaagttcgagaccagcctggccaacatggcgaaacctagtctctactaaaaatacaaaaattacccaggagtggtggcatgcacctgtaatcccagctactcgggaggctgaggcagagtcacttgaacccgggaggcggaggctgcagtctcaaaaaaaccaaaccaaacaaactcatttctgactggagcagtggctcacgagactctgtctcaaacaaaacaaaacaaacaaaccaaccaaccatttctggctgggggcagtggctcacgcctgtaatccccagcactttgggaggctgaggcaggtggattgcctaaggttaggagttatagaccagcttggccaacatggtgaaaccctgtctctactaaaaatacaaaaatcagccaggtgtggtggcaggcgcctataatcccagctactagggaggctgaggcaggagaatcagttgaaccagggaggtgaagcttgcagtgagccgagatcgtgccattgtactccagcctgggagacaagagtgagacttctcaaaacaaaacaaaacaaaacaaaacaaaaaaacagagtcaacagtgtggggctgagacaacagagttttaagagaacaaagtattagaaaagtcttgagagtcagtgtccttctgagaactttaatggccctcccaatcatgtggctggtaacgtttagcctcagtcctaaatctcaccatgactgtagtcttagtgaaatgcaaatagtgacaatcttgatatatttctatttcgatatatttttactacaggtaaagtgtaatgcttctaaaataaagtctgacaattcagaaagagtgctcaactcaacacatgactagcagcaacatgcttttggtttctagtgcctatcatgctagaatcctcttcttcacattccagtgtgccaactggtggagggagtgcgatacgcacatgtgtgcctttcaagtacaggcacagcattcaacaagatgacaaaaaaacaaaagcctacgtaagtacatactaaggagattgttaggaatcactgatttgaacagtcaggcttgccaaaatcattgctaaaattagtactgatgatagttaattacatattaccacgacaaatggtattttataagaaactagcatgtatatatgtattaatttaaatctccctgactagactatattttcttattctaaggtggtgattcttaactggattttatgtaattctttgagaataggatggaactgctgaaccccatctttaggggaaaaaaaaagcacatacatagttaacatttaggttttctagactggaatcttggcttgacaattttctatgtgactttaggcaatttctttacttctctatgctttagtctcgtcatctatgtaatggggagattaatagtctttaacttatttgagaatgaactgagttaatatgagtgaagggcttagaactcttactttctggcacacagtgacccagaaatctttaattctcatgatgatgacaatcacttgaagatattcacgggttctatgaggctcacccaaggacctccaagtccccggtgaccccgggtataggaacactgtctactctttcttaagacaggaatcagagatgctgcccaaacccaagcaatattattctagaataaatttgggcggaaaactttaaaaggtaggtaattttgtcaattcatttgcttagaattttgttaacaacttttagatttgctccaggtaaaatttggattatctggcctggttgaatgtcagttgagaacaaggaacaaaacaaagtatattttccatatttacaaatagttatttgcaatgggtcttctttcacaggtctggcattttactattccagcatctgtcttcaaaaataattttaatacaattaattttagtttactttaaggtttatcaaagtatatctaagatttattattgctatatttgatccttaaacaatattctacataagacttgataggtattaagtcacctcttttaaaaattaggcaaagaagcaatttgccccaaattatgctgggctcccagatcatgtggaccctgtgacatttttctactctggtttttttcaatcgggatggcaggtaagctctacctgcagacaattcaaggacacttcatgaaaactaggtttttggtgtaatagttctttacataccttgagaattcactgtcctaaaatttaaaaatgccttgttttgaatgtgattttacatataaacatttttttcttcaaaaataatgccaacatttaatggtattcagctttacatacctcattattgtaagaacagatgaaattctggtcttcttgggtgtctggatcacactctcttgcaaaagtttttttctgttcattttgtacacagagttccaagccttgggtaagtggtgttttaatgaaaggaagcaagcagttaggatcacggaaggatacttcagcagcatgagccctggaaatttcgttagtctccaacagagagtctgcagaacatttttccaaaccaagggactcctcaatttcacggagctcacaagattctaacgtgctatttatagacacatattttgctgggttgctgtgttctacaacctttcgggaagatcgtatgattttgttctgattgctgtaaaacagagctacccacatatgaagtaaaagcttcacttcttccacattatcaggcaaatcagtattccagggcctaagagtttacagaaagaacacatgaaaatcattgaaaatggttattttagttgattaccttatcataagcaagtgcctccaatattccttagtttttgtttttatttttaaaatttacagatatgaaacatgaatgagtaaatatgtagttgacttaacaaataattatccatctaacccactcattttacagagacgggaactgagaatcagaacatgtaattgccttctttcaaatcacaaaacctgtatggcagaaccatgatctgaacatgggtagcacgtgtcttttacaccatacaaattcactctggacacagaatatttattatagaaatggtttcgccaatacccaaatcctcatcaccatgcttttgctaagtctggctgattcatttattttccatttttgtgtctctcttctaataattgagaaagtctgaagataaaatatctctctgggcaattcaacagaactatactattttcagactacagttctgcaaaatatcctgaaacagtaaggggaaatagaaaacatttctggccacctggcaggcaaaaggatggcagatcgctggagtaccataagtcaggggggctgcagagttgggcaatagctaaacaggaagttctaaggaaatgacccttatgagtatatatgaacaggtgtatggaagaaagcctgacagctgtagagtccatatagtcagatgtgaaacagttcattaatagggagctgaatgtcaattcatatagctaatgaatgcttgctaacagtgatggttaccatttattactactactggccagtcactgtgcatctcaatatatgtaacctcaggacacagctacataattaaatgttggccacagactgtcatccaccattgatatcacctgaaaatttgttagaaatgcagaatgtcaggcctctcccaaggagaatgcatcaaaatctgcagttcagtgaaatctctagatgagcagcacacacaattaagaagcactgtccagaagcaagaaacttgcccaggatcacaggaggtaagaaagggaaagaacccgggttcaaatctaggttagtctacactccaaagcctgtgctgttcaccactctgttattactgacttgattccttcttaagggagatctatagaacaatcttatgtgaaactgcttactcctatcaatctgaccaatttaccaagctacagtgatttttaaaatgtttcttctggaattcagtctgtaaagcattatttctaaatctcacactattttacattaagatctcatctaaaaattgaaattcaaaagccacaagggcttacgagggagcattgcaaaatggaaagctattcattaggctaaaattatctttaaaaacttctccacatgagcacagggggaaaaccagcctgttactcttaattgccaggaaacatgtttgcttgatgttattatcaaattactggttttaaacacaacacttctttctccttctccagagtttggcataagtttccccatctcactacattcatctcaacagaaaagtttcatccattttcactaagtttcactcatactcacccatgtaatgctcttactacagttttctccagtgggttgttggtatatttgctgtctaaactgaatgcatattctgtttcacatttgaaagtgatcttaacggagtcatcacagctaagcactatacgagagcaagaagattttttcacacgggcagacggtggtcgatccttgggcttcaccacggggtcgtcaggaggcttttgctgaagcaaaaggccgggctgatgccgaaatggcatgactttccccactggggttgctgcttcagggctttttgtcccattcctgggaaacagagggcttagtatctctctctcctgtagatgtttctttgaatgttctgtaaggagcagggcatatgaatgttccacagaaacagaagagctttggcttgcatctgaagattctagcatttcctcagtaagtgctgactgggctttagcaggggcctgactacaaggaaccaagctttcttcatcttggctaacagttaagtctgatccagaattactcttcctatcagaagatgggttaggtagtaattcacctttttgagttttaactcctctatgatattcatggtcagatgtacctcgcaaagaattttctttagagagcaaaacatcattttgtggcaattcagaggaacagtgaagatttctagcctcagatactggtgtggaagaagtagcagagcttaatgctagatcggctaacatatttagggcctgggagtcatagttgacgatggagttttcaggaagatcattgtgagccgctgtggtattttctggttgaacactatttatgctaatcccatcttcttgaccacctcttgaaatttctgattgaagctttgaagcagtttctcctttgacttcagtataaaagaaaaaaaaaagagagatgtttgcttgtcatagaattaactctctgccatattactatgatggttaattcaacatgtctgagaaaaacttatgtaacatatattgcatattaaaattttctattagattaaggtctcttccaaccctcagataaaacttatgttatacatattgcatattaaaattttctattggattaaggtctctttcaaccctcagattataatgtgttaaaccagagggacaagtcttaaggaatgtgtacattaatttagaaagaaattatccttcaaaaacatatgaactgatctacacagaagacatacagctcagctcaaaaaatgtacaaacaaaaaaacccaaaaaagatgagagtcctgcccttgggagcttacaatctaataaggacaggaatgtagaagtttcaagtgtgtatgagtttgctaacatactttctcaggaaccatttccctgaacaagcgatttattagagaaactacctaagttcaaatgattttaactatattgatctttaattacatgatgtgatagaaataaaaaattagaaaagtcctaagagtattcagaatcatcaattaattccattaccttttaaaattttactttcattaccaaaaacattgaccttttacattatccaagaaagagcaaatctactgacaatgttcccttttacagataatcaaatctatccatatgcccttaatcagaacatttacatttgccagtggtttcccttggtattttcaacgtattcattattccttcctaaatgctgttattatgaaggataaacttcacaactctgctaaggcaatgattccctgctgcaggtagacagatgaccagaaaagccaactatgttcctctttatcatagtagcaggtccaaaatgaattaacaacctgccagccaaggccaatgagtaacacatttaaagagaagacagctccagcctatgatgtcatcaattagaacgacaagggcatgcacatacatggggaaagggttaaactgatcaacgactgcccagtttttatttaaaacagcaaactcaaaggggacaggtggatgaaaaggacccaaagcagataattgtcttgttagtcccacaggtatactggaaacataaaattaattttgtgatctgatgctaatttcattctttgttaatattatggcctccatctacttatcccttacacaaaatattacttaccagtaaggcctaatataaaagatactgtattaaaataaagaaaaatggtagtttaacatattatagtctcacataaatcacccagttattaacgtgttacaggttcccaattaaaaaaacaccacccataatttctatttaagacatacataagacaatgccaaaggaactacattaaaaaaaagttcagtgaataaaaaggacagaaaatcatgtttcattaacaaaaggactgtctgacttcaaaattatcatttgattctaatttaaatcagtaatttgcaaactgaggtcaatgtggctatgtttcatctgccttcttaaacgttgatattttaagtataagaagtaaaatgattaacataggtgcttaagaaaaaaattcagagatttaaatgtagtcattcaaaaatgttaacttggaatgtggctgcacaatacctacagacatttgcaatacaaatcagcctgtatttgaacacacattttgaaactttaaattttctgggctcacttttctgccagtatgcaattatatacctcctcgcattaatcaatttgtcaataaacatctgaagccaattcagtacaaagaatgcaaatgacactgctaggaacacaagatgttacctattctcatgtttacaaattggaaagattggaccaagacatgtcagatgaattgaaaacagtatgaattaaattatagaatgttctcaaatatcccaaagaagtgagagattagttacagtcacaacatgagaaaacgcctccctgtggggataaatctagctgcaggcccctgaagggcagaggttgcctgggggaggcacagagggccgcaggggaaggagcacggtggcaacagcagaggcacaacgcagagaggggaggtgcagccacaccataaactcccgagagggacaagcagaagagctcaaatctggtatggaagccaaaactgcagcatatgggtttttgaatgacatgatgagcttttaaaaaaatcttcagtcataaaacaatctgaaaaaacttaaagaatctcagggtatgcttaagttgaaaaaaaaaacaaaaaaactaaaaaaaacaaacctggctgggcgtggtggctcacacctgtaatcccagcactttgggaggccgaggcaggcagagcatgaggtcaagaggtcaagaagttgagactatcctggccaaaatggttaaaccccatctctactaaaaatacaaaaattagccaggcgtggtggcatgcacctgtagtcctagctactcgggagactgaggcaggaaaactgcttgaacctgggaggcagaggttgcagtgagccgagatcgtgctactgcactccagcctggtgacagagtgagattctacctcaaaacaaaacaaaacaaaacaacaatccaatttctttctctgaattctcactctctgtgagatagtaacatctagtaatagatgagggagaaagtagaatcaggaaaaccagacagaaaactcatagaaagataggagagaatgaagtctctccgttaaacaaaacaaaaaaaatacacacacaccacaaaaaaatcaataccaaagggaaaaaaaattaaggaaagtagatccaggaggaaagctggtatttgtctcactaaggtgacaacaaaactttctagtacagaggttatatctagcagttgaaaatacaaaactggagcagttcatgtgactaaacttgattctttacttaagcaaagttaaatcagtaaaactacttttaaaattaatgccttttaaaaccaaatacaggattctcagccaggcatggtagctcatgcctgtaatcctaacactttgggaggctgagccaggcaggatcacttgagctcaggagttcaagaccagcctaggcaacatggtgaaaccccgtctctctctctttttttttttctgagacggagtctcgctctgtcgcccagactggagtgcagtggcgcgatctcggctcaccacaacctctgccccccaggttcaagcgattctcctgcctcagcctcccgagtagctgggattacaggcatgtgccaccacgcctggctaattttgtatttttagtagagacagggtttctccatgttggtcaggctggtctggaactcctgacctcaagatccacccacctcggcctcacaaagtgctgggattacaggcgtgagacaccgcgcctggccaaaacctggtctctgtaaaaaaatacaaaaaaattagctgagcatggtggtacgtgcttgtagtcccagctatttgagggggctgaggtgggaggagcccttgagcccaggaggtcaaggttgcagtgattgtaaagtgagaccctgtctctaaataaataaaactaaatacaggattctggattactgacagttttggacagtctgtttataattccctttagataaacttataatcttctatttttataattgataatggtctagaaaaataatgccagatactacttgcttctgcatttagtcataaataaggccatttatactttaatgcttgtagacaattcatgttcaggctttttgcaaagtaaaaagtaggctctatgtttttgaaggtttgagcttttgtaccttcctaatttatttacattaggaaaccagtttacttagtttttttaatgtctgaactgaaaaacacagaaaaaattattgggacattgcaactgctcttacactatttcaataaattatcttgcactctctgttagatctgtattggggtgtttaaatttataggaagagtatttcttaccaggttgtagctgctttctgtttctggggttctcattgccttttactatatttactctctgtttttgtggagatttcttcacaggtggcttagcccttggaacagttttgactggagatttctcttgtttccttgcccttttagcatttgttggcactggaacatctttagaaataggagcttcttggtttttcctatccaatttggttttctgtacaaactgtgcagtcagcacttccgcaccttatgtagaaaagacatcatttttgtaaggggtaggggcccagatacttagcatagcttttccattttttgttttgttttgtttttattttggggacagtaactttagtaatggggaataaactatgaagtttcaggtatttaattaaaagattttaacaaatcaaaagttaaacattctcacataaatataatatgaacttgctaagtgtctgcctatatccctatcagatgaagaagaaaaagatcagagtaataactttgtaacaactgaaaaaaaaagaaaaacaaacaaacaaacaaaactttgggctgggagtggtggctcacacttgtaatcccagtatgttggggggccatgacggacggactgcttgagcccaggagtaggagaccaacctgggcaacatggcaagacactgtacaaaaaaataaacaaattagcaaggagtggtggcatgtgcccatagtcccagctattcgagaggctggggtgggaggataactggagcccacaccactgtactccaggctgggcaagagtgagaccctgtctcaaaaaaaaaaaaaaaaaaaaaaaaaaatcttcataacctttcctgactaatgtgacaggtaagactgaatatgctagatcacagccccaggatatagatatttctgtttaaacaaacagcagcacagcttccataaggtgaagtggttaaaactataaccacactgcagagaagagttgtatagacagcaatatatttggagagccatattatatattttacgttactacttgtaaacatctaaattttaataccatctgaaaaacaatcttttaaaagatgggaagcctgaggaaagtgtgcacctggttttatttctaacaaatctgctatcttacacaatgatgactcttagaagcgctctgggaagcctgaggaaagtgtgcacctggttttatttctaacaaatctactatcttacacaatggtgtctcttagaagcgctctgctttgcttctcacatggcataaaaatagctaaaggtggagctaaaggatgggaagaaaaaggaaatactaaacacctgcttataatgcacaacagaaagtgtttcaatcttttaagagttaaaattaagcctcaaagatatcatatgaaataatcacacatttaatgttggcaaatatttttaaattacattatacagaagacgctacttctcactaaggacactaaaaatgatattaaacagtttaagaaactgatcagtgttagtgaaatgtaggagaaaaaaggagacccatttcatttcattcttttgggggttagcgaaaggaatagttttaaaaatgttttcagaatatcttaatgctgtacatttcaagtctgattatcttcctccctaccaaattattatattaataagtactaaagcagcgtatttttttttaacaataagacttcttattacactctaattacattttctaaaatcttcagcatagggaagagcaaaataaaaataaatcaggaaaacagttaagactaaattaaaaagaaaaagattagacaaccaagacccagggggaaactttctaatatttgtacaaacagaaaaggaagatattcccaagtactcccaggtgttgggagaaaaaagaaaaatgaaacaaagtgatcctgcatagattgttttgtttacatgtaacattcaataccatgcttctcaaactgaatgcaattaatccactggtgggttgtaaaataaattcaatgtgtcacaactagaattctttctttttttttgagatgcagtcttgctctgtcacccaggctggagtgcagtgcagctcactgcaacctctccctcccaggttcaagagattctcgtgtctcagcctcccaagttgctgggattacaggcaagtgcccccatacctggctattttttgtgtttttagtagagacggggtttcaccatgttggccaggcaggtctcgaactcctggcctcaagtgatccacccgcctcagcctcccaaagtgttaggattataggcatgagccaccacacccagcccagaactcttaaatgaaacagaatagaaggtatcagactgtattacacataatttttttttgaaatttttgttccagtcatgtatgaacttgtaggtaccggaatataatatcaaacatatttcttacagtggatataattaaaaacatctgagaaacagtgacaatttatgttgagttatagataactgattcaataccttaaattggttcatgcagaacagtatggttggcctggaatctgttttacagatagttgtatagtctggtgcactgctttatactaccatactttccacttaccctcctaagtacgcacatctccaccccgttcctcaagccacaataagccagaaaccactatttatgaagccacaggataaaaccaaggttgggtacagtggctgacgcctgtaatcccaacactttgggaggctgaggcaggagcatcagttcaaagtctagcttgggaaacatagcaagacgtcatctctacaaaaaaattttaaaaattagtggggcacccctgtagttccagctactccagaggctgaggcaggaagatcacttgagcccaggagtttgagactgcagtgagctatgatcatgtcactcaactccagcctggctgacagagagatcctgtttctaaacaaaaacagaaaactccaaacaaaaaaaactccatagggtaaactctgaattatttagaatcctgggattaccataccctagacgtttcttctttaggcaccaacatttccaaattcaaaatattacagattggcttggcaaacttttctgtgaggggccatagagtacatactttcagctttgaaggtcatgtggcttctgtcacagctgctcagctctgccaacacggcatgagagcagccagagacgacacaggcacaaccgagtggccccttggccataatgtgctgccttcttctccaaaggagtcacccatatacttccctactcttttagagaaaatagagtaaaacacaatttgagatgactctaaaccaaagtcatatgatttgctgtcctatgttcactgaaatacatttgccaatacattaagtggctaggccaaagtcatatggtttgctgtgctatgttcactgaaatacatctgccaatacactaagtagctcaagactctaattctcactcaatttttcagggagcatcaaaaccacacgaataatccaggtgctcacgtaaaaactctgtgatacacataaaggattagaaactctgccccagactattttacttttggaggtcccaggcatttccctcctctcgataggtgttgaggctgtcagctatcacggtttgctggtactgatgtgcctgattttagaagaaccttttctacctccatttgtgaagaggatggcacagaaactagatggttgtctttcttagaatggaacatacacgtgtgggtggttttacatgtggaacataacatgttggtggtgggtaggcttttgaggtatcttggtctttcctatttcttggttttcagttgctatctcaatcagagcttgtcaggcattaggaggcacacaaattgcctggagagaaatgatggtgattctaacaatcttctaactgatgctgcaaagctgcagtccacagggaccaagacagcagagggatcgaatacaacaactattattattattgagatggagatttgctcgtcacccaggcgggagcgcaatggcgtgatctcggctcactgcaacctctgtctcttgggttcaaatgattcttgtgcctcaaccttccgagtagctaggactacaggcacgcaccgccacacccaactaattttgtatttttagtagagacagggtgtcaccgtattggtcagactggtctcaaactcctgaccttaggtgatccacccacttggtttcccaaagtgctgggattacaggcatgagccaccaacgcctggccacaactattattataataacccacataaataaatcgtgcttacctctttttcttttctgaggaaactgtcctttaactaacttaagagttgttggagagtccgagctgttgtctgctctggaagcagttcttttgggaaaggggcggcacaagttcacctttttactctgcaccatgtggggcatgctggccttcctcttaggctgcactctcagatttgacgctggactcaatggaaaaactctcttctttgctttcaacatttcttcagaatccttttttgtttcagtttcttttctcacttctgcctctgagacaagaaattcaggatctggagtcataactaaggaaaatccagcatcacaaattccgtctgaaacacaaggagactgaggatgctctgctagcaagtccaaagcagtagacacttccaaaatgtaagcactagggtctgaaaaataagagttcaactgagttaaagactctgaagggcacttttcagctggaggaatcaagtcaaaaccactgggcagtttccccaagaatgtagggtctttcattctatcctgaggagcaacactcaatgaagggcttctgtccgccttgtacaattcttggaaatgacgctttactaatgtgtttggatggattctttcttcaggaagtgatttctttgtttctagcagggcacaattaagggtagataaaataggtatcaccttcattgagatgtcatcttcaactttcaaatctttcacccctagaatatatacacacgtattaaacatctgaagtttattttttaaaaacaaaacattctggaaaaaaaagctttagatttcaaaattatgtgatggttaaatatgttatagtatttcaaatgacaacctaaatggcaattaatagaagacttagaggtacatttaacaaatgtatctccatatacttgaaattacatacacacacacactgaactgaaaaagaatcatctgacatgcaatcactaggttagaacaagtaaactaaaccctgcctccagctccatctcacctaacaaggagctcatgagctcaatggttcatcacagcagtaccactggtctttagagctggcagatttgctttcgtactttttcttattttgttttaaaatttattttactgtagctgtaccttactgaactcacttcaaattcttttcagaagttagtgcaagtcaactgaactgaaaaaagtagaagccctaaataatgctggaatctcactggaatgattattgctaactttatcaccttttctagcaaatgaaataaaaacttctaaaactgactagtctatgtttcacctcctctcctgctttgactgaagtgctaatttttccttttttttgaaaatgaataaaggaaacagtaaaagggaaaaaaaaagagaaaaggtctggtccctatgaactgggtaataaaatcctataaaatttcagagttgtcagtaatataaagccacaagaaacaacagccttcagggcctagtaagtgaaaataaaaattgtaccattctttttaaagaaaagtaacttcagaatgaaacacaaagttagttctagttaaatacattagcactaaagcagttattagaaaaaggaaatgaaggacaaataacagtaaaaaggaaaatgtggccagatatcaaaataaaaatttttgtattttttgtagacatgggatttgtcatgttgctcaggctggtcttgaacgagtgggctcaagtgatctacctgcctcagcctcctggagtgctgggattacaggcgtgagccaccactccgggcacaacgtttttataaaccaaattgttttaaagttattgcgctggtctttttgttgttttgttttgttttgttttaactcagagtcttgctctgtcacccaggctggagtgcagtggtgtgatctcatctcactgcaacctccgcctcctgggttcaagcaattctgtgtctcagtctcccgagtagctggaattatatgcatgtgccaccacacctaactaatttttgtatttttagtagagatggggtttcaccatgttggccaggctagtctccaactcctggcctcaagtgatccgcccgccttggcctcccaaagtgctgggattacaggcgtgagccactatgcccggccactctttttcttcttcacctgatacaaatataggcaaaaagttagcaagttcatatcatatttatgtgagaattttaaacttgcgctttgttaaaatcttttaatgaaatacctgaaactttatagtttacaactaaaaaacaaaaataaaataaaatgaaattagaaatcttacaggagccagatctgaagttagctgttagaccctgaacaagttcaactctgagtttcttcatctttgaaatcgttataggagtacttattttatggattgctaagtccattacttccaccacaaaacctgacatgataaatgcttgaaaaatgcaaacggtcgctgccaattatgttattatcatgggtaatgttttgcttattccaaagatgtgatgcctaggaaagcacagcgttctgcttcaagtaactgaattgttttgtttttttttttaatttttttgagacagaatctccctctgtcaccaggctcactgtaatctctgcctcccgggttccaatgattcccctgcctcagcctcctgagtagctggaactagaggcacataccaccaagcccagctaattttttgtattttagtagagacggggtttcaccatgttggccaggatggtcttgatctcctgacctcgtgatccacccgcctcagcctcccaaagtgctgggattacaggcgtgagccaccctgcctagccagtaactgaatttttttaaaaaactttaaaaacatgtttatattggttatagctttataaatactatatagagttttatgtttaaacacacacattgtgattatacaacaaagtgacttttttttttttttttgaaacagggtctcactctgttgcccaggctggagggcagtgacacagtcttggctcgctgcaacctccacgtctcgggctcaagcgatcctcccacctgagcctcccaaggagattggaccacaggtgcaagccaccacgcctaatttttctctattttttgtagaaacagggtctcaacatgttgcctaggctggtctcagaactcctgaactcaagaaatctacctgcctcggcctcccagagtgctgggattacaggtgtgagctgccgtgactggtcaactctcatttatttatttgtttagcaaatatttattattttataggtgcctggcattgctaggcactagggatatagtagaatacaagaagggtaggcattaaataattatacaaataaatatttaaactatatgaatgataaataagcataggagtctaaggtgagcaaagagtgttgacgggaacaaagaaagtgatagtgaagccgagtttgacagataggaggaagaataagctagattagtgtttctcaatctttttagtcatcctccttcccagcccttttagagtcatttttcccccatattgacctccaaaattttaataccagatatacactgcatatctgtttatgcactgtatgagtaattttttttgcccccaggagccaaattttggtcctctgggtggatcaacatcacaataaaaatgtatgggcttgatatgaaaaggactaacagataaggtccagataaggagaacagcacctatgaagactctgagacatatttacaggagagacgatggcaaaatttaataataaatgaattcagttttagacatgctgaatttaaggcacctttgagatatctcagtggcaatgtcagtagacaagtggagatatgggactgaggctcagagggaagcataaacctacaagggaggtcaagaagggtgaaccagtgatgttaagaaaagaggtatttaagaggaaaaaacagtcaacagtgtcacgtgctgctgagaggtcaagtcagatgaggactaaatatatccaacagacagagtgagctggaaaccattgtatcctcacctgttgacaggggtgaacgaaataaatgtaacccatgcagacccatctgcttgcctccaaaatctatgcagaatgagaatcagaagaagaaaagttaggttgttgatcttataaagcaaaagtaaacataatgaaaaatattttttcccaaaacagttctccatacctggttctgatagtaaggctgatgatgtaagtaaaatgaaaaaccctcgatcttctaagcatttgatgattgccttaaataaaaaggaaaaattcaactgaaggaatattctgcaatccctctcttctccctctacccatactcattagtgaatattgacctcaagaaaagaaaaaattctgcaaatgttatgggaatcagggtaattctgtccccagtatcagaaacttcaagttccttagctgaaataatcttggccctgttgggtctatataaaataaccagaacatgaaaggttagttttagaacagtgctcaagaacatggcagatcaatcagaaaagacttatttttttcactgagacagctgacatttcataccactgcctaaacagccaatatgttaccatgtagtcattataaactcaagatgaatcaaacctataagtagcatcttaagctcatatttacatgaaaattatcccaaaacgctgaatctaaaaagactgcaagataccatccaatagaatacttctttctatgcatcttaagaaatggaaaataacagaaaataatcaagttccagggcaacaagaaatacagatgaaaataaattcttcctctcttttgttcccctctattagagtcttcagtggactcttgagctcaagaaaaaagtcttgaaattttaatgctttcagtaactggggcagttttgtccccaggcagcagaagttgtctaaaagctgttgttctaaatcatgaatttaatagtttttcttttccactgcttaccatttcaaaaatctatatacacataaaagataaaatccaatattagtacaataatttttcagttaaaccacctaaataaaatataccattttacagaacattttatttcaaaactgagaggtgataaggctacaaatataaatcaatatattatttaatcacaatgaatatacaaaataagactttttaaattattacattacaattaaggtatgacactaatatctcactctcaaaaagaatcactgctttgagtttcaacaagattctatgagagcccctatgtgttgtatgtcacatgatgacttacatatttgtctcctccatagtctcctaagctccttgacttacaggagctatgatttaagagcctatttctttaagagacagggtatcactctgttacccagcctgcagcacagtggcacagtaacagctcactgcatccttgaactcccaggctcaagctatcctcccacctcagccttcggagtagccaggactacaggtgcaggccattatgcctggctagtttaaaaaaaaaagttttttaattttggtagagataagatcttgctatgttgcccaggctggtctcaaactcctggccttaagcgatcctcccaccttggcctcccaaagtaatgggattacagatgtgttccaccatgccagactttagggactacactactttgtatccttgcttcttgcccctcctgcccagtatgtgaatcaatctttttttttttttttttttttttttgagatggagtcttgctctatcgcccaggctggagtgcagctgcgcgatctaggctcactgcaagctccgcctcctgggttcatgccattctcctgcctcagcctcccaagtagctgggactacaggcgcccatcaccacacccagataattttttagtacagacagggtttcaccatgttagtcaggatggtctcgatctcctgacctcgtgatccgcccgccttggtctcccaaagtgctgggattacaggcgtgaaccaccacgcctggccgtgaatcatccctttgtccagtgtatctatgctgtagatgctacccaccctctggggcaatagtagtacttcataatgcctgcaccacctacctcattcatcacaaggagtactcaagtatagcataataaataaaatattttgagatggacagtccacactcacataacttttcttacagtatattgttgtaactattccattttattattgttgttaatctcttactgtgcctaatttataaattaaactttatcataagtatgcatgtatagaaaaaaacacagtatacatagggttcagtactatccacagtttcaggcatccactgggggtcttggaacatataccccacagatactgtattacattaataatatataaataaatattaaacatgaaactcctttcagcacaactaatatatatctatatcgatctatatctatatatctatatctatatctatctatctatctatatatatatatataatatatatatatgtgccatctaggcacaactaatatatatcaattaaagaaaaacataataattatattttaaattagtgatgcttaccaattgcttgtttttaatacattctgttaatttatctatattttccccttgtctgtttgacagttctacctcatacaaattgaagcacaaatcttgaaaacagactgtagagaaaaccagaaaaacatttcttatttttaatacgctattatgtacttatagtcaatttgttcattttatatgttgcaaaaatgaaagaatagaaatactactcagaaacctttatcatttactgttcttggttataaaactccctcataaaacatcaccaaaatagttattttaaaacaatgctcttatttatactgacactgctataggattaacaagacaaatacaaatacatactacatgaataaacatcagtgctccatgaattaacctaaatgaccaagaaatttccttctcatggtttttctttgagtttaaaagtacctctataaataaaaccaacaaaaactctgtcctcgagaggaatagttacaagtttccaaatgcttttaatatctgcttgcttaattgcatcagtatttctatattaaagctagcctttgtcatcttagatgaaactacctttcagtttctagttggcctccaaggaactgaagaaaatagtaactctacagctttcttacaaaagactcttttaagagtcacttatgatgaaacagaagtgtgcatgtgtgagtgtttggaagagagcagaaaataaccagaacaaagcccaggacaagtagcgtgttattacatttcaacagacctttctcctccaagtaattctgttttctgaaggcagcctctggtagtctttttttcaaggaagacactttcattacatatttaaaatctagttcctgcggtctgaaaaacaacacaacagtatcaagcagaataataaacagtggatctaaattttcttaagttttggttttctaatataaatgtaaacaaaaatataaccacaaaaaagaccttaagttgataagctccaggttaaataatatgtgtatttttaagtagtacagattttcaaatatatgacccataaaccatggtctgcaaatatgttcacatcttctcaatacatgtattttcagtacagacaaagtatctagatgtgtcaaaaaaattatgtatacaggaataaggaattaaaaaaaattatgctatttatgagttatttgccaggcacggtggctcacgcctgtaatcccagcaactttgggaggctgaggcgggtggatcagaaggtcaggagatggagaccatcctggctaactcggtgaaaccccgtctctactaaaaatacaaaaaattagccggatgtggtggtgggcgcctgtagtcccacccagctactcgggaggctgaggcaggagaatggcgtgaacccaggaggtggagcttgcagtgagctgagattgtgccgctgcactctagcctgggcgacagagcgagactccgtctcaaaaaaaaaaaaaaaaaaaaaaaaaagttatttcctgactactttttcctttttttgtgtgtgagatggagtctggctctgtcacccaggctggagtgcagtggtgcgatctcagctcactgcaacctctgactcccgggttcaagtgattaccctgcctcagcctcccgaatagctgggattacaagcatgccgcaccacgcccagctaatttttgtattttcagtggagacagcgtttcaccgtattggccaggctggtttccaactcctgacctcaggcaatctgctcacctcggcctcccaaagtgctgggactacaggtgtaagccactgtgcccggcactctgtttcctttttaaaaactcattttaaaatgcttttacacttatacaaaagttgcaaacataggacaaagaactctttaatacccttcatccagatttcccaaatattaacagtataccatgtttgctttgtcattctctctctctatacacacgcattatttttttctgaaccttttgggagtaagatgcaaacctgatgcccttttatgtcacatacctctctgtgtgattcctttaaacaggaaattttttcttttctttttttgagataaggtttcactctgtcgcccaggctggagtgtagtggcgcgatctcagctcaatgcaacctccacctcccaggttcaagtgattctcctgcctcagcgtccccagtagctaggatcacaggcacgtgccaccacgcccggctaattttttgtatttttattagggagagggtttcgccatgttgcccaggttggtctcaaactcctggactcaagcaatcctcctgccttggcctcccaaagtgctagcattacagacaggagccactgtgcctggcccctagcaaattttcttatacaaccccaaagcaataagcaaaatcaacacattcacaatgataacgatactatgacttaacctacatcttattcaaatgctgccaaccgtctcactaagttccttcacaaaaaaagaaaacaatttccaatccaagatgccacaatgcattcagtaatcacgtctctttagtctcctttaatctggaacagtttttcagtcttttctttacttcaatgactagggtattttgaaaaatatagacgattttgcagaatgctcctgaatcaggataggtctatcattaacttaactgctgagttaagatggtatctgccagtttactccactggtaagtctgcattgtttcctttgtgattaataagcaagtagtggggaaatgttgtaagatatgcaaatactattaaactttcacctgtttttagcacacactggttgattattatggtgttgtcaaatgctgatcttctaatttatcaatctttccacatttattagttgcactctataatgaggaagaactttcccttctctatttgcttattcacataatttttatgttgtgggttattatactcctacctcttcttaaaaaaggccgataggaaaaaaaaaaatgaatcctcacaacacatcagttttcaccttataattcaattaaactatgactatttcttaatggttttgggtacaaactaagaacaggatgaaccaaaaagatttcctaagatgttcttcacagttccccaggagaaaatattaatcatgataattgcttttaatgtaaatacatgtaacagctattctaacatttttctaagaaaatcatgttaaaatttgaaaatcagatactgcaaatgttaataaaaataatacgattaagtggctataatctgctatatttgctatcaggcaaatctgatttatttcttggggaaggtcaaatttctagtatctaatagtttaatttatcccaagaggtcattttcccattaataaattagaatttaggtttactatgtcataccctgtgtgctatacatttacccaaatataccctcatctaaaatcaagaacagttgctgtattttacaccaatgccacccttgaaatgaggtgaggaaaaaaaaccccaaaacttgtaatataagcattagtaaaggacataacatttaatacttacagctgtgttggaatcattgcaccgtaagtggaccaaagagctatatcacatagcatacggtcttgaacaattaatttccctttccatggagacatgagaactgaagaaatgaaggtaaaaaagaaactgattatttatgatgaaacatttactcaagaaaaaaaaaacctaaaagaatcaatgaactatttcttaccattttcactgcgttcaagtctagcagaaaaagaaagaaaaagaacatgtttacaagagtaaaaggaacaaattcagtaaaacaaagcatgcacataattacttacatgcttttatgagctggtggtgccatagttttagattccctgtatcgaaaagctacaattacataaggacagatctgtctgggtcgttcaataacggtgttgcctgaaagttcgtaaaagtaatactgaaagaggaaaaataagtattatcagggtagcactatggaactgcatatgtaccaagtttttctcaaccccaccgagccctgaaatttaacacattagactcagaaatatatcttgggtgttactcattcacaggtaactatacctgactcagttcaaaggcacgaaaatgactcgtcttgttagaaaccttgttagtattttcagacacgtggcaatcatagccagaagatggcttagtatagttagttgtataattctcagacacaaacttgacttttccctagaatgaaaatattaaaactaatcagatgccttcgaatagcaataacctttactctaggattcatttagaagtagtctaacaaggatgcagatatgtgtcccctaacagtaactgtattaagaactatacttcttagaaaaacaattatcttaaggccaaaaatagttttgattatccatgaacccttaaaaatggactcaaaaattttggacatttgggcgtctgagacaaatatccatagtttttatcacaatatcaaagaaatatacgaatcaccctaaatttaagagagccatttccttaaaagaaaaactatagcccaccatcttttatgttacggtcactgaatggctctttggtgactgtaatgtaaaagaggacaaaatctaaaatttcaaaagatgagtttccaatctgaactatgatcagttgtaaattataaactgagatacttctattatgacagggcccagcaagttaacaaggagcaaatatgtagcaaagttcttagcaggcagctggtcctggttgctgaacagtcagcagtattttccattacagagttctctccatcaagggttacatgtctctccaaaaaaaaagaaaaaagcaagcagctgggcacagtggctcacaactgtaacccagcactttgggaggccgaggcgggcagatcatgagatcaagagatcaagaccatcctggccaacatggtgaaaccctgcctttactaaaaatacaaaaaaattagctgggtgtggtagcgcgcgcctgtagtcccagccacttgggaggctgaggtaggaaaattgcttgaacccgggaggtggaggttgcagtgagctgagattgtgtcactacactccagcctggcaacagagcaagactctgtctcaaaaaacaaacaaacaaaaaaataaaaagcaagtaagccaagtttaccattatgatgaaatatgcaatgattttaaaagctgttttgaataatacaatgacataagacaatgttcacaagatgttattaacttatatcaaaatgggatatgggactataggcaattttaatttttataagaagaatatagttactttttaaaaaagaagatgttttgttgttgtttaagtcctgcctcttcatttacagacccaccaaaggccaaaccaccaagccaaaaaatgtaaatagtacttatcagtaaccaatcatctctaccatctcctcatcaaacattttatggttctgggtgcggctcgattttgtgaaataaaatgaagattgagagcacagaggccaaaacagcaatctccagctagtggcaagaaatcaaggctgaggcataatctaagtaaaaaacgaaatgcttattatctgcattagtaggcatactttctgcagcactcatcgcagagcaagaaaagaaagattaagggaggaaaactagtgattgtacctcaaagcaatgttactcccccaccacttttttttttttttttgagacagagttttttgttcttgttacccaggatggagtgcagtggcgtgatcttggctcactgcaacctccgccttccaggttcaagtgattctcctgcctcagcctcccaagtagctgggattacaggcacccgccaccacgtcaggctaatttttttatacttttagtataaaaagtggagacagggtttcgccatgttggctaggctggtctcaaactcctgatctcaggtgatccacctgcctcggcctcccaaagtgctgggattacaggcatgagccacagagcctggcctctccctccgcttttttgagaacaaactttacaatattaagaattcacaggctcttgtttttttttttttttaattaaaggtcatttagtgctaggctgataaccaaagaatttaagatagtaacaaagctaaaaaaaaaaacaataaaacgagaccacagaaatgtcctcaagaagcccaatcacatctaaaatcagtttcccttctgtttgggtgaaaattctaattgcacgattcacttaacagtaccatttaggacatttaaggatttgtggcatcatcagttctaggtagcacatgaagctgtgaagctggatgtcttatggagaaagaaaataaagattctattgaccatttaaattagacaatgaatgttgttttctaaattcatcttttataagtgtaatcacatcaccttataagcagctacttgttttctcttatttcatatttaaaaagtagctctgacaggtgagaggaagatttttccctgcatacccttttattatttttgaagttaaaaaaaagtttacaatctagtaaatgaatcaaagttttctttttaaagaaaaggaaaaatagttttgcttttcctgaatttggatagctaactttggtgagaactatgttcaactaatatctacagagaatatcaaaggtagataaccttaaactttaaaaggaaatcacgtaacagcacatttaagctttaccttaattatattaaaaattacaacataaccagatttcccatgataccatggtcttgaatgaagacagtcggagtatttggaaatgtatacacctgtaaaagtataaaatatagattaagcagcagattgcccatcagacaggagaaagtagaagcaagaagaccaattagaaagaaagctactgtgatagttgagacaggagaggaggattccaacaaggcagcagcagtgaaaaacgaggaagaaaggacaggcttcagggctattcctcaactgaggcaactctttcgaaacataagagacaatgagtgagaaaactgatacagtggaagagagcgctaattctgtggtcagaagcttgggttccaggtaagaataagtcactcaggtagggagggtgggcctgggtcacagacacaaagaccacagggtgctcatgaagatataaaagatcaataagctttaaaaactattattaattgaaagtattattatacacaaaattatccagttctagtcaagccaaaaattacaaaagacatacaagtagtagtgttaattttactatcaaccccagtgtatgtgtttttgaagaatgtgtatttgtcaggaaaaatccagtttctacttccaccactctactgaagccagcctctcaaacatcagcaatgaaatcgtaagattgtagcaatgtaggaaaacgtcttttttttttttttttgagatgtaagctgcagtggttatttgtaatttactttcagattctccagaaaaaaaattaaacaaatgaagcaaataatgcaatgtgtatgtttatatttatatatatatatatttatatttatatacatttatatttagagacagtctcgctctgttgatctcggctcactgcaacctctgcctcccaagttcaagcaactctcgagtcttggccacctgagtagctgggattacaggtgcatgccaccatgcctggctaatttttgtatttttagtagagacggggtttggccatgttggtcaggctggtctggaactcctggcctcaagggatacacctgccgtggcctccaaaagagctacgattacaggcatgagccaccgtacccagccaataatgtataatattatctgctaaacttcggtggtaggtatattatggtatgctctttacttttatgtctgaatttttcataatgaaatgagggtggggtgaaaaaataggagagaagaaaaaaagctgtatgcagtgttatcagcgttatgaatttatcacttttaacgtcccttagaagatgagttgaatgtaaactttaaatttttttgttttatagttatcatatgacccagtggttccactcattatatatcgaagatatatataattatgtccacccaaaaacttgtacatgtatgttcataggaccattattcataatagcccaaaagtagaaataacccgtatgtccatgaattgatgaatggataaagaaaatatggtatggccacataacagaatacaccattgtataatataacattttggtcaacaacagactgcataaagtttggacagtgatcccataagtttgtaataccatatttttactgtactttttctgttttgatacacaaacacacaccactattttataactgcctgaagtattccgtacagtaacctgctgtacaggtttgtagcctaggggcaataggctacaccatacagcctaggtgtgtagtaggctatgccctctaggtgtctctaagtacgctctgtgatgttcacatgagtaaaaaattgcggccaggcagggtagctcacacctg

SEQ ID NO: 11955 - DNA, 50595 bp, Human
agaataacccaatgatccttggatgtcttacctacatgggaaacactgtttctccccctctcccactacctgcttttcacggagaagctaacatttattaagcacacactctataccaagcacttttctagaattaaaggtacaaaaggcataagtcatctgtgccccagaggaattcactatttagtgtggagctatctttaaaatgactctatcattaatgtacgaatgcaaccaaaacacagagaggaataactgtgactcaagagatgaacatgagtgtgtcagatggagaatttcaagcaggaaaaacaacagagtgccagaaccatatacagatctggtgaggttggtgggagggcaaaggaggttgttgaaaaggctgtggaaaaattagaatgtggtttgatttctatcccacctgtgtgatgaggatggaaacatcttctcctgagcttcaaacatccctaccacacacagacacacacacacagacacacagacacacacacacaccattgtggaaatcccagccagaccttgggtattcatgcccccaagccctgtgaggggcacatccaatatgaaggctgtgggagaagagaatcctgctatcatgtactcactcatttagcaattaataagtgcttactaaatgttaactctgtagtgcgagggaagagggtatgataaatacacactttctgggtaggtacatgtatgatctagttgccttcacttttcccctgacaggtcattgctctgtcaacacatatttattaaacaatcacttgggggcacggtacctccttcctctcctttccctccgagataaggccaactctaggtgttcccactatcttcaaccccaccccacggtaggctcacaagaacgtcattttgatcacttaagggatgaattttaggtttagatggaggataaacttttggagatggttcctcatatggtctgtctggagactttttgcaataaatggtgtccgtgccatccagagaacataggtcaccagttaatcaagacagtagggaataatgatttacacatgttgacaaattgattcctcttaataaccaggtcaattttttggccaacactatacacatgtacactatgcacataattacgacatctataaaagatagaattaatctaattttatgcagatatgggaagaactcgtcccaagtctcacagtcagtaagtgatggagcctagagttgaactgtttcacttcactaccatgttaatacttttctcaacacattctgccgctctcactctaagtgtgaggccctgtccaactaaaacataatatggtgagttcgtcattgattcaaataatcaactttcttcccgaatcccaagtttatctcttctgattaggaaaaaaaatgcattttgatatgtcgcgtttgcgtaaagcgaggccgaccgcacgcccccttctcgcgagctgctcccctcaactgcgacccaatcacccttgcacacgcctcctgagcccccgcggttcccaccgggcttcaggccacgcctccgccgctgcaccgcctcctctccccgccttcgcccgtagtctataaaacctggagcgcaggatcgcgcccaggagcggcgagctagcggacgcaaagactgggcatgctccgcggcggcgcaggttttggtcacaagtaggaagaagccagtgcaccagaccggcaaagagaagcgggagccgccgcggcagcgcggccgtggggtccgccgccgccgcatcggagcgggaggaggagcagcggggagggcgaggccgccgggccgagagccgtcccgcctgctctcggtcttctgccttcgcctccgcgcggtgcgtcggacccagggtctgtcacctgggcgccaggggccgccgccggggagccggagcgggcaggaccctccctccgccgactgcggcccgagagcgcccccgcggggtggagcggcagccgccttctgcgggcggctgagtgtccgtctcgcgcccggagcgggcgaccgccgtcagcccggaggaggaggaggaggaggagggggcggccatggggctgctgtcccagggctcgccgctgagctgggaggaaaccaagcgccatgccgaccacgtgcggcggcacgggatcctccagttcctgcacatctaccacgccgtcaaggaccggcacaaggacgttctcaagtggggcgatgaggtgagcgcccgcggtccccgtccccgccgggcacccgtgtctggccgcccgcgctgcctttgtcttgccctacgcccccggccctatcgcggtccgcgttctccactgcgcccgggggtcctcgagcgcctcccggccccgggagcatcgtccctgctttcgcctagtccgcgtccagggccatcctcctgactagactcctttcttgttcattcattcttttgggttttccccttcattccataaacacggattgggcgctgggagggcgtgagcatgaaaaagtgacattaggtgctgcgagtcttcaacctagtgtatctgcagaccggcaactaccatgatccaccttacaggctcaaaattcgcttttgcggtcaatatgaaagagatttaagttttcctagtaggcctgctgcttttagaaatcaggtcttcaggatgtccacttctgccctacctcatgcaggtgtcttttccttaaacctctccaacttctcatcttccctcccctccaaaacacacacacttcatagctataaattgaaaccagtaaattacggctcagtttcctacatgggggaggaaccttccctttcctgtttaattctaagtgggaatgcatttagagtttcaacattaggatttgcttgtgtctttccatggcctaggtccagcaactaaactttacaaaccagtgttctgcctagagatgaaatgtctctagattctcagtaggttgaaccattgtttattggaatgatctggaatgcagcaatgttaaaactgttgatttagtgtcatctgccaaaactttttgtgccttccctttctgtttttgaaaattacgtgtgtatgcagtacacattaaatgacttcttgagaagtccatctctgtttttgtttttagcttttgccttagatggcttgccacctgtgtaaattgtttatcttttggccagtgttgttatcaatcttggcctaagtgctgacgtgctgttacaccagtgcagaatatctcctttcaaaaagttagttttttttttttttctaagattgggattctacctcctacagctgaagaaattgtgctgttttaaattaggaaagtatgatgactagtaattcacatttctacaaaaagtggtttgtcacacttctttgaacagaaaaagcacagcatgtgttttggtgatgattcttcagttttactgtaaagttcatagtttctttacagcatctgccattttgtatattcatttttgtattgtgtgtcacaggaaaatgtaagacgaaattgggcagggacattatgcttgttcacctctgttttcctagagcccagccttgtgcctggtgtagttggcatcaggtccttgtggcatgaatgagtgaatgaactactatttcaagttcccactgtatggtaactagtcattgtagagcagttcaaagtttgacatttttttgtgctgctctttttttttgagacagaatcttgctctgtcgcccaggctggagtgcaatggtgtgatctcggctcactgcaacctcagcctcccgggttcaagcaattctcctgcctcagcctcctgagtagctgggattacaggtgcctgccaccacgcccagctaatttttgtatttttagtagagatagggtttcaccatgttggtcagggtgatctcaaactcctgacttcaggtgattcacccgcctcggcttcccaaagtgctgggattacaggcatgagccaatgtgccgggccctgtgctgcttttgacatttaactaggtctctctacaaagacaggcagttcaagtctttggtagtcattgtcccaggtagaactacatcaacaggaaatttgcagcacagttggagctcagcaactccttctggagacaacaccccaccccccaccaccccttatccatctttgtcccatttggtgtattcctgcaagacactccaggaatccttaatcttacccttttaaaaaaggcctctcctgttggcaggaagagcatttagaactacctattttaagtaacttttgtagttgttgggtaaattgaagtgggaagagctgaagagtagagccttgaagtacgtgtctctgctttaacaggctttcatggagagatttgcaataggtttacctccttcccactccaaaagatcaaggggcttggaaaagagtggccataatgcaaacttgtattatgcatctataaaggagagaaaattggacccagcatttcagccaggtcataacacttcttgaaaaaattacgctgagcagatctgtggagaattagactttggtattgtattaagactctaataatggctgggcgtggtggcccgtaatcccaacactttggaaggcccaggcaggaggattgcttgagcccaggagttgaaggccagcctgggcaatatagcgagaccccatctctaccaaaaataaaaaattagtggcatgtgcctgtggccccaactactcgggaggctgagatagaaggatcgcttaagcctgggagtttgaggctgcagtgagccgtgattgttcaactgcactctagtctgggtgacagtgagaccctagccccctaccccaaaaaaagatttgataacactgctcttaccttaaaatgtgtaaatgatgttcactgaaaactttctttagtgactgttaagactataccttcacatttcttgttccaaatactctgtcataaattaaatacaaagctataaattgattttttaaacctcatttgaaatgctgcttttaccagcattttactgttttatgatctatcctttctgtttccctagactattttgttttccacaagttcctttgttcccccaccgcccccccaccccactaacatattaatgtcttttggagtggggagtaaacaaactgaggtggaaaactcatcttagaagaaaagcataacccgctgctcattttttattattttaaatttgcttcagttatgtctctgggtggagtatagaatttttgagaagaataacattcctgccctgaagtgttgacagttgcccgacacaaaggaaagaattaagattgtgaagactgcctaggtgattaaagaaaaagaagccccactctactttttcctcctgccatggcacttcagtgaaaccttggtctcccccgcgcttgttctacctcccgcccttgatctgggatgcagatactaattctccattgtggtacctctctacatttctttttttcttttttttgagacggagtctcgctcttgtcacccaggctggagtgcatgacgtgatctcggctcaccgcaacctccgcctcccagagttcaagtgattctcctgcctcagcctcctgagtagctaggattataaggcacccaacaccatgcccggctaatttttgtatttttagtagaatcggggtttcaccatgttggccaggctggtctcgaactcctgacctcaggtgatccacctgccttggcctcccaaagtgctgggattacaggcatgagccagtgtgcctggccacctctctacatctcttatatgcagagagaaggtgtgacttttttttgtggggtgaggatgggagggtctcatcatgcctaagtatttgctgatgcctgtaaccattcctctagcggcatcatcatgtgaatctaatcacccttttgtaagagcattatttttcagactgcaggtcatgattcagtagtgggttgacatacatttagaagattccaaccaggacttttgtgtgtgtgtgtgtgtgtgtgtgtgtgtgtgtgtgtggcaagacacttaacatgagctctacctccttaacagatttttaagtgcacaaatatagtattgttaactacaggggcaatgttttacagatctctagaactagtttatcttgcataattgaaaccatgctcaccgattagcagttcctcaattttcccctccacctagctcctggcaacaattctgctttctgattctatgagtttgactactttagtacttgatataagtagaattaagcagtatttgtccttctgtgaccgatgtatttcacttaacataatgtcctcaagggtcatctaaattgtcccatactgtaggattttctttttttttttcttttttgaggctgaataatattccattgcttgtatgtaccacattttcttcattcttctgtcagtgaacgtttagttgtctctacatcttggctattgtgaataacttcgatgaacattggagtgctaatatctctttgccaacaggactttttaaaatattaaatggaatagggtgaagaatattaatttatcataccatagtaagaatattatgtaaaacttctgagttatcttctgaggaggtgtgtgaagggtaggcttgtgcattggattgcatgtaaattatttcttactatggttcacagttgaagagtttgaaggccacagtctcagatttatttattcaatgaggtgagcctcgtgaaaaagaacaggttagcactaatctttgcacatagtaggagctcactggtacacattctgaatagaagtgtgaagacaggtcagaagcctagtggctcagatgcaagagagcttgtttgtgtgcagaagccttgagaaataactgagaaacaggctgcgcagataaaagtgtgtgtggtagataaaagtgggtgtggtggatggtgtgccacgtggagatgaagaatggcccgcaggacagaaagtggtgttttggatgtgatatgttgggctttatgggcatcatatcaaaatgctgctttttttgcttactgttgcacttatagagccatggacttggattaaaaaaaagacaaaaatgaacttaaaacgcgccataggtatggttggaaggagaggctgccactttagaaatgctcagctctacttactaggatagtgtttgtctcttcacaccagaaagaaccttggatttggggttcagtttgtgttctcatccaaggctgaagtggattgtcttacagaggtgcgtgtatgctggctttttggaactcaggtattttcctgtgagaagctccaagatcagcctacagatgcctgtttcacctttaatatgacaggtcctaactctagccaccatttactgtgctgcttctgtgggaaacagaagttccaactcttaggttccagggagatacctattttgccccaggatgaggagaggtaagggggatattcctgggtgccctgttgcctgctgagaatacaaacaagtaagcccttctgcacagttcacatgcagcttttcagatatgggttttgtttgtaacttagatatgcacattaaaagacagatctgggaaatctatgatgtaaatgtaacaaatatgacttgattttttctgatgactccagtgttagctgcctgccagaccttttcagctacttagtggcagacatatcatcagcattgaaatctgtctgactccaggtccagtccttaaacattataccaggttttgggttatttacaatcataaatttcattgaatttctttttacagatttcaaactgtataggttgtagagggtcagaaaacaacatttaaaactaaacttttacttctaagtttgtaacccagtgcagtggctcttgaaggcaagaaggtaaattgtcctctagttagcagaaaagtccatgtgaactttgagaggaaaatgcaatgtatctttaatctttatgagcatgttcttatgtgtaaaacagagatgagatttattaagggctgatatatcatccattgagtttgaacttccaatttgcctatgctaggttcagaatgctgaagtgactatttagaaaatgcatagctgggaggccgaggcaggcagatcacaaggtcaggagatcaagaccatcttggctaacatggtgaaaccttgtctctactaaaaatacaaaagaaaaaattagccaggtgtggtggcgagcacctgtagtcccagctactcgggaggctgaggcaggagaatggcgtgaacccgggaggcggatcttgcagtgagcctagatcgcgccactgcactccagcctgggcggcagagcgagactgcatctcaaaaaaaaaaaaaagaaaatgcatagcttgccaggcatggtggcttgtgcctgtaatcccagctacttgggaggctgaggtggaaggatcactggagcccaggagttcatggctgcagtgagctgggatcatgccactactgcactttggcctggatgaccaagtgggaccccatctctttaaaaaaaaaaaaaaaaaaaaaaaaaaaggaaagaaaaaagaaaatgcctagcttattaatgaataagtgtatgatcctatttaaaaatacagtcttgagtgataaatttagaatggacaaaaacacaattatttgagtcaaattgaaggttctctatagctttgggcaagttgcttactctcccaacttcaattttgtcatctattaaatgaggacaatactaccttccttgcagggttattgagattaaatggggtaatattagtgaggtggtttgcaggtgcctagcctgttaagtaaaatctcacaaatagcctaaaccatttacttagaaaatttaaaacatccagtatatcttatttaaatagctgtggtcattgaggaatgaaacattccacatatgtagggttttttggtttttttttacagttaactgaaacttgcttgttcagatacaattatattccattaacagtaattttttattgtatttcttttcttttttttaatattatgtatttatgtatttatttatttatttatttattttgagacagggtctttcttgctctgtcacccaggctagagtgcagtgacaccatcacagtgtgctgcagccgcagcctcccaggctcaagctgtttagatcgtatttctaagttgcgcttcaaaaacgcattgacacaggctcaggctaggcttcttaaaataagatatagagcacaaattaattatttcttaataggcattacaaagattcaggttccttctataggtcatagcgtattctgtaacacaaaaagcaaagttgtcgcatctctctatcttttttagctgtcactggacattgattcaacagcatttattgtccgttaacccctacccacccccagaagttcccttgtgccctttgcacgtgtgtgcatgcgtgtatgctagagagagagggggagagcacttcagttgattctggttttccttcagacaccacctttgagaaactgccttaaagagtgtgtggtcattaattagatgaaggggagaaaggaaggcattatggtcaaaagaacagtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtattagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcaggtgtttttaaaaaaacattttaacagctttattgagttataattaacataaagttaactgcacatatttaaaatgtacaatttggtaagttttgatatatgtatacatcataaaatcacctctgataataagtatattcattatctccaaaaatgtcatcatgcccctttggtaatttcttcctctggccatcccatgcagctgatttgctttctgtagtttgcattttctagattttcatatttaagaaatcatagtttgcatttgatatctagtttcatatacctaggaaatcatccagcatatcctcttttggtctgccttcttagagtctacataaatattttgagatccatccatgttgttacatgtgtcagtagttcattccttttcgtcgctgagtaatatttcattccatggttataccagtttgtttatacattcaccatttgtgttgcattcagtttttcactattataaaaaaattatatgaacattaacatacaagtttgtatgtatggactaatgcttttcttcatcttattaccctaggagtagcgtgttgttaactttttaaggaaactataataccaaacttttccagggtggttataccattttgcattctcactagcagagtatgccagttcagttcatccacattcttgttaacaccggtatgggcagtctctttaattttagctactctaataggagtgtggtggtacgttgttgtatttttaaattgcattttcctgaagatcagtgatgttgagtatctttttatgtgccgatttgtcatgtgtgtatcttttttgtgaagtgtgttaaaatcatttgtctgttctaaaactattgagttttgagcgttctctatattttggatgtaagtattatcagacacatgctttgcaaactttgcaaatatttcctctcagtctgttttcattctctttttttattttttatttttttttgagacagagttctcactctatggcccaggctgtagtgcagcggtgcaatctcagctaagtgcaacctccaccttccaggttcaagtgattctcctgcttcagcctcccaagtagctgggatcacaggcatgcgccaccacgcctggctaattttgtgtttttagtagaggtgaggtttcgccatgttggccaggctggtcttgaactcctgagctcaggcagtccgcctgccttggcctcccagagtgctaggattacagtcttaagccactgtgcttggccttatttttatttttaagagatgaggttctgctatgctgcctaggctgtcctagaactcttgggctcaaacaaacctctgccccagcctaacaagtagctgggacttacaggcatgtgccacctcacctggctaatggcatactcttttgattgctgaatctttataataagccatgagatcatgtagtattagctctctagctttattctttttcaactggtttgactcttctggatattttgaatttccacgtgaattttagaaccagattggcaatttctacttaaaacaaaaaaaccctgctggggttttttattgggattgcattgaatctgtagatcagtttgggaaaaattaacatctcaacaatattgagtcttcaagtatatgaatatctctccactctacttacatctttcatttctcccagcagtgttttgtagtttttcgtgtataggtctttcacatcttttttgtcatgttatccctgaatgtttctcatgtttcagttctattgtaaatggtttccccggaccttcagctccatctcttccacccagggagtccactgggctcttcttcaccttcctgcccatgacctggagcctctccccaggcagtaagtgggggcaattgtagggcccactgattttcccccgtttctcagggatcctttcttatctgatacgcagtgtcttgaaaattattctttcatatattttctcttcctctctcttttttttttttgttttttggtttttcaggtaggagggtaaatttagcccctgttactccatcttgattagaagtggaagtgtttcccactttttctatccttttagctgtgttctcctttgtctgtaaactttgtccaaagctggctatcattgtggtttataagatacttgccagcacccaagatttagccaagtttttaaaaggtcaggattttctttgctcttaagccatagttttcatcatttagtatctctgttatcatcctgtgactggatatttggtaaaaacacaattagtttcaaagtcgacatacattttattaatgagctttagtctgaagatcagagtcgaagacctggggtcaccccgggttgtgtgagcttagaaaacagaactaaagactgggcgtgatggttcacgcctgtaatcccggcactttgggaggccgaggcaggtggatcacttgaggtcaggagttcaagaccagcctgaccaacatggtgaaaaccccctctctactaaaaatacaaaattagctgagagttgtggcacatgcctgtaatcccagctaccagggaggctggggcaggagaatcacttgaacctgagaggcagaggttgcagtgacctgagattgcgccattgcactccagcctgggcgacaagagtgaaactccgtctcaaaaaaaaaaaaaagaaaagaaaaacagaacttaaattctttggaccacaatttcctcatttgtaagactaattaaaaaaccctatcatttggtgttttgaattgcatgtttatatatatagattcttttagttgtattttttaacaatttttaattgtttcagaataccttaatacttaatactctgtaacttatgaaaatcggtaaattctaccagaagtggtagaattcattccccctgcaacctttcaggtttcagcattttctttgagattacatactttaccatcaactgaaaaagtaatcttaattaatttcctagaaatttgatgtgggagttagtagtattgctgtgtgtaggaagaatgatggcaggctttcaagaggtggggaaggacaagaagcctctggatttgccagttgggcaggtactgggggcgtctggcaacaacatatctgaacatattaaggatttgggagaatagcaaaagttggtgtcagatcaaaataaatgccacaaagcccccatgcatgtttttacatttcatatgatgtttgaaatcttgatgatagtttttagaaggagacaggcctgcactgggacagcatatgagtttgggtcactttggtaatatctgtgtggctaagttatcactggtgtgtagtgaaactgaatgagtgatgacttaatctccacttaatggttctgtttctcagacatggtttaaaaagacagagaaggatgtaatgagcctcagacttatagccaaaagagttcatatttgatatatctttattggcacttggaaagtttggttatttagattggtatgttctgagcgagtttctatgactaaggttctactctgatggatgatctctaaagagctttctgtattagatttttgtgtctgttttatggttagagtttagtagttgaacttatttccacacaatactacgaaagagcccccaaaacagatgttcctagttacataaatgctcttacagaccccctgttgtctttgtccccctcccccaagattctgtttttaggcctttggattcagttaactcgtttttgaagtggatggtgacttagcagaattcagactctaaggtgagtgactccatgacgcttttccaggaaactagtaaaaatctgggttgtaagtctgccccattcagattaactgctggaggggaaccagagcttcacagagatagaaaaggtcatagaagctgctgttttccagcagacttttcagcagtcctgcctgagctaagcagggtagtaccctggcctgccagtgtgttaagttgtgtctaggggttatgatctgttggctccactactcaaatagagcaagaactgggaagtaaacaaaaactttattcctggaagcatatttgaggcctatacgcagatcgctttatacatagttcctgcagactcggtcatttagtatctcagctcaggatgtactgcaagaaattgaggcagaaatgagagggcgcagtcgagagaggagctgcccaaagcaggtccagatgtggccttctgatatgcccacaagggccctgccctgttatagctgtagttaaagaagtgaaattgccaaaaacatctgaagccctaataaaaagtgaaagtatgtgtagtatcttcctattgatagcagatagtcaattttagaaagatttccactcacgtatatgtaaactttttaaagaaaacatatgctctaaaggggtaagttttgggtaataagaaaattaatttcaataaaatgaatgttctgtgtttgatgagtgaaagaaaaatgatggtcttatactaagagtttctggaagactttaatttcaaaaacagtagtttagaactggaagggacattgggttttctcttattttcagatgatttaaaagccaaagactacaacacattctaagtggctatcattagggaaaattaaggctgctctgggcaggataaataccttgtacaactttaggaggcaccagggtgggtagcaccccttgagggtggaaaggggaaggagttacagtgttgggggttcagcaaaggtctctgaaggagtggcacttgacttgaagcacacaagagccagctcttgaaatactgaggtaaaaatcttccaggcagagggaacaaaagtgtcttaaaggccttgaagtgattgttgtagagacagaaaaggccagtgtagctgcaacatcgtgtggggtgggttgaaatgaaggaggctgagaagattggtcctaatgctctttaggagggatgttggagtttctgctgagtgtgagccatttaagagtttcaaggagagtgacttgacctgcttgctgaaggaccatggtcttcctgactgtagggttagacagcattccatgccagtagctttcacctttgactaaaacaagcgctctgtgaaacaacatttccacgaaacagcagttcccttcccatgagtgacatattctgatatttctattctaccctattaacgattattttttgttatgttgatcacaactcatcatggcccacaaaggagctgtaaccaatgtttgagaaacacaagacactattctgtgtcaatcagtgtatcactgccctggagctagaaaatagtaaccactaacccctgagtggtacagtgtacttaatactgttttagcactttacatgcattgttttatgtaatcctccccagcagccctgtgaggcaagtattacctccattctgcaaaaactgaagcatcgagaagttaccaagattcaaactgattgactccaaagcctgcactcttagctgctcccccacctattaccgcccaaataggcaggaggaaaagagctctgtgacagttttaataggctccaaacagagatgagattgagggtggcgaggaagagaagaaagaatagagaaagggatggtggtaatgcaggaagtaggctttttgttttttaatgaaaatatgaatatgtcatcagccacagatccacgcttaagcattttttggtaccccatagcaggtaattctcttctagtgaaatgccagcactctttcaaaacgacaccattgaatatgcttggtaaaattctcggtctgcaggacaaatgctaacaagtttagtaatgtgactgcagccttcccagctaatctgctggcaagcgagccctgtgaaaaggcagatgcaggacgagccctttctatgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcgtcctgtccctggaggcataggtgacccccagtgagcactagcagtcactttggacttagaattcctgtatttagcattgactctcacttagtctctttagaaaactctcttttttctctctgttaggttgattagtctaacttcagttcctaggaactaaaatcctgaatttctcataggcagtctgaatttagggcagcctaatttataacatgccttagaaggaaatcatgtgtgcattcttgcttgctcagcccaagaagtgtatcaggccctgagcggggcaccgcccactgggggatgtgttctctgtcttgtccccatgctaaagccctaaactctcctgcacctagagggaaccgctgcagaaattctccatgattctcacccactacagtgccccagctctggctactgcagggcagttgatccaaagcagcttctgtctggggatcaggatactgtttcttgtcaaccacgtggtgactagaactctagcaggggaatacgttcttaggaaaaagccaaggaattcatttgtctttagaactcagaacctattgtactgaagtacagatgattggaggtaaataaggactattcatacttacaatgttgtttctttaagagaaaatgtgttctggtttaggtttctaaattacagagtacctgagtaatgctggtggccataagcagacatccccattggcaacttgatgtgctgtcttttctgaggttaatttgtgtgagatgactggttaggttttgctagatttggttcagaaataaagtaggaatgccttaatggtctttataattatcagaaaattaaaactaacatatgcctgaattgtggtagcatgatgtttttaaaaaaatcaaccaatgtaaattcagaggcccagaaaatgtctcatgcatccgtggagcatgaaagagcaggtctacattcaaggatttcctttgtgccaacaataatgaattagtgtgtccaggtcaaattaattttaggattgtgttttctcttgggttttggtccagtgctgtctagtacaacctctgcagtaagagaaatgttctactctatactatccattagggagtaggaaactgatttttttattttatgttaagtaattttaaatccacacagccacatgtgcttagtgactagcataatggacaacacaattttttgtgttcctttggtgacaggtgacattttctccctgtatgagagtcctcccagtttaccccgcaactctcactgtctttctctattttattaaagtcttgaaatttttctcttgggactcatatcactaatctaggcaagttaagaatgttttctctgtttgggctgagacaatattgagaaagttactccacctaatcctataggaaattaattgatttttgtgcagtattaaaattgagattaatgtgttataaataaaaagcagcctgctctgtgctacagaaaactagatcagggagaggccacatttattttaatttctaaaagtgtaaacctttcatagtatcatgtgaaattctttagtatgaatagacatttcaaagtaggaggaaaaaaacctattttctcaaaatatatgaaatgttagcagaatttgatacagctttagacaaaactgctaaaacattttctttttggaacatagaacaatttaattattacagtatccacagtcatcaaatatatatatatttaaatcatcaaatatatatgtttaaaatatagttgtgtgtgtgatgttatgtatgtataatgtcatgtacacaaaagcacatacagtttctactttgtacttactggtcccctaaaagtgcttggagattaccatgtcaaacagtggttttcctatttgtgatgtcatcattagacatatctaacatgggagtccatctttaaaaatctgagccatatgtaattttattacatctgtattagaatctcatattcagttttctactttttaaaacacagctcctcttttagtcttgtcagtcaggttgtcctatgttactgtgggtgtttaaaaattaagtagcatcactatggctaacacctctttgggtgctccaagtttgggaagtgaatgccatccaacttgatggttgagatttcttttaaaaaaaaatttgtcattaccattttgctgtgagaggaaacagtcttctgggcagaaggcattgagtccctaactttaaaacagtttataacctagagggtgactacttggcatgatctctgtggggtggatgcagtgatctgcgtctttgacaggcgagagggtgattgtgctgcagtcagtggtgcagctcccctgggggacgggatcctatgggaggttgaattttatgttgaaggatccctagaccctcacctttgcctagccagtccccatgtaaggaatcaacttaaatttaaatggcacttcctctgggaagccttctgatcttctagaccggcttagactgtgctgttacatatgcacagctctctttggtcattttgagcactcgttcagataattcagcaatagcgtgttattggctgtcagtccagccagtgtaagcctgagaacaggagccacatctgcctggctcttcacagtattcccagcacctgcttagcaaagagctttgttgaatggatgaaaggacaaaggggttagtgctgggggtggggggcagggagcgtgtccagcaagacagtgttttttggcactgagtagtcatcaactctaactagagccttagtcctcaaaatggttgcaggcttgtttaggagttagtgtaaggagaaaactaagtctctgagaagcaacagttggttctagcaaaaggatcaaaactattgtttgggccagtgcaagagagccagcagtgtggaatggaggagctggccctgaaccccagatgtcagtaggggtctgaagaccctgccctgcacgcatactctacctggactaggtcctggggagcccttcactgtcttgccctccttggcctgaccacctggatagagatccttcccagggtgtaaggaggggaaagtcctcatgctgtctctgggaggaatgtaggacctcacagctcatagtccctgaagggcttggtgtaggtttcttctcttcagaggtcaagcatatgatgggttaaatagtttgagagggaaaattccttccttctcatttacagagaaactgacaaaagaactttctccctaaatggggaactgcctgtaactgctctgagtattatagaactgtattgtttcctaattaagcattgtttttacctctaggagtagatattaagaaattagtatttcataaaatacccagccattcctcaaattgtttttttttttttttttttgaggcggagtcttgctctgtcacccaggccagagtgcagtgccgcgatctcggctcactgcaagctctgcctcctgagttcacgccattctcctgcctcagcctccttagtagctgggactacaggcgcccgccagcatgcctagctaattttttgtatttttagtagagatggggcttcaccgtgttagccaggatggtcttgatctcctgaccttgtgatccgcccgcctcggcctcccaaagtgctgggattacaggcatgagccaccgtgccctgcctgccattcctcaaattctaagctccctgaaactcttacccttaaggtagagtatcaaaagtttttaaaagcaagaaaagaaaatttttatcttatgctagtggtaaatgccatttaaagacttaaatcctaaaagcttgtatttacccttaaacttcattgtcacaggtatttctctgtctgctgtatattcagcattgtactgagtacttacatcgcctcagttaaaattctttgtttttgttggcctaatttcagattaacataaaagtacctcacccttgtttaaacctgcattaaatgacttggattactgtgtctggagttttcctagcaacactatttcacacacaaagcaaagtacatactagccttttgtatgtgtctttgtccttggttcaacagctcagggatagtagtgtattaatgacttttattctggtcttttatatgtgtctttgtccttgatttgacagctgagaatagtggtttttattctagtaggataaaatttagccttttagcactagaagtctaagagattttaattttcatttgtaaaaatagtgcacatttaaaatctgaatgtcttgcagagtggtcaggcatttttttattgggtctcttctccctcaattaaaaggataactgatgggtgccaaaaaacagtatcccagagtcaccttcagggcattgtgacctgtgtattgcagagaatagaggtcggtgggtatttttttcccctacttccaagatgatatgttaattgcacaagtttaaattggtcactctgcaacccatttataatgctctttgggtatgtatgcttttggagttgtatatatgtgtaaagtacataaatatatttgatgttgctgcaattctgggtttacagcctagatgctattcaaagttagtaagctgatacagttttatccttggaatcagtgttgtgatacagaaaggcatctgttttattattttcttttgtatgttgttcctcttatcctttggattcaaaaatgaagtttagaatggggatacaatccagaaatcataaaataatttattggggctttagatgttttatattggaaaatcgttgtcttaatgtatcactttttattatcaccaatcatctcggttattgcgtcaaaccccatttcagctctagtttgacttttaaatatgcagttacgattcagaatgctcatatagacaggctctaatcggaaataaacataaatgtgttgaggtggtgggggtgtttaacaaaaagctaaaagtttgaagaacctctttgaggactagtgcagaaagttcaaggtgactgcagagaaggagcacttcagaaggcattacattttagtttgaaaaaccgtcaggaaattcttgaggcttccaactgatgattattctattgaaaagtaaatttggttttctttctcatttggtaaatattctgatgtttttctgtttcatttgcttaatgagatcatgaagtgattatactttaattgaggagagtttggtttgttaacattttaaatgtcatccgtttggcatttaaaactgatatttaaaactcagaatgagctttaactttttgttcttttgccctacccatgttttaaacttgtgggctaagagtgaatttgaaaactaaggatttcaatttttttcaaagttaggaaactaacaattaaagttattgcaacttagtttatataattgctacaagttcttgctcatttggtaaaaaataaatgatgcactcagtaagcaaggaagtatctcttagactttctttaggaagcatgttttctagttaagcaaataacttaattccagtagcagatgccaggcagatgagttggagtctaagtgagtgaaggaggaagtactgaagaaggaacatttcctcctagctgggagagttaggaatgctacacagagtaagtgggttccgtcctgggcctgagggatgggccagttcatctgttaaaatctatgactgtaactattgttacagcccagcttccatgatataatgttaggaccccttccatgaaatgaaagcataatcaatttgagatagtttcatccagtattataacttttccctgcttcatataggttataacaattttataaaaagcttatcttcacttaccaagattggcaccctctacagccctagcagcaaggtgtgctgggccttgaggccagacggggctggcttcaaatctctgcctgacacttgtggccttgagtagcttacctctctgagcccctttgcccacctgtgaaatgggtaatcaagcctgcttttgcatgctgggtttgaagattaggattcatatatgaaagcatatcctttctcattatgcttatttaaagattaacttgtatcttttcacatacccattctgagactcaaccaagttttctgtttccaggttttagctgttccggagtcacagatctatagatggtatcttgcaacctgtaattgttgttgcgaacagttccagattctgcagcctagtttttagtcagctgacactgagtgattctgcaggtggagatctcatgtttctggttcgtgtacccaaatcaagcagacttttccatttcttgagctaaaagattctgatgagagctaataaacgttaactgaaagtttattttgttgttgtttaaatctgctaggctatctcctacagttactaacatttttttcctctttataatcatattacttagcccttaatgtttctgtgatgaggacggctgactcaaatgccttccaagaccagggaaatacacataaataagggaataaactgcagacagtgtgcacccctgaaaagcaaacagcccagtcacacagtcacaggcttcgtgctgggcttctgggtattgttttaagactgagaacctagatttacatgtgaaatatctgggaaatagtggatatacggttgcctgcctttttattttttctaaactactattgtaggccaaaccaaatacactgtagcctggtttgccttgtgaggaatcagtttcctacctctgtagtaattgtattggtgccatgtgcaaagggtactttcaagggcttgcctgaataattctgtatcttttcacttatatatggataatggatgttttgtttccatcacacacagtgattcataatcttcactgctcacgccaactgtcatgattgaaagcttgtaacttcaggaaaaacaaaagtaggttctagttgtattctgcccagaagtctgactttgtgtttatgtcctttatttttactagaattccacgaggtattgttaataaatgtactagtgcaccctgcattgcaaattttatatggtttcagagtggagaagttgccttaaattacttgagataaaccaaaattaaattgttgaaacccctcaaataacttctccacacggtatatttatgattatgatttaactctccaaaagtgggactggtagtgggattatgaaagtgtaatctaccttacttattactctgccagtaagtaagtgtaatctaccttgactggaatgtccagataacctctttcttaaacttatagtaagccaactgaggaaataaattttaaaatgcagcttcttttttacaacagcaatttacagaatctttgcttcaaaacacatcttttttttgaagtacagcttgtcaaaatgggtatcgacctttccataggatattaagtaggacagaggaaagaagggatggaagtggcactactgactgatcctttctacaggtttccatattatgcatatgaacacttatgtgctgtactgtaaacaaatgtgactgtctggagttactgtggatcctttacagacttcacgtttccctgcctttttcttctggaggccacactgaaaacaagtctggaagaatgttaatttttctcacctttattttcaataggtggaatacatgttggtatcttttgatcatgaaaataaaaaagtccggttggtcctgtctggggagaaagttcttgaaactctgcaagagaagggggaaaggacaaacccaaagtaagctctcatgtgctgatttagtgtttctgaaactgctaaaacttctagaatatagagttttttctcaattattggaggcaggatagcctaacagttaagagtacaggctctggtttcaggttgccatagtttcaaatcatggttcctttactcaatagctgaataaccttgggcaagttacttaacttttctgtgcctcagttctctcatctgtaaagtaaagatcatagcaatacctacctaaggtgttggaattaaatacattaatatatgaagcactttgtacagtaaactaaatataaagcctgttttttattaaaacatttttgggaaaaaatgtattgcagaagcgtataactgggatcacaaaccatgatgcaagatataagttgcagatgggctttgtttggctttgtttggctggcatgatttttttttgagacggagtctcactctgtcgtccgggctggagtgcagtggcacgatctcagctcactgcaagctccacctcctggcttcacgccattctcctgcctcaccctcccgagtagctgggactacaggcgcccgccaccacgcctggctaattttttgtatttttagtagagacgggggtttcaccgtgttagccaggatggtctccatttcctgacctcatgatctgcccgcctcagcctcccaaagtgctgggattacaagcatgagccaccgcacccggcctggtgtgtttttaaggtattcctacatttaagtagacagagacggggaggggaggggaatatatactcctctgctcattttccactcattcgttttggggaagctgcatttgagtttggagggcagcactgaattgaaagaacccttaaggcctcatctccttctctgcagagtaggttagtttgtcctggacagtgagtgctctgtgtgcattttcagttacttataaagattttgggttgggcatggtggctcatgcctgtaatcccagcactttgggaggccgaggcaggcagatcacttaaggccaggagttcaagaccagcctggctaacacggtgaaaccccatctctactaaaaatacaaaaattagccaggtgtggtagggcacacctgtgatcccagctacacaggaggctgaggcacaagaatcacttggacctgggaggcagaggttgcagtaagccaagatcgtgccattgcactccagcctgggtgacagagcgagactctgtctcaaaagaaaaaaaacattttggacccaatacttgttgacccttatgtagttgaatagctatggaaaagtaataatcactgagaactgtgaaggacttcttagcttcatttatacctaatggtttctacacttttaaagcaactttaaaaacttaaaaattgagcagactatagcaaaagaataagatggaactaagttatttctcctccgtagccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccaggttagttcctatattaacatgccccagcagatctctcagagatacaggtaatgaaaagagcaagtcacgacccgggcattccaccttacaatcctcatacgttacagatggtttatcttttatagactgcacttgatagactctgtaacagtagagctgcagacacagttgcatgccagcttctgtcagctgtggtggctgcaccgtggtgagtgcactcagtgggggctcagtgggaaagaccaggatactgtgatgacagaccagcagtgtggccgtgtctgccgcaggcgagggtggagggagcagcacgcctgccacacagttctgaccctgtaagcagtagccaaagcttctggaatgctgtcccctggtgactgtgacagttgcgccctcatgcactttcaaaaagcagcatttacctgctagcatatggtggcatcagtggcagatcagaggatctgcagtgctcccaaagcactatcgataccgatgctctatgaacaacgtgagtcattaggtccttgcatattgttctgaaaagaagatttagggtttgtcatcaaatctagttatgaccaaaagtacataaaagtaaatagtgaaattatgttcttcgcttagaatgaggtacatgaatatcatatgtattatacatagaacctctatgtaaaaatacatttctgccaaaacatgaatgtgatttatctatgctagatgtctgtcagatggtgacagtatacttagctcctcaaagttcaaaggagctctgggggttggtatcaatggtggagaacactttgaactatttttataccttttctctgatacgtgtccgtcagccattcagggtcatatcattggcctcagaggggcatttaaatgggaattctatttttttttttatatctctactgtaacatctaaatagttgaaaacttatttaagccagccatctaacatttatagaagcatctctatttctgtgataccttcattctgtatgtacaggtcacttctctctccacccccagaaggaaaaacccagctgggtgagggtggacagatttgttttgattagagtgggcacatttcttcgacctaatgtttgaaagaggaggtgaaaaatcattggccctgccattcactcagacacttgagtgcctgctgcaggcagaatgggcatgctctcatgagtgaagacggacagctctgtctctgtggagctggggggttgaagaacaatcaaatacccatagattcataagcgtcaaagtggggctgtgctagcaggaggagatggggagcaaagagtacaacctaggtatccagtggactctggtgggtggagggggagggggtgggatgtccaaggttccaggaggagtgaaataggaatgaggagcggaggacagtcttagggagggggagcagtgtgtgtagaagtcctaggatgaaccaaacaagcggggacttcctgggaactagaagaaagcaagctggccagtgtgactaggaggctgaggaggaagtgcaggtatggggtaaagggaagctggcaggtaattggcaggccaggtcaggttaaccataaattttagttgttctcctaaaagcagttgaaggccttggaaaggttgggttgggcagatggcatcccctttttgctttgcagccctcacttgggctgtagtgtgagagtagctgtggagctggtgccagggcttactaggaggtgagtgagggagctccctgaggggagacaagggctgcctggatgcccgtgggtgctggtgataggaaaagtgggtggtttaaaagatgacagagtcagtgaactgctggggagagaagacacatcaaggcttttgctataggtcattgtcctgaaaaccttaagagtactagagtagaggccaaggagtaggttacagatgttaaatgacaacttctagtgaactggaaaatttaataccttatatgttcatttttttccccttaacattaagagggttgtacatttcacttagcaaattaagaaagtgggaggggatttgtaacacaaaccagaactgttttatatattaaagctgaagaatatataggattgatgggcagtggtgtttccttctgggccagaaaataaagttttgggttaagcctaatgtgccctttaccttgagaatggttccatatgggatagttgcctttttaaaaaagatttagtgtctgggcatggtgtcttacacctgtaatcccagcactttgggaggccgaggcaggcggatcacctgaagtcaggagttcgagaccagcctggccaacatggtgaaaccccgtctttacaaaaaatacaaaaattagccaggtatggtggcatgcgcctgtaatcccagctactccggaggctgaggcaggagaaccgcttgaacctgggaggtggaggttgcagtgagctgagattgtgccgctctgctccagcctgggtgacaaagcaagcctccgtctcaaaataaataaataaataaaaataaaaagattcagcatcttaagtcattgtgaagggaaagttgagacagaggaataagctttattctaaaaacctgtaatttagaaaaaattatatgtataattttttataccctgtccatataggaaggtattttgggacttgaaacaataattattagttatttagtggttagaagcctccctatacatccacaataaatgataaagttttgttgtagtataggatcaagagagaaaggagtgctctggttcttaagtgtaaacagggtgactttataaagatgcaaagatttatagtgtggaactctagtccaaaacagtaatcatgtgactatttaaaattaaaattatataaaatgaaaattgtagttcctgatgtgactgaggaactagcctcatttcaagggctcagtagccacgtggttagtgactaccacatcggtttggatagtggagatattaaacatttccatcactccagaaagttctgtgggacagcactgctctagaatgaagcagtgccgtaggtgtccgaagatgcaagttctgattctaccttctcccttccacacaaacacattctcattctctcttcatccaatctgattctggtgagcaaggaatcccctcagatttaagtttattactctcccaaaggactattcctaaggttctaggctcatagtaaataatgcacatagcttcaagaattctcaagaacccttgtagctgggaactgttttctagataagatcactaccttcaattgtttacaaggtggatttgggcaggcaacagatactttattttatattaagaaaaggtaggggttaaaaataaggcattgatggccaggtgaggtggcacgtgcttgtaatcccagtactttaggaggctgaggcagaaggattactggagcctaggagttaaagaccattctgggtagcatagtgagacctcgtccctggaaaaaaaaaaaaaaaaaaaaaaaaaaaaaacttggtacagtgactcatgcctgtaatcccagctactcaggagcctgaggcaggaggatgacttgagcccaggagttcaaggctgcactgagctatgattgcaccactgcactccagcctgggagacagagcaagaccctttctcagaaaaaaaaaaaaaaaaaaaaaaatttttttttaaaagatatgagctagtcttgatcctcaagccaaaagtttcttcccactaatttaaaactcctcccttgtttggctttcgcttagtctttgtcctccctcacagcacatgtaatattgacctcaaattcctaacttggaaaaactggggccatcactaaaagtgatgtagaatttgagctttacacttaggaataaatatggagcttcatttttctgtgttgaaattagagctccttaagtcaagtaagagaataggattgggtttcagacttcagagggtgatctcaggggtagatggggacacctgcagagacactccctaatcttgagggactcatgaggtgacctatagaggcaaaaaacaggctccttccagattcagagcctaccaggaagtgggaggcagtggtgccatgcagcaggtccaaagataatctgagagtttagagatggaaaaggaagacacctcataggccatgtaggggacacctgtcacccatgacagctgatgtgaccaagggaaatgacttctgtgctatcagtccttcctattagatgaagagatggagaggacccgagtaagtgctgtgtggtttgtgagtgagtggagacttggataaagttagtagtgggctggaattaaaagaagatccttgtgagcaagaagtgtggggagtggttgtaaaggggcacagtatttacacaacatctgttttgtaaacacaaagccctctgaaaaggggatactagaaatgaggtgtctttggcaggtgcagtgatggcaagactgcacacaattaattcttgaaaacaaatcccatctatttagttcttcaatttgttgtagattaggctgtcctgggttcacactgcccgaggtcaaacccaacccagtggaaggaggagcttccaagtccctcttctttccagatgaagcaataaacaagcaccctcgcttcaggtgagtatggctttgtgttgaaatgcagatgcccttcactagacccctgacttctgagagtatagtatttctgtctagaaatcctttttgagcattaactgagttttggctctcttcctaagtaaccagagaagatagcagatgtgcacctgttcacatcttcagtacccccaggcttcttggttgttgatgcgtgcaccaggcttgatttgtcaattctccaagtcgtcacaaagttattcgctgagccactgcgaataactcttttaatagggagattattttcagtcctaggtctgtaaatgcctactgggattttttttttctcttagttatttctccttttttgtcctctctaaccatcagtatctgtgatttgcccatcttactctatataacttataaaataggtgcagtacctgatatatataataggcactctcttccattaacttcaagttctgttggtttgttgttcaattctgaggttttaagttgctttaaggctctcactagcctgatcttagctttgtacaatgcatgctcatctgtcatcctgagcctaggctcctgatccagagtgggaacatggagacttctcagcgttcattcctttaacaggccctcacgtttgctatgtgcagagccttttggggaagacagatatttgtagacgtagtttctaacttcatatgttgtcatgtgtttaaaggaaaataaaaataattcagctgctcaagaagagatagattatgacagatgtcaaaagatgcaccagaaatccttcttggagaaagtaaggtgcttctgactgagggaatcaaagcaggcttcacggaagaggtggcatttaagctgagtctatagcagcactgcccatagaaacatgtaattgtaaatgttctcatagccacattaaagtaaaaaccagatgaacataattttatattttgtttaacccaaaacgtccaaaaatgttatcatttgatccatgtaatcctttactcacaagtaattttacattttttttgtacggagtcttcaaaatctggtgtatattttactctcacagcatgtgcatgttttcattaggacaagccatatttcaagtactcagtggccactgtgtgcctggtagcttctggactaaacaagcatgagtctggaggataattattaatcctgcagagatgagggagggaggagcaaggtattggggctccagagatgcctgggcaaagtgggtactaaagtttgaccaaagtctttggagttaatttgggacatgttgcaaacagtgaaagcagaccatggcagactttgaacacctgaattgatttggtaagttacagggagccttgggagcaggggttgagcaggagacagaacggcattctcgagcaggagccaaagaattgatactaatgcaaaatctttaatcacaaagttcccttgtagtgtcttgacaccacagatacattttctgttgagttgtcttagataactaatttgaggtatgatttcattccacttacttgtatgtaatcaaattcttcttttacacgatgactcttaggtgaccaatttatgacgtttggttgtctgttttagtaccttaacaagaaatatccgacataggagaggagaaaaggttgtcatcaatgtaccaagtaagtctactgagaggtggtggggtgggagagagacatgttgtattgttgtttaatcctggattctaaaccatttttatttttgtatttttataatacagtatttaaggacaagaatacaccatctccatttatagaaacatttactgaggatgatgaagcttcaagggcttctaagccggatcatatttacatggatgccatgggatttggaatgggcaattgctgtctccaggtatagtttcaaatatacagagaggcaaagtgttccatccatttctgttttttaacttctttatatatgcatgtttcctgttccaaaaatcacattttaatgaggttgaaatggtagctggtatgcctttctgaaaaacatgaagttatattagtaaattcattggaagctgtctatgactaatagttctacagactctgttgttcaccacaaaggtatatacggtatatatacctttataactgtaatttcagttaacttaaaatgcaatatattctgtcattgtttcccttctctttttatatgcctagtttttactgccatctcgtgacaggctagtgaggtggtttaaatattgttcaaaactctgaaaatgagctctgatggaagtattccaatgattttgtgatccaagggatttgtgcaaagctgtctagcggtacaaaaagaataaatatttagcagcttgtgtttgtcttgcccctgagtaaagtatacaggagcctgtctctgtttacccatttaaaaattttcctggatctgtttaaatgatggtgcccctggcagtgagtgtgtccaagctcacttaggaccagagtggaagagcatggaacccatcaggtggccacacacaagcctgcagttggcttttggctctgtcactactcaggtttttgggcaactccctttacttcttttggctcagatttttcatcagttgaaagaagggctgatattaagtccccttctaggtctgactctaagctaatatttattttattgccttaactaacagaagtaaaagagagaggctgcttgttatttaatgtccaaggaaattttatccagttgtgattacttcagctgattcaaaacagcgtccttagaggcacagggccgtgcagagcctggacccatgtaagatccctctgagccgccagcctgactgctctcagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataaaatatgtgacttccaaataaacataaaccatcacacttcacgaaaaaagagatctttcgacttttaactgcctgtttcctatcttaattacaagtatttctaaagaaaaccattaagttctagagcttacagtacatggttttaaaattgtataagtgctgttaagagtattgattgccttttcttggtttaatattaaaccagggtgttctgccgaagaccgcatagtttctctgatatggttccaaagggatattctttccactgaaacactgtatgtatactagtaaatgcttcctaatggtagatgataaatatttttgttgcttgtagatagaatttttccatctagtgtaagcttaggattgttttctttttcccagtgacatgtacagtttcactactccacttaaaaaaaatcgttagctcagataaagtgtgtggcacatgaaatgaattttgccaattcaccaccgaaatccctgctttatatctcttcagtggaacactaaaccaacttctttcccaagtacactgatttgatctttacaaattatatgaatgtattaaattatcacatgtgccctgaaactgtgtacatctattatgtatcattagagagatggaaaaaaaaaaaagaaactgcttagtaaagtagaaaaaatagttttaaagtaattttgtaaggctaatggaagacttactgtataaagcaaaaaggattttaaccacattcaaattattgactgttttggggcttttcaggaatcacttaaaaagcaccaagttcacagccaggcacggtggctcatgcctgtaatcccagcactttgggaggctgagatgggcagatcacttgaggtcaggagtttgagacaagcctggtcatcatggcaaaatctcatctctactaaaaatacaaaaattagacctggtggcatgtgcctgtaatcccagctactgaggagtctgaggcatgagaaacgcttgaacctgggaggcggaggttgcagtgagccaagatcgtgccactgcattccagcctggggaacagagcaagtctttgtctcaaaaaaaaaaaaaaaaaaagcactaagttcatgacaggttatggtagcccctcccacccccccccccaaagtcatgtgacttcaaatctgggttgtagataaagtttagattagatgtttcagtttctaacatatatgttccttagttcctccctccacccccaaccccacccccatcagtttcctagcaacattgtgtgtctccttcatatgatgcctcaaaacgacactagaagcccaaattagtcatgtattcatagctttttaaggtataagaactttttttccttccattaaagccattatccacagtgatgtcctatttaatttgattgcatatcagctgtagactaagaaagctaattactaaatgcatttaaaataactaagtcacttcactgttgtatacttctctggggttgaatttcccaggattcacctacgaattatgtattgtatactaggccatctaagagaagccagttgaaaaactggaaagaaaacctgcttctcatagtatctttttaaaaacaaaaatgacacatactcaaatacctaagagcaacacaaaaaagacctaaaaaatctaagagatgcatgttcaaaataattctttagtcaaaatacttgggaaacatgtagttttttgttttttggtttttttaaaatctcaatgccttgtcagtttggcttttggggtcccggtctttcaggtttctcactatacctttgaccgcatgtcatcctctttagcaccccccccccacttttttttttccaagattctcatttgttaagcactaaccaggtatcagatgctgtcctgcgcacttgggatagagaatgggaagaaagatccccgcccttctggagcttctacttcagcaaataagtgcataaagactttgggtaccagctcccatttcctcactgctcatgtaatttcatgccatatgcaaagcgatttccaagttcccacctctttgcagaaactgcccttggtttggttatcagtgacttaattgccaacccttatcaatttgtgtctactttaacctttgaaactcttattctttgatgcctatgacacagcttttctctgtgttgaattaattattaaattagtaatgactagttaatacagtctccacattgacatgaaatgtggttataattgagcaggcaaacttgagtctccaatagacattgctgtggaaaacaaagttgagatctagctaaaaccattggaactaacaggttgagattataacagtaaaatattcacttagctgctgttatttcaagtcttaaacactgaaattatgtcgtgtaccaacactaaattcaagctgtcattaatgaataacaacatgaaattcaaactgtcattattgaataacaacagaggagattaaaactgttcccaacttgcagttattacaaatgtgctaacaaacacaatttgtgttccttgccccttctaccgtcttggaaaaaaaagcaggtttttttttttttggtttctgttgggtaacaaagaatttatgctcaccaagttatatgatcttttctctgcctaactcttaagtgtcctacctaccatccttgtgcaggcttcctgggtgatctccccatcttcaggacattctctgagcctactccccaggtctttctacaactcgggtttttcttctgggcaccagccctgaagacctagccacttagagggcctctttttctgtctgttctcttggcctcgtaagtccatcatgtcatgacacctctttatctctaacctctgaacacccaagccaaaacctaagccatcccctactctcagtctccccttggtcaccagtgcctgctactttgactttagtatcactctccccacatctttcctcagccttttccttgacaggtgcagtattttaactgcttccctgtctttctagtctttcccccttccaagctcttcaccatactgccaccagtgaagtttgaaaacaatagttggccggacgcggtggctcacgcctgtaatcccagcattttgggaggccgaggcaagcagatcatgaggtcaggagatcgagaccatcctggctaacacggtgaaaccccatctctactaaaaatacaaaaacaaaattagccagtcgtggtggtgggcacctgtagtcccagctactcgggaggctgaggcggaagaatggcgtgaacccaggaggtggagctttcagtgagccgagagcgcgccactgcaccccagcctgggcgacagagtgagactccatctcaaaaaaataaaaggaagaaagaaagaaaacaatagttaacatgtccaaatcccttttgcatccctcactgactgaagggataggaaggcaacaagccagtagaagagaaaatgctttgctaaacatcatcgtatgtctgtgtcttatttttcttttttgactatttaatcttatttcacttaggaccttggttatttatattagttgtctataggcagtggaacataattaaataccattttctagttaaattcacctaagacaacttttaaacaaaactcttgcgttaaatgttgccattaatgaagcgttgttaacttgcccctctctgcccagcaccttccttctctgacttcactgcttggggagcatgctaatgattccttggtgttaataactttgcaattcttaaacaggtgacattccaagcctgcagtatatctgaggccagatacctttatgatcagttggctactatctgtccaattgttgtaagtagaaattacctcttattttaaatactacttcgtatgaaataagatagcatgtgcagaatttactgacagtgtgctatttaagtccagttaagacctcagtcagagatggactaatataaatagtatgtaggtttaggtataatgaactgagagtctacactgtagaagtttactcttgctagtacaacattgatttgttaaatgtgaagtttgaatgtggccattttccctcccccatacttcatgtcctcacattagagagaggatgatttaagtgaatcaaacccaaggaactggattcttcctggtatatttcactgtaagataggcacaggtacatgtgctctgtatgggttgcataaacatgctttttgatcagaaatataactgcatggagctttttttagcatgtaagtgacactttgaatttgcaggagctgacttttgtttgtttttagatggctttgagtgctgcatctcccttttaccgaggctatgtgtcagacattgattgtcgctggggagtgatttctgcatctgtagatgatagaactcgggaggagcgaggactggaggtgggaattgtttttccttaatagcccttttaagtcaagcaggtaaaatggatcttttgtaactacttgcaatttcaggatgtctccctgcaatttttatctgaaatggggaaaaagatttggtctaggtggggagttaatttttatcgtatgttgatgtctgtatttgttttagcttcatttaaaattagtagtccgatttttctatattttggaagtgctgatggctgtttttaccaaaaggctttttggtgccacatgagtgttttgtatatggtgctttctgctgtggaaagtataatttgttgtcagagattctttttccatgtaaaaggttaggcattgactaataagggtgagatggcacctcttgtttgcatgttgaactgtaaagtaacccttgcatctctccaacaaggggtgtgcatcagaaccacccatggaaatctttgaaaatagacacccagaccctatcctagacctactaaataagaatctctaggatgggacccgaacaagggtgtttttaaaggagccctcataagtggttttgatattctcaaccagggctatactactactgctctggtcttcatgtaattgttcataaattgttgaacatgctttctaagtagaaataaactttaaaggataattattttgataggtttatcttacgttatagatttatttatttatttgcttttaaccttagtatttattttccctagcttaataagaatgaaagtgatctgcttttaaaagataaaagtatatttaaatcataccagaaaaaaagggtatttaaattgccttcagattttaaaaaacataattttccttaataatactttttagggctcactaactttttttctgtatcttatgttgaggtttttatataattatcatatataaaaatatattccactcattttatatagcatattcatttatatatatttttaatctttagccattgaagaacaataactataggatcagtaaatcccgatatgactcaatagacagctatttatctaagtgtggtgagaaatataatgacatcgacttgacgatagataaagagatctacgaacagctgttgcaggaaggtgggtttctactccatctttctgggtttgaatgtacgcctttagttcttcaaagctcttttacacttttttgctgactcctggtctggtttctatttttagtgcaaagtctttaacttctctcatgaggctacttgttcctaaagtttcaggttccaaatacttgtgagattttcttgatttttagcaaaaggagcttactttggaggtctgtgtctaggtccacaccagtgccccagcaggcattgtgtaagtagtgaataaaacgctgacactcccgcagtgtccgcaggataaaatactgggtgaggtgaggatactaatcaaaccagctatttcaagcttctagacaccctttcttcaaacttcctgagctatcctgtcgtctttctggactaagaggaagtggtatctctcgctttgcagtgagttcccatgtgatctctttttgcaggcattgatcatctcctggcccagcatgttgctcatctctttattagagacccactgacactgtttgaagagaaaatacacctggatgatgctaatgagtctgaccattttgaggtatcttctcagttttatttttatttatttatgtattgacttctgagagtctggaatcctctgttttatatgcatttcacttcacaaaccaacatggggaggcagttttctgtacctgtggagaacacaaaagaaatttcataagactttcatttacccagtgcagtaaagaacttggacaaataaaaaatcggtttcaagtactcttattttacgattcttactgtttatctcactgattctaatttttttttttattgttcagtattttcttatttgcctagtggtgaaaaattcaaacatacactgcacaaaaaataacctgatcagttatttcagtgcttcagacatatcaccttttttttttgtagatagacttctcatagatttatttctgtgtcatgttatatgtagacattgacatatataccttttgaaataccatctatatcccctttctttcccccaccaaactcacaaaaggagatataaatccttccagtcttgccatcgggtcccaagatggtcaggacggagaaagaactctctctcagtgtattgagaaacagctacccttcttaggctcttgggtcatcgaagcagcagcattcccaggagaggaggaagaaaggaaacaactgtcatgtgacagggttctcagatgaaagtgtccagtgtcacctggaaaggcaggctggctcctaaaattctcagggatgaaggtgggggccccgtggctcttcagatgctgctctgtagctgggagatagggagtaggagctgggtgagattaagcttgcagtgatagggcctcatagcttttgttaaacacttggctgttttgttttcctaaaagagcacactcgaagaaaatcttcaattgtacctttttgtctttgtcaattgaaatttggtatggacagtgagcagtcttcttccttaattaaataccagatcatcttaatattttcctggatgtgtgaaaagttggttttcttctctgcttttgtatcacagaatattcagtccacaaattggcagacaatgagatttaagccccctcctccaaactcagacattggatggagagtagaatttcgacccatggaggtaagacacatgcatcagcaagaactgactcaaaagtactctttcgccagctgttcatcacccttctgatgctgctatgagaaggctcttatatataaaataaaaattaagtatgtgcatggtagcaagtcagtccaagttaaggagggttgatttctgagaatagatgtgggcaaagggcttccagacccagatggggaattaggagatggcttgggaatgacatgatctgaggaagggcctgggtcagggaagagcatgtttgtgtagttggttcataacttctctgggcttctgcttgtctaggtgcaattaacagactttgagaactctgcctatgtggtgtttgtggtactgctcaccagagtgatcctttcctacaaattggattttctcattccactgtcaaaggtaaggatatgtttctttatggtgatgggtatagatctatctgtagatatatttatttatatatgctatttatttcccacctgatttcatttgaaattgtttaccctttgcaataaaatgtttctccatcagccctattctttattttcttttaaacctaagcttaatttctagacgctttccattcaagatgattgatggctagaagtagtcctacacattgatttcatccaccacaaaatcccaggttgattacaatgttaaattaggatggggagggaaagtgtaactgctggaatgccggtaaaagtctcctcagtagaactgaacttgagatatttctgaagaattcggatgggattgaactctcagaaaaacaaattggagttaatctgccccccaaaagaccaaaaaacaagctttctgggaggagtttgccagcaaaacaactccaggtgatgagggagcagagctgtgggttgtggagcagtagctgaggaggtgaacgcctttggtttctgggccagggttcctcttggcagagagtggctgggaaaaactgctaaatagagagggccctgccgcaggggttcctggttgagggtttcggggccagagaatggagaagtagggtagccctgtcacagcaaacatggaagcaagaatgaaactgcttagctccagcatctgcccctggggcatctccttcctccatgaggggtttgccagactgtgctcatccccacaccccctgaaggaaatctggctgtcagcccatccctgcctgctcctcacacccagaccaaaggtcacccacagaactctgtgggcccacattgccctcatgcctacctactggggagaccaaatccatctaagagagattccatgtaagctaccagtctaagcctttgcttataaataagaatagatgcttggaaggcaacagaaaattgagaacaattaacagccttaaagagaagggcctactggtcttgcaagggcatactctgtaaagtcaaacttagttacttcaaggaagtaagctgggcccagcgcaaatctataatctctgctcctcaggaggctgaggcaggaggattgcttgaatccaggaattctagtgcagccccgacaacattgccagatcccatctcttgaaaaaaaaaagcaactggaaagaattactattttttaaaaaatacttttaaaccttttttagagacagggtctcactatgttgctcaggctggtctcgaactcctgggctgaaatgatcgtcctcctgctgcctcagccttccaggtagctggaattacagacacaaaccaccatgctcagctttggaaagagttcttaaaggaattctaattagtggcctcagacaaattctagagaggttcagtcacatccataaaacaagtattatagattgtgcttatttaatggtgagtattctcaccagtagagcagatgttgaatatccaaggtagtgatttaaaagaccaaatgaagattaatcccagcaggatggtgaagaaatggaaattatggaaatcctgaagcatggaaagctctggaaaattcaatgtttgtgtaataatttagaagaggagaatagtttatataggaaagatatacaataatcaaagaaataatagaatttttccttaataagtcttccttaaggatgagacaaatatttaactcaaatgtaggcatttattaatctcaaagagaaaattaactgtccggacaggagaaaaaattaggagacatgaaaaggggggaaaatcaactgatattacttttcatttgcaacattaaatgctagatggaaagaagttttcagaatctcgagaggtaaagaattaacaaccacagaattatcttctcagccaaattattctttaaatttcaggtgattctaacaaaactgaatggatcaagttagggctaaaagtatgccagaagtcttatctagtgtcttggtttgtttgggctgctgtaacaaaaataccttacagtgggtggcttataaacaacaggaatgtattgctcacagttctggaggctgggaagttcacgatcaagtcaccggcagtttcggtgtgtggtgagagcttttgctctctggttcatacatggtgccttcttgctgtgttcttacatggtggaaggagctaactagctcttcagatgtctcttcgtaataccagttatgagggtagggccttcatgacctcccaaaggaggtcctcccaattgcctcccaaaggccctactttctaatactgtcacaatgggcattaggcgtcagtgtatgaatttaagggaacacagacattcagaccatagcaccttgtaaggggatatggaaggagatgaatggtagatactcattagtgcttgacacttagagagttataatttcaaaactacctctttaaggaaaactattaatagtatagaaacaggatttattacttttaaacttgctggcgaaagggtggcaaaatgaaccacaaatacatttcagtgccacaaaattgggtgtggggccaggggagtgatgaaacaatagcccatagaacataaagtggtgaaaataaaatgaaaacaaatttgaatagactaaactctatcctattaaacagctgaaacagataatataaaatagcaacacagtttgcataagatgtacgtagaacaaggacagatgccgacaagagctgcatagtgaccttttggaatgatagcaggaatggcaaagcaatatcaggcaaaatgtgaggtagaaattattaaatgggatagagaaagcagttttatatattcttccaagatgatgtgaaagctgtggtcctttttgtaccatgaaatgtaacatgaaaagagtttagtgtgatgggtaatacatggctttgatgtgagaactaaatgcataaatccctggtactatttactaggcttttaacctggacaagtgacttattctcagtgcctcagtttcccacatgtatcccagaggggaataagtaggctgttgtaagcccgtgtggggattaatggaggtaaaccacttaacagagtaccttgcatgttactcagtaactgacaggccatataatcaaaggatgggaaaggccatgggggaattaaaggcatggttaataagcttggttgtatgcgtatattacgtatctcataccacatcttttttcaaatgccatgagtaagatttacaaaaattaaagaaaatcttcacttctcaaaagtagacataatacagcatgcgttcccgctaaaattcaacgaaagagatactctggagaaatttaacattggaaattaaaaatgtctttccaagtagattttagattaaccaaaactagaattacagattgtgtaggaaagtgaaagacatgctggcagagctgatgtctaaggaaaaattatagctttaaatgtcttaacaaaaagattttaaatctaagtcattgagtatctaaagagcaaagtaaaatatactttgaaaggaagtcatcaaagcacaaattataagtggtcgttatgaacttttttcaagactaaggaaaaaagaaacaaatattaataatgaaagcagatgttcacagccatggtggaatgtatactatttatttgagtatgctcctagagtatctagattcttcagaaggtcctgtgtgtctcttaaaaaatgaaaccataacaatcgcactccctgcataatgaatatgggaggagacttggtaatcaagagagcttatgtaccatctgtcccatgtcagcctggccctctaactggtcactgttgtatatattgaggtcccacataagatttcattatagaaaataagggattactactaaaacgttttttaaattctgctttgagagtcttaaaaagtcattggagatacagagaattcacaaataaaacagttttcggtttcatgagtgagtctacatgtccggaggcaccagatgggtaaaacagcagtgatcttctgcccttgggagggctgtaaccttattccagatatgacaacctatgaactgtctttgcctttcctcactaaagtggggaggcaaaaccccaatggcgaggcagcaggggaagagcactcaacttagaagaaccgggttataggccgggcgcggtggctcacgcctgtaatcccagcactttgggagtctgaagcgggcagatcacttgaggtcaggagttcgaaaccagcctggccaacatggtgaaaccccgtctctactaaaaatacaaaaaaattagccgagtgtggtggtgcaggcctgtaatcccagctgcttgggaggctgaggcacaaagaattgcttgaacccaggagacagaggttggggtgagatgagattgcaccactgcactccaacctgggcaacagagcgagactccatctcaaaaaaacagaagaagaactgggttctagtcctgccttctgccttcgttaccctgggactcctggtgagacactgctatataaagggaaccagccacctgccctcccaacactgtatatctgttgcaaggctcagtcacagaggtgctttgaaatgcagacgttccacatgaatataagttttgggttttaagtttctcttaaaattccctgattggttgaaaaatcacataccaatccatgattgagtgatacagtcctcacataaataaaaagcctgttcctcccactgggaagcatttgagcagaaagtagaatccctaagggaatgagtcctaattgcaaaggtgaggaaggtgctgcaacttgtatgtctgatcaagaatattttgacttagtcgtgattctttttttcccttaggttgatgagaacatgaaggtagcacagaaaagagatgctgtcttgcagggaatgttttatttcaggaaagatatttgcaaaggtattacattatcttagatttctaatgtcagcttatgctgcaacaagctgctaaagctcccctgaccctcttctccggcaggtggcaatgcagtggtggatggttgtggcaaggcccagaacagcacggagctcgctgcagaggagtacaccctcatgagcatagacaccatcatcaatgggaaggtaggagggtggccctgtacagtacgcctcactgtgcacatcccccggcagggagttcataaagtgtcctgcttcttgtaggaaggtgtgtttcctggactgatcccaattctgaactcttaccttgaaaacatggaagtggatgtggacaccagatgtagtattctgaactacctaaagctaattaagaagagagcatctggtatgatatctatttttcttaatctcataatatagacagcatggtataatcttagaatgttcaatttcttaaagtagtcttttaaaataatgctgtattcatgcacagtttcacatttttatatttctgcaattgtattcaccttataatctttgacactcataatttagattagtagtgctttttttcttatcagttcataaaataggggtgcatctgaaaatcactggcatcttagatgatgaaatggcatctggattgcttacttatcatttacgtccaactgtgttgatcttacatcatcatgggcccttttatagggctaaggaactctgtaagttaaataagctgaacagttctttagcctgcctttgtacatacagtgaggctcctgagaatcccctttctttgttagttttgaggaggttacatttacaatacagtacagtaaccaagtactgctaacacagtacttggcacaagggagctgtcagctgttaataaagtgacagcaataatggtaatggcatctgtatttaactcaaggcttctgtaaactttctggagtcacaaaggatagccgtagaaccctacctcacccctcaaatggtatactgccaatttcccacttcattcactctacttactgttctttattctctccacctctttgatcaaagatcgctcaaggaccctacagtcctctgaggcagtctcatgacactggcatttgtagtcctagccctctggccaaatgggagggcacatgttcttgtacacatgtgctggctcctgttccttaagagctggcagtgtcagcatatgggtggcatctaacaggtaccatagaaactggatgtatgtgttctcattgcctgcctgcaacctagaattcctgcccaggaggagttcttcaaacgctatgaaagatgttcccaccccctgccatgcagctacactaaaaggacatattgatttctctccagaattgtgtttatgctgaccactaaatatcaacttattaaaaaaaaaacttacgtggttttaatttttttttcgctcccccctcgcccacaggagaactaatgacagttgccagatggatgagggagtttatcgcaaaccatcctgactacaagcaagacagtgtcataactgatgaaatgaattatagccttattttgaagtgtaaccaaattgcaaatgaattatgtgaatgcccagagttacttggatcagcatttaggaaagtaaaatatagtggaagtaaaactgactcatccaactagacattctacagaaagaaaaatgcattattgacgaactggctacagtaccatgcctctcagccagcccgtgtgtataatatgaagaccaaatgatagaactgtactgttttctgggccagtgagccagaaattgattaaggctttctttggtaggtaaatctagagtttatacagtgtacatgtacatagtaaagtatttttgattaacaatgtattttaataacatatctaaagtcatcatgaactggcttgtacatttttaaattcttactctggagcaacctactgtctaagcagttttgtaaatgtactggtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcacttgaatccattgaaagtgcttcaagggtaatcttgggtttctagcaccttatctatgatgtttcttttgcaattggaataatcacttggtcaccttgccccaagctttcccctctgaataaatacccattgaactctgatggctgttatcaaaggaacttttctttgtttaaatttgctgatgcaggaattaagtttaaacacaactctatagaaagaaaggagattattacccagaattcacatgtagtgattattaaggacaatttttttttttaactaaaaaagttggcggcaggggtggggggtggcaatcatttttcttcctatacatacaaaggatattgtcaaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgttttttttctcaactagttaagtcaactgcttctgaaataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaaataaaagaatggaattagctttcattcagaaacctttgagtgtgtgtgagttccacagctaaacaaatagtagaagagtttggtttttgtaattaacccaaataccatgaaattattttttcatcattgcgacctcagatgtttctagaaagaagcatagtgatgaagacaaacagatgccgtatctcccctagtagctatcaaccccggtggggagaaagaacttgaagtgtgactgaattgactgctgtgccactggaagattttttttttcttttttactcccaactgctgttgtgctgggtcagtgggtacatggtgaatgaatgttgagtaacctgggtgctgtgcacactgcagtctaagcaggagatacttttctaagcaggagatacttagactgtgagtcagcaagtcctgcagagagctgttttcgactcctgtctttggatcagtattcacccacacacacacagagttcgtgaaataatgttcatctgagaaacacacttttctcagagctctaatttctttatttgaatgttcctagggcagtgcttatcaaactgtagtctacatacaaatctctttggggtgtcattctggcttggtaagtctggggtggggcccacatttcttaacaagctcccaggtgatgctgatgctgtggatttgctggccccatgaataataaggactttctctacctgagttatggacacatcaatatcaagtctcaaataacacttgcttttaagtctaatgtgatatgtctacattttctcttattaaagaccagatagtggtcttctttctccaggacagagaatgtaagcctcacagctctcatgagctttaccatctgaacacagctaagaatttgggattttaggaacagaactgtaaatcttaaaacaagcaaaaagtgctttctccttggtagaaatacctgtggccaagcccagaccttcagatcctaacttgggatacaactgattgttacttaacctgctgctaacctaaagactagttttctgctcatctagtcccctgtgtgaataagaggtttcctcctggtcccaggatgcctctgctgctcagctcatctctgaggctgtctgtgagccttcagttcagaaattgagggaaaatccattgccttggatgtctccttccaaatcaccacccaaaacaaaaattaggagacgtagaaatccaggatgtgttgtg

SEQ ID NO: 11956 - DNA, 20713 bp, Human
  misc_feature (1)...(20713): n = A,T,C or G
tgaggtggagatggagaagaaaggattattggaaatgggagcagagggagaaaggaaggagcttagaaaggaagaggccaagtttccagcttggatgactgggaggcaagtggcacctttgattaaaatagatcatacaatgaggaggagaagatttaggtgacttgatgagctcagagttgcacttgctgagtttgaggtgtctcaagcatctcagcggcagtgagaggtccagcaatcaataggtagatggaactgaagttcaagggagtagcgaaagctggggatacggattcagaactcaccagcctggagatggtatgtgaaaccatgagataacttgatacctcccagggagagtttatgacgtgaaaagaaaaatgggacctaaccagcattcttagagacaggatcttgtagcaacagagcagaaatctccaggtagaaacaggagaatcaagaaaatatgaacatgcggagtcaaggaaatgcaaggtacccggaacaagcagtaggcaaatccaatcacaaaggagcagaaacaaactacccagtggatttggctataaagttgtagctacatggttcagattggaatggagaagccagaagagggatggaggaactgactttgaaaaggaggaacatcgccttatcagaagttggagggggaaggggtggaggatggagaccagtatttatatgtttataggggaaggagcaaggtcaggtgttgtggcctaaattgtttttgaagtagggtaccagatatctgctgagaaaggtggtgtgagtgggtgataatagctgcagagaccatttaagaggaatgggaaggttaagagtggccactggggagactgggatgggcacctggccagactgaatggatcagtgggtgatttagtgggcccagttgtcacaagttccacattttagagactatttattctccagttgctctgggagtagagaaggtggcttgtagcaccttttctttttccaggttgaggttttgtagaaggtgttaccaatgccaagaccctcctgctcccttgactccagttgccttggctccttaaggagtcccagagtgacagagaagaagcagtggccattttttctgcaaaagctttggctcttttatgaagtccatgatttctaccatgtcatgaaagccaggtccaagcctggagttaataagtccaagatcctctacagcctcttctcagtctcatgccttccaatctctagggcagcctacatatcaaaagggatttacaggggctactctggtgcttcttttgtccaagaacctttgtctgtcctttgccattccaaaatccatcatcaccaaattagccattccaaaactgctcagcattagaaatccggagttgggtagattctatggaccaataaatggaatttttcgaaacatccacactcccttctttcctttcctatgtgtcctcttagtctaactggccccaagctcagtggccttcagacagaagcagaaatgttccaagatgattagctaggaacacaaggtacaactgaaaatccattgtgcaaacaagtgcctgtttgattttctcttcacttccctttgggtattaagcttcctttcaattcgtgtttggtttctggtaataaatatggcaccagtttcattgattgattatgaagattaaatgtgagaagtcaagaacgcaaagcagtgcccagcatgttcagcattcagcacacagcactattgtttgtaggaagcattcgcacaatgctgagacagctggaagggttgacattgtgaggggagggcccttctttcaccatcctttgcgtaaatggcttatctcacctccactcaacaagcccagtgtatggcctagaactcccatcatacctgtgcaccaattgaggagagacacatgggtgggaaattgcaataaaaagacggcccacagcaggctgcattcccatggctggccagaggaggaacgctttgtgttctcatcggaggtaagtcctgctttaagccccaggaggcttcctcctaatcctgggaaatcttgatccactggacatgctaggattctttgtttctggaaatttttagaacccagcaagtagtttggaccctggccattgtcaagtgctccaggtaccactctatgtccaactcagtcatgcttccagtcatctgcgatgctccaggcctacggacgccaccctcttccttgtcccagatattcccaccagggaactaggtctctattgggatctcatctctaagaatcaccaatcctgggtgcttccctatccctgctgtctcatagcatactcatggtatccctgcccgaaaccgatctctattttccactgaagtcttccagaggttgtaggaagttatccaaagatttggccatttagggaaagtatttcccagaaaagtaaatgccatccaaatgctggcaggcttttttgcagctctttctttctgcctcgccaccgcccccaacccccattgatttatttattcatccttaatcctctactgagtactccttgtgtgccagattctgtactaggagcaaggaacatggggctcggtttggcatggttccacagtcacagaaatctacatccatagaggacatttcagggggctcttagcagcacccaatgcataaaactaagaaagggcagccattacttttgtgtgcaggtattcacaggtaccatatccctttttctctatccaatctccaaagagcctctacttccacctgagcagggaccatcctgagacctttctaggacattctgcagtactagccagctctaagcttgcctttggtttgcttactgtcaattttatcacccattatctcgctctatctgtccataagtcacacctactttgaaacaatgcagctctttatgaaggaagtcaacggatctgtttctaagaacatagacctatgccctaatcttatcttggtcttttctttcccatagctgcatgggaagtctgcatacagcaaagtgacctgcatgcctcaccttatggaaaggatggtgggctctggcctcctgtggctggccttggtctcctgcattctgacccaggcatctgcagtgcagcgaggtaagtattctgctcacctggcatctcagatgtcaaggaagacctagcaagtgaggatagaagtgcagagaaggtggctcaggtaaggaagaggaattggcagttctaaagcaaaaactcagagctagaagtcaagggaaacataatgagaaacaatggaaatcaagtcacaatctctcaaagagcctaatcagaaattcctctgaaagggcagtgggagccagttaacataatttcccatgcccatatctttgggagattagagaccccagattaaagaagatcaagaaatacataactcagtcaccttgtgctggcaagtgccttctccttttcctgaaagggctagattaagtgatctctttatgaagtgggcaattcagatacttgcagaaaggagtctcaggcttagaattagagtgcaaatttcagcccctggaggagggtgggagagggtactgagctcattggaggcctccagtggaaaaatacaatctaagaataacaaatgcagtgattccttgtcttaaaataagtacatgcatgagcaaagtttgaaaatctttttttctgaaaggcccttctaatgtgtattataagcatgtgcaaagcttgaaaatctcttttttttagaaagcccctttaatgtgtattgtaagcacatgatcctgtgtgtgcacttagctccttcttcaggcatctacagcattcaacaaaatagaactagagaagacaattagcttgaccctggtgctgtgcttggcattttacacatattatcacatttaatcctctaacaatcgtttaaggctttctttccccaaatgaggtgtatatattccaagatggttctgggggtgcctggcaaactcttaacaagtttttaatggctgtatgtttattttttatgcacatctaaaaaatataactagcacatgatatctatgttatcacagatattattctttaagatgaaactaattcttaaaagataatcattgaaagaaacattttaagtcaataataggacaggcaaacacatgtatgacaaaggtcatgacccaaagcataggaacggataaagtttgagaaccactggttcacaggtgtggttttgccaatgagtctcaggggacttaagtcacctgccaaggtcacccagccagcaggtgtagaattggatttaaactcagcctgaccagcctgtggtcttcctccttcacttctctgcctcttcatacatcacagtttctaaaactgtttttaaaaatggtagatcaacaatcagaaatggtcttgttagatcagtggttctcaactgggggcgatgccccccaagaagacatttggcaatgcctggagaccactttggggcatgctggtgggatctggtaggtagaggtcaaggatactcctaaacattctataatgcacaggatggctcctccagtgaagaatgacctagccaaaatgtcaatagtgccaaggttgggagttcttgcaatagactgtgctactggtatggaaaaatgtctatgttatattaagtaaaaaatgcaagtggaaaaaaagatgttgcacagaattaaacttatttttatttttaagaaagcaatatattttaaacttgcctaagaagaaggctatattacaaatttattgttacttctggggatgagatgggcttatgacaactttcatttctgctttattaattttaatgatgtttgaggttctttttcagtgagcctgtattacatttataatgagaaaaacaaatattggtcaaacaaggctgctgtgtgcatgatgcacaggaaagaactttgttactctgaggcagggagggaggctgtgcaggacggtagccctgctgtcctcaatgcctgtaaaataccacagaaggtcctcactgattattctgcccccaaggtgatgaagttgatgtttaattaatggaccgtgtgtgtattgtcctcattggagtccttagcacagccaaaatagagcatggaggggaaaaaatcctgtaggttctggcattgctcagtaaacccaactgcactctgtcactttcccaggttatggaaaccccattgaagccagttcgtatgggctggacctggactgcggagctcctggcaccccagaggctcatgtctgttttgacccctgtcagaattacaccctcctggatgaacccttccgaagcacagagaactcagcagggtcccaggggtgcgataaaaacatgagcggctggtaccgctttgtaggggaaggaggagtaaggatgtcggagacctgtgtccaggtgcaccgatgccagacagatgctcccatgtggctgaatgggacccaccctgcccttggggatggcatcaccaaccacactgcctgtgcccattggagtggcaactgctgtttctggaaaacagaggtgctggtgaaggcctgcccaggcgggtaccatgtgtaccggttggaaggcactccctggtgtaatctgagatactgcacaggtgagcagcagagccctggaggaggcagctacacagccaatgagatgcctcccaggctcagtagagtgagtggagcaagtcaagaggagacaggagaggatgcagagcagcctcgactcagctcctgcccagtgagaactcaacacaggggttgagaccttccaacatttcaagccagaaattcccattcaagggtgaaatttcctagtttataaatgtgtgtagcataaaatccagaactcatgctcgttccgattttggctccatttgagaagtttaatttgcctccctgagcctcagtgttctgatctgaaaaaaaggggggggggtaacagcaaaaataacagctaatacataatgctcacaatgtccttgttgctatcctaagtacttcaaatgtattaactcatttgatcctctccccagttccacgaggtaagtgctacctaattaccccaattaggggcacagagagattaaggggctctcctagtatcacagagctggagcatggtacagctgggatttgaacttggcattctagctccagcatccatggccttaaccaccatgctgtcctttctcattttgattgaataggctaatacattccttgtccttagaatagagtcttgcctgtagtaagtgttcaggtggcagctttagggctctcacttatcccattggactgggagtcaggcttgatgcttccactaagtatcacacaaccttggcaagattcttgtgccccggtgaaatgaaagggttggacttgggggcctcaagtccagcccgcactgcatcctgatcttctctctccatgccccatcacctagacccatccactgtggaggacaagtgtgagaaggcctgccgccccgaggaggagtgccttgccctcaacagcacctggggctgtttctgcagacaggacctcaatagttctggtgagctgctcactgggcaagtaactaccatcctgagggggcagggcaggagggagggagctttagagggtcaagataaggtataaagcagagtcaggggcatggacctgaggtcaagggaatgtgggctctccaatccatttgctgtaaagccagtgggtttgcaaggataggagggcagggttggagcaaatttccaggtcagctgctgggccgtggcctcaggaaatggttctgacatgggcaggcttgacccctgagggatgaagacactgaagatgataattctgctaatgtaggagctatgttttcatagccacagggtcttcatgtcagggacatgggcagacttctggggacaagtcactactgtctctgagcctgaatgtcctcatctgtaaaatgaggataaggtaataataatacccaccatacagggctattgtgagaactaaatcagagcagtccaattgggcaggctcaggaggtgatgaatttctcgtcccaggaggtaagcaagcagagtgagatgtcccatgggtagggatgtcatagacaaacaagcactaagccctggacaggggatggatgagcctcccactgagattatttccctccatcactgaactctaacaagggcctttgatcttgcctttggcacaagcatgccttcctctgagcacactacaagtccctatggaagagagagtgttctaggcagcaggacaagaaggagcatgacacatttggaaaacggagccacagtgtgaacagggcgatgcttagatgtgcccagcagaagcaccctgggaaatgaggggtagggaacaaccaacaaccttgatctccttgaagactctttctgctcattgagtggataaggccccagagattcagtgtggttttctggggtttgggcccatcacagagtcagattttgggctttaaggaggccctccctgtacctggatgggctccaaggacagtctcagctgactgagtgagcaggtggcctgcctcaagtcttcatcagtggccagcacaatgatgagtgtccagtgggccccattgcttgcagacacatccctctgtgctctgactttcacttccatctccttctcccacaccctgctctcattttaggttcctgcgcctctgaactctgaaattccacaaatgcaccattccctctatcccatctccatgcttttgcctctcctgttcccttagcctgggatgcgttcacttgctttactgacttgcaaaactcctacccacgtttcaaatttcataccactgtgaatccttccctgacttcaccaagagactcagatagaccttcttctctgctccccctccatctgtacatacttctgtctgtatctttatcatattgaagtataataaactgttgatatgttggtgtttacacaagaccaagaaatcctcatgggccaagtccatgccttatttacttcatgttgaatgcacctagcatttgagaaggtggttggtaaagtggctcatgcctgtaatcccaacagtttgggaggctgaggccggcagatcgcttgaggtcaggagtttgaaaccagcctggccaatatggcaaaaccccatctttataaaaatacagaaattagccaggtgtggtggctcatgcctgtaatcccatgcctgtaatcccagccttgggaggctgaggcaggagaatcacttgaatccaggaggcagaggttgcagtgaactgagattggaccactgcactccagcctgggcaacacagcaaaactctgtctaaaaaaaaaaaaaaaaaagagagacagagagagagataatgtggttggtaaatatatattgaatcaatgcattaatgaatgcaatagaaactgtcttcctattagtttactatttgtctcccctattcaactgttagctctataagagtgggaattttttcagttttgataagtgttgtagccccagtgcctggcagatagtagattctcaagaagttgtgtgttgaataaatgttgagttaaaatatgatagctctgaacttggtcagatgtgctgactcaacaaggtagcatatatctaactttgattctagtatggaatgcaagtccatcctgcctccccaaataacacaatccccaagaggaactagactaaaaaaccttagcaagcctgcacataggacacttggaaatcttgaatgaggggccccctttgccagtcccacctactgccagcctaggcatgaattccatctggatcccagggaccttctagtctacataatcttctgggtcatggagatgttaccaaagagtagggaaagtgggcttccagactcatgtccattctacttgccttcatctctgctttgcagatgtccacagtttgcagcctcagctagactgtgggcccagggagatcaaggtgaaggtggacaaatgtttgctgggaggcctgggtttgggggaggaggtcattgcctacctgcgagacccaaactgcagcagcatcttgcagacagaggagaggaactgggtatctgtgaccagccccgtccaggctagtgcctgcaggaacattctggaggtaagtggctttcacaccactgctgccagaaggtatgtgttgggctgatgggacctatcatagtagctctgagatcttggacaagccacttagcttccctgagcccccagggttgtgtgagagtgcacaagttggtttacataaagagcttagtataagtctgacatgtgagtttcataaacgtaagctacaattatgataatttcaattagggatggtgggggagggatgcacagagaagcaagcttgttggttcctgactcttcccaagggtcaataatttatcgttctagttttttgcctggtttcctcattcgccttcccataaagtgtcagtaacactgaaggaagaggtcccttgacctccatgagctcagaaggtagggtggctgcatggttaagcaaattgactctggaaatcagatctggatttgagatacacctacatacacatacacataaacatctgtatggttttgtttttttgccaaagagaaatcaaacccatgccatctacaaaaacaccctctccttggtcaatgatttcatcatcagagacaccatcctcaacatcaacttccaatgtgcctacccactggacatgaaagtcagcctccaagctgccttgcagcccattgtaaggtatggcattgacccttgccctttgacccataaccctggcaatagtcacatcacacttacttcaagtgcagactatgatgtccacaccatactgccagcctcctccaggagcctccagtcattcagtcattcattccacaagtattcattgattgtatattaaagatgttcagcatgaacaaggcagacatagactattccgtggctattaaagattgttataactaggcaatgcagcaacatgaaacagtgcttactaaatgtgctagaaaacaaaaacacaggacaagttcaaagttcattcaccttgaggaacaaaggtattaaacaactaattaaaccaataattacttataagcaagatgagtacaatgtaaaagaaatgtggggtgctttgggagcagggaacaggggttccagacccctgttggtggtgggtttgatggggacagaacagcttccctgcagacgtgagatttaagcagagaccagcttttatcggataaacaggcacccccgtccccagcagaaatagcatcagatagcaatttgggcaggggcttttctctgttttgttgtgtttctgtgctgaaatggggccctgttgaatcagttccttagcatccctagacttgctaggggactttctgagatgtcaaaaatccagagtgcccgtctcattccctattgctccctgggatcacaaagcaacaggatcagaaggattagacattttctaattcagtggtttccagatggtttggtgctggggctcctggttcataaaaaatcaaaatgaaagccatttatcttgttaaaattggtgtttcactgaagactgtggaatgcagggaagagatctgttgctaaaaaatgtgaacacacagaactggttctcagccccactctgcaggtgagaagatggaggtatacactcagttattccttcagcaagggagatatgtgtaacctgtcctgcagggaggatcggtggaaatcccagagacagacttgtctgtcaagtttagtgcctagaagctaataaatgctcagtttaaacgactgattgactagttcacttaaggatccaagatgtgtgtccttgccttcgtaagtgtgttaagtaagtgcagggcttgatttatgttgttctctgaggtttccactcttgtggctttctttttctcagttccctgaacgtcagtgtggacgggaatggagagttcattgtcaggatggccctcttccaagaccagaactacacgaatccttacgaaggggatgcagttgaactgtctgttgagtccgtgctgtatgtgggtgccatcttggaacaaggggacacctcccggtttaacctggtgttgaggaactgctatgccacccccactgaagacaaggctgaccttgtgaagtatttcatcatcagaaacaggtaacgagcaattctggaattatcatttggccttactaacgtttacaggaaagtgttcatctcatccatccccagcagacgtgtaagttgtactacatatcataaccacaatctttgacccagaaatatcactcctgagattttagcctaaaatattaatactaaacaggtgggcagggtaaataaatgtcaatattttccatttcaatatcgttgataactttggcaacaggctgattgttcaaaaatagggaatcaatttggtagtgatggattattacacagaagtgaacactggtcaatatgaaaacaatatgataaatgttgtggggtgaaatatcattaaacatgcccggctgacaaaaacaagggaaaaatgcatttctatagatcatgatttaaattatagtaataatcctagctaatatttgtcattgagctatggcacattagctatgtgccaagcaatatgtggattatctgattaaatgctcacatcagtctcataaagtgtatattactgtctccactttacagataagaaaagtaaggttcagtaaggatgagtaacctgcccataatcacttagctagaacgtgggtcaggctacagtataaaaccagtctgtttcactccagagactgtgccctcaaataatttaagccatgtgcgcttatggataacatcttggaggaaacagaggaacagaaaaagtccacgttatcatgatggagggaacccgagggactctttaattttctccactgctgtttttagaagttacacctttgcccctgtcaccctcccagctgctcaaatcaacgtgattccaccatccacgtggaggagaatgggcagtcctcggaaagccggttctcagttcagatgttcatgtttgctggacattatgacctagttttcctgcattgtgagattcatctctgtgattctcttaatgaacagtgccagcctgtgagtgtctctttgaactgaactcttcagagcctggcatggagcctggtacctgataggctttccatatatatttattggaattataaacgcagggagggtgggagggaggggaaagggagggacaggaagagaagggtaaaggggaaggggaaagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagggagaaaggaatacaggagggatggagaaaggaatacaggagtgatggaggaggaaaggagggacagggaaggagagaaggaaggaagcaggatgaagagacggaacgagataggtaggtgtatggatgggagggagggaaaaacgaacaataaatagatagactctagatctcctaaaggcccatatctaagcaatttttgtgtccccaggaggcagatttgataaagaaatctgtctactagattccattggcatcttttaaatgattataatcatagatgacttttttagtgcttgcactttgtcaagcactatgctaaaacttctgcatacattttttaatgtaagtctcagaacaaccctgtaagtagattattttgcctactccactgtgaggttcagagaagtccttgcccacagggccacacacaattagaaaatatcagagccagggtgtgccccagccgagaggtggctccagtgcccctgctcttgcctgcatttggaactgcctgtgaatagttggcattttccgagtgcttactttgtgcccatgtgttgcagacacatctcattttcatcttcacaaccaggtaggtattatttagttattgtagaaaggcaaagtcattggccccaaattatatagctaaaagaaagtctctacttgatgagattcaaacccagatttgtttggcatgacagtgataattttctagattgagataaccacagcatcggaattagggccatagcgtgaaccagttctggacacagttcttggtccagagctgcccattgtaggagcagtctagatagaatccaggcatttaaattttgatataataaaagttcatcatccctacagtcttgctcaagaagtcaagtccgcagtgaagtaccggccatcgacctagcccgggttctagatttggggcccatcactcggagaggtaagtggccaaatcccagtgacaagaccagctggctgagtgttgacagttaaccacagatgcctggggtcaccaactcaacttctcagggctcttgtaccacctcagtctgacccttactgaaaaacctattctttgagatgctttgggtaataatgacaatattgtcatttggacctcctgtgtgcttagagaccaggctaagctcttgcatccatcaattcacttaatcctcccatgcctatgtccattttacaggtgagaaactaagactcagagagattaagtgactcgcccaagatccccctactcatgagtggctagagttaggattgaacccagctcagtctgattccaaaacatgtggccttttccttattccacctgcttccaggtccccataattcagttccttatgggtgaggcgtaagtcctaaatcccgtctaaatgcaactttgttttctggtgaatgactgttttccaaaattcatttacagtattctggagtataatataggggaggctttccaatgactcctcatattttcatccatcctactcatgggtttacagtagtgtttagttagtgtttttatttccaccaggatggagaagtgaaagaatgaaagccttttttttcccctaaaggaattaagatgcagtaatgttggtaataataatactttctttgtgcctggcactttgtcaaatgcctttatatgcatgatcactttgaaggctcacagcaggtgagggaggtaagcattatcaccatttccattctccagagcaaatggaggctgtctcatgaagtaggctctgccctgagttttcctaccatttcactgagctctcaacttgaagcctcaggtggcatcacagggtaacttggtggaggttaggaacttccacttttgaatcagacatactggggtttgaatcccagctctgctactgactggcaaggtcaacttggcaagtcccttaacatcactgagctccagtcttctcatctgtcaaatggggatgagaatactttcctcacaaatctgttaggaggattaagtctaagatgcacgcaaagtgtctagaaaggtgcctgtgccagattctagatgcccccacaatgtggccacaaacttgctggtggttgcgatggccaggtctaggaggatgtgaagcagttatggccacagtgttgcagtcactggagcatgactgaggaaacccaccccttctgttcttgttcacaggtgcacagtctcccggtgtcatgaatggaacccctagcactgcaggtacatcattttctcatgcctttcccacagctttcccaactctcctttctcttttcaattctgccccttttatggcccagaccctatgctagggacactgacattaatcagacctaagattggcctttgagatgcccacagtatagtggaggaggtagtcctttaacaagaaatatatactgagtgcccactgtgtgccaggccttcttctaggcactgaagatgtgatggcaaacaaaacagcccaggtgcctaccctcatagagcttatgcaccagtgtggaaagtagaaaataaaaaagtaaacatggtactttagaaataaaagaaagtgatgtgatagataatgccttaaaaaaaaaagaaattcatttctttttttttcaaactcaagaacttttttttttttttaattcattttactttaagttctgggatacatgagcagaacgtgcaggtttgttacataggtatatatgtgccatggtggtttgctgcacccaccaacctgtcatctaggttttaagtcccgcatgcattaggtatttgtcctaatgctctccctccccttgccccccatcccctggaaggccctggtgtgtgatgttcccctccctgtgtccatgtgttctcattgtatagacattcatttctgtcacacataaatgaagcttagaggcaagctgtccaaggctagcggggcagcaccataaagctgtcaaagacccaggctccttccaactcatgcctccaccatctttgaggtgtggccatcatcttcatgttccaagatggcagccagagctccaacctttgtatccaggcagcaggatggagggaacaaggaagaagccaatgagtgttaaaagacattcccgaaagctggcaccttatatctccacttacatctcattggccagtgcttggtcacatgccacacattgctgtgaagaaagctaggaaatgtaatctttactctgggtgggccatgtgcctaaccaatgtttgatggctttattagcaaggtaggaaggaagaatgactatcagaatggataagtggtcagaaaaactttcagagtaagtgatgttgaagccaattgagaaaaatgagtcggaggtgcaaatgttaggggaatgagccccatatgcatgggaacatcaataattcattgcacaagtgagacagacacttgagcaaataaatgacaagcaagtagatagtacagaaagagtacataaaaggctaaataactgtattggataaggtctggaaagaatttcaccaggtagtaacatctgaatggggttttgatgaatgacttggagctaaacaagctaactaataaaagaaatatcacactcacacacacacacgcagagagagagagagagagacagagagacagagagagagagagaacatttttacatttttttacatatttatagggtactagaaatatgtcttggacaaaatggaaagcacatactattaagatttgctttcccacaaaatgacttatattggtgaacccaaacatgaaaaggttctttccatcctcaaagcccaaacttaggtggcagtttttaaatttcccaaataagtccaagatggactctctatgttccgtgctagcattcagaaaatgctaagaaaagtcacgctcattgagaggagtggttagagctcattctaaaagcagcttaggccaggtgcggtggctcatgcttgtaatcccagcactttgggaggccaagacaggcagaccacctgacgtcaggagttcgagaccagcctgaccaacatggagaaaccctgactctactaaaaatacaaaattagatgggcatggtggtgcatgcctgtaatcccagctacttgggaggctgaagcaggagaatcacttgaacccgggaggaggaggtttcggtgagctgagattgcaccattgcattccagcctgggcaacaaaagcaaaactccatcaaaaaaaaaaaaagcagcttgaagtcaagaacctcaagtctcattcctttctgccagtccttctggttagcccagtgcctggaacagtgtggtttcccagtagagtttgccaaattgactaatttctagaatgggtggtagattttggacgcttctggacaaggaggggatcagtctgatgttgagacagcctacccactacaagagggcacttgtggttttcattgtctgctatcacaatcatctttgatgttttagaattaattgaacatcaacctgtttttataattataactttttgtcatgtactgttctgaaatttatgatatttctctcctcacttctaggacatcagccagttactttgaaattggggtaatggggagattttacaatttggtagtatggcaggaaggctcacatatttctcctaggccctctgatacaagaccattatcatctgggatccacgtccttcactgaaactgagtacacagtgatgtgccaaagagatacaatcccagcagaactagatcttagagtctagcttttaaaaccaacatttatatagtgtttaccatgtgccaggcaatggtctcaatgcttaatatgaactcactcatttaagccttacaaaaatccagtgaagtcacagctgctattaatatttctctttggcatacaggaaaatacaggcagagaggtttaataacttttctgggactgcccagctaggtgtagagctgagattctaagctaagtaatcaggcatcagaggcagtgctttttaacctctgtgtctttctgccccttcagtattagtcagcataaataatgctagctgctgtaacaaacagtccccagtcttctgtgtctttagacgacagtattgtttcccactaaatcactgggggaggggatgcagttctgctccatgtagtcgttaggagctcaggcttctactaccttctggtaacttctggtaactccactatcccctgcaagtcctatcttggatcctctgcatctgctccctagatggttgatgagagagcaacaggatatataggaggctttaaggatcagacctagaaatggcacagatgacttctatgcacattttattgaccagattcggtcacatggccccacctagttgcaaaggacactgggaaaaattgcattcctgtgtgtccagaggaaaatgaaaaaaatggttggtgattagattgcctctaccatgtgagtcccagagactataactaggccagatatcaaagatgctttgcctttctcatccttgtgttgtgaaagacaaagaggccaacttatgtttgctcctgactcccaaagcccaacacttgacagtcatatttcttgtatttcagggttcctggtggcctggcctatggtcctcctgactgtcctcctggcttggctgttctgagagctccgctgagcatctggccttgaagtttgtgttcttccctctggcaatggctcccttcagcacttctgctttccactccaattcacacaggcttggtattaacagaatcaaggccaggctaggttaggaaaagggaagagctttcaccttctttaaaactctcggctgggcgcagtggctcatgcctgtaatcccagcattttgggaggctgaggcaggtggatcacctgaggtcagcagttcaaaatcagcctggccaaaatgctgaaactccgtctctactaaaaatacaaaaattagccaggcatggtggcaggcgcctgtaatcccagctactcgggaggccaaggcaggagaattgctcgaactcagggggtggaggttgcagtgagttgagattgtgccattgcactccagcctgggcaacagagcaagactctgtctcaggaaaaaaaaaaaaaaaaaagaaaagcaacatagtggggtttctgtcaatctgtcctcggctgcccttctcatttgttgatgggaccttgaaagcaagcttgctaggtgccctctgtggctccagcctttaccggaagtgtggtgcatgtttttaacttcagggaagcggtatcctgtcactggggtatgggatgagcatggagaagaggcaccagccacgattccttcctaagcatctcctgttctgactgctcatgaattgaagaaactgacccttgtgttcactctgcttcctctgattgtttctatcatggtttccaaaaattgccatgggaacatgtcaaagggccacttttggagactctgctccaggaagaactagtccccatagctcccctatcccccaccataccacagacatgctgtgacttagagaactacacaaacatccttgggacctagatgctggaggaatgacttaatttgatgcagaaactccatcacccaagggagtacctctcactgtaaacagtgctgtgcttgctctgaaggattaagcaagaagtcccaacagaagcaatgcaccagtcctgctatgggaatgaaactgcaaagcctaggagatgggtgaagtccctttctggagacctttaatgagtacttcaaagcactcgacacagatgcagcaaatagggcatcacacatacacaggcattaatactcacgggcatatagatgctgacatgtgtacactgacttacgcccttcccacagctacagataagggctcgcaaagttggcctcagagacacatcaggaaccaaggtggaccagcaggtgccgagcctgtgtatctgcttggaggagacgttccaatgtgctgccttgttcagagatggtgtagttgcaagaaacagaaacccaccacaatttctcaggcaaaaagggagttaattataaggacataagagcacaaagttccagtgcaagagatacatccaggctgcacaagctccgggagtggggcctggcaagccaaaagaaaccaaagtttgtcttgccttctgttcctctttctgaagccacatagccttttatgactgtgtatctttgcatcgcttttgttttctttttatgtctctgaagccagcttttcctgttcactcatcccttgattaaatatggacattctagcttcacatcacttcctaattcagggaccaacagagactggttagcatgttgctatcccacctccaaattgcatcagggaatttgattttgctgcttgggtcagggtccagtagtctgggccaggggactgggaccatctagcacatagccaaaggggctgacctaatggggcaggtctgacacaaatggggtcatttcttggacagacatcccaagggccactatgatagtagcttctctaaaagacgggttcctgagaagaattgcattctgtttcccagtgagttagcggagtcatacttactacatcccaaggcaggtggcatggtagaaacaggcctgaaagagaggtcaggttctaaccttctcccctctctgaggctcagctgctcccttctgtagaataaaaggggttggtctgtaacaagattttcaaaaatttatagtagtgaaactttacaattcgacttggacaaccagagattaaaagcaaatagattcttgttgatgtcaggtggggagcttagctctcccattctgtgattccttcctctgaaggccctcaaagcaactccataataactcacagagctgccagagccgatgttttggagcaccctgagacatatgaactctaatataacttccaggagaaagtacataggattccacttagagccaatctcagctgtctatctgtctagctacctgtcatctatctatccatgtatctatctatgtatctatctatgtatgtatgtatctatctatctatcatcatctacctcctatctacctatcgtctac

SEQ ID NO: 11957 - DNA, 64813 bp, Human
ttttcttggtagagacgggattttgccatgttgcacaggctggttttgaactcctggcctcaagccatctgcccgccttggcctcctaaagtgctgggattataggcgtgagccaccacacctgttctgaacccatttctttggtgctttttggatgggtttgttgtattatatatggttagatatcttttctagcagtatttttttcccctgtaaccattgattgactgctcttggatgttctgagagacaatatccaaagtcccaattaataattgtgactccctcacgcacagtctgtagaaggcccagagtgacagggaggcaaactcaaaggcctctggtggccagaaggggtgtggaaacctgcacacattgcatggatggtggggactggaggagcaggacatgctctatcagggggcagctggctctttggctgcagctggttgtcgtgtcacatgggagcgtcagttcatgatgccagttcttttgtttttaagagagccagaaatctagatttctacgtgaattttctcatttagaaaaagttcataaacttgatttaagtttataaaacatcctgttagccaaacaaaacacgtaggcatatggcctctggactaatcaggagtagctgggcctactgcccctcaggtctgggggtagctgcgggatttctttccttggggctgtgcacatggctgtgttaagcttacaggggaaactgttggggcgacaactgttgtcaaatcattccactttctttttttcttttctttttttttttttgagacagggtcttgctctgtcacccaggctagagtgcagtggtgcaatctcggctcaccgcaatctccacctcctgggttcaagagatcctcccacctcagcctccccagtagctgggactacagtcacgtgccaccacacctggctaatttttgtatttttagtagagacggggtcttcactatgttgatcacgctggtctcaaactcctgacctcaggtgatccaccagcctcagcctcccagagtgctgggattacaggtgtgggccgccacgcccagccaaatcatcccactttctattcatcctttcatttggcaaacctgaagtgaatactatttcctcccactcttttaggagcccatctcttgcttttaatgtaaaatatgcataatttgtgttttaagattaccatcagtttcatgaagagcttaatttttcccatggatgaagtgtaagtgggtacctgataatatatcgtgagcttaacattttccaaaccctgtttcttggccctaaatctgcccccttccttccacctcccaagtggaattgacatctttgcttcagctgcaggaatctgaccttgcaacaggctctggataagccctattagaacagccagaggtagagagaccaggagtggctgctcttgtgtaatcccatacaagtgtcagtatctgttgccaaatactgaaaaggaagccagttccagctgattaccataaaactttcccagcacttgtggcttgggaggcggaggaagcaggacagcctgataaatgtgtagaaaggatgcatgagagatccacccttgtaaggtgaggtggtctaatatgttgactatctgcacaggtgagcctttttatagaaagcaaaaaatatctggagacaactttgcttgcatctctacacaaatttcatgttaaaatgaaatccagaaaaaacctcggtcagaagatgcagtgcttctggcctaaggcttttcagatttcagtttatcctcccaaccccaccccccaggagcacagagtttgtttgctgttctggtgaagctaaacagtagttggacagttgacttcattggaaaacgatattattttgaaatgaggcttggtttcctcggtcagtgacctgcttagagagaagcggtgggtctgcacctggattttggagtcccagtgctgctgcagctctgagcattcccacgtcaccagagaagccggtgggcaatgagagcatgtctgctttcaggttgtggcctggcctgctgatcatgttgggttctctctgccatagaggttcaccgtgtggcctttcaacacacatagaaataggtaagtactggtgtcttgttatgttgttgagaggacaatacatctgtcaaagacattaaggaagagactgaaaatcccgctcgtggattgatacagtttcccctgggcactgagctgagtggcctgacagcagggaggagaagccggtgattgcagtcatccagggatagggattggcagcatgacttcagttaaggggcaaataagaaagagagctgatgccccattggtcatgggacccctgtgtgtttctctgggtggggaaatagtgagaggctcagtgaacgagaggttgcaacgtggcagcagaactgacagaatgggagaggaacaagatgggtggaatatggcaggagtgagaaatgtacttttgttgtttttacatgtccaaggacaggcatttccaagtatatgtaaagagccatatgtggccatgggagtgggtccctgagtcaaattgctgtaaaagtgcttggcttcaggaaggtcaagaaagtaagggagtttagttatccacatgcacggtgccaggaagatggcaggagttggagagcagaagggtacagcaagccagtgccaccgaccttaggggcaagggcagagtcatcctggatatagggagatggcaccacaaagagttatttaaaatttttatttttctagctttattgatgtataattgacaaaaattgtataaatttaagatatacaacatgatgtgttgatatatgtatgccttgtgaaatgattagcacaatcaagctaattaacacatccgccccccccacatagctaccatgttttttgcatatgggctgagaacacttaagatctttcttagcaaaaggatttggttcttgtatgaagtgtatttgtaacatgttttaacgcatggaaaacgtgagtcaatttgtaatagaattagctgtgataacattctacagcaattttcagattaatttcagatatacctgatgttctgagttttcttttttttttttttgagacggagtctcgctctgtccgccatgctggagtgcagtggcgcaatctcggctcactgcaagctccgcctcctgggttcacaccattctcctgcctcaacctcccgagtagctgggactacaggtgcccgccaccacgcctggctaatttttttgtatttttttttagtagagatggggtttcaccatgttagccaggatgatctcgatctcctgaccttgcgatccgcctgcctcggcctcccaaagtgctgggattacaggcgtgagccatcgcgcctggcctgagttttctttaatttagataaaaattataacagaattttatagttgtaccacctccagaagtttcaaagaataataagattataggcaaaaaatgaaaatttatcagtgcaaaatagacatatatactgagctacgatgggcaagaacctgttatcacagaatttgactatctgaaaggacactagaagtcaccgagtccagttctcttcttttacagatgaagaaactgatactagacagttttacagctaagttttcagtggcctggcctagaattacatgtcctgacagctggtccggcgttctttccattaaaaatgtactgctagaagggagtcaggaaacaatggaaaagaggatcagacttaggttctagttccagccatccagtaaagtagatgtgtgattctgagcaattcactttttacctacctctcaattctataaaatgagggggttgaacttcttaaagaattctaaagtgtcttgcagttctatgttctgtgaagttgaaattgccaaaactacagagtaagctgatgaggaacaaatataaatggaaatactccatttttaatccttagtgtttaaaaatttacaagacagattgcatctgaaattttaataaaaccagataattgcttgcccttcttcattaagtaccaaacaaaggtcctaatggacatttaaagaataatatttatgtgaacataattgaaggcatctcctgaaatagaatctgcacggattctgagaatttttttacatagaagaagaccaaaactccatcatttatttactaataaattagatgattttataaatattttggttcactttttcatttcttataaaggggcctgagtggaaggtcagcattatctgagtgagttaattagaaatggcttcattcagcgtaaatcactggaatcctgtacacaggttatttgtatttgtgggttgtgacttttatgatattaatgcttatagtagtggcaatagttttttgttatatgaattttaaaaattggaggtgattcacaacagaaataaggtatcacctttgaatgtcacttcccagggaatgttagtcctcttattgattcttgggagattcaggctgtgggtgggtgtggggtgtagttggtagctttctgagatgattttgtccttctggtccaatgatgaaaaacttttgaggatcattggttcagtccataggttaggtgttatattgtattttgtacttaggtttgtctgcctcagtactgaagcaaaatatgatgacagtttctttttttttttgagacagagcctcgctctgttgcccaggctggagtgcagtggcgtggtctcggctcactacaacctctgcctcctgggttcaagtgattcccctgcctcagcctcccaagtagctgggattacaggcatgcgccaccatgcctggctaattttttgtatttttagtagagacggggtttctccatgttgatcaggctggtcttgaattcctgacctcaggtgatccgccctcctcggcctcccaaagttcttggattacaggtgtgagccaccatgtgtggtctggcagtttctttttcttgagctcctaccaagtgtcagccactgtgcttgtcacttagcatttattatttcaaccaacctatacggtgggtattttttaaactcttttccataggagggaactgaggtctagagaggttgaatagcactaaagctcatagagttatttaatagttaagcagaaactttaaatcaccatctaaacttgctttgtactataacaatagaaatactgcacaagcctatacctaatgaaaattgccagtgagtgcaaactcatttcatttcctgcgtccttgacagttataaccacaaattgtgtatttttcttttaaaatcatctcgcctaagttatgttttcagtaatagttgaacttaattgatttatgtatttatttctctcaggacacagagctctggagtttcttcagcttcacaatgggcgtgttaactacagagaggtagaaatcttgatttttcttttcttctttgtgcattagttttcttttataggtgccaaacaaagatcctaacagatatttaaacagtaattttaagactcattttggctgggcgtggtggctcatgcctgtaatcccagcactttgggaggctgaggcaggtggatcacttgaggtcaggagttcgagaccagcctgactaatatggagaaaccccatctccactaaaaatccaaaattagccgggtgtggtggtgcatgcccgtaatcccagttattcgggaggctgaggcaggagaatggcttgaacccaggaggtggaggttgtggtgagctgagattgcaccactgcacttcagcctgggcaacaagagtgaaactccgtctcaaaaaaaaaaaaaagactcattatttatttctttatgttataatgttgtatattatgttattaatgttataagacattaatattatggttaaaaggtatatgtctcttccaagtgctacttgaacattttataggtatcttatatatatcacacttaaaatttaaagattttaatgatatgactcataatttgaaaaaatacttgagaaattttttaaacagtacatttttaaaaatgtgctaatcttctctgtatcattccaatattagtatatgtgctgctgagaagaacacatctttttgtttttattgtagagatgggggtctcgctatgttgcccaagctggtcttgaactcctgggctcaagcaatccttccaccttggcctcccaaagcactgggattataggcatgagccactatgcctggcccatcttttttgtttttattttaaaaagtcatacttgagagagatcatttattttccacttcttgttactgtgtgttgagcacaaattgcatcaccaggaggagaaggaagtatttattaagaaatacgcactgagattctccagagattcttcatccaactcctgctatattccatatcctggtaggactagctcatgactcacctttacccatcttcaaatgaacacattctgatcatatgcactatttgttctatggctaaataatactttgtgacgaaggtgtaattctttcatacttatatttgataagtggttagcattcccttctgacatcagaattggatcatttaataacattaagtcttcataatccatttgggaagcgggatggtaagataactgaaatttattgtaccctcaaaatacttttagtcgtaagattcagcttcctcacttgccaacctaacaggccgaatgaggaaaaacagcatttatatctgatagtcatcttcattgaccttgacggcaagtaggcaggaaagaggagtggaaacgagaatctgcctaattcatcacatgaacaatcaatccagagtgtgtgcagagtgatttctagtagaggtattctacaaggtattctagtagaggtattattaatttaaaacatgttaaatggacacagacgctccctttcaggatgcattctaatccaaatactaatgtcatcctcagaaataggccaggcgtgatggctcatgcctgtgatcccagcactttgggaggccaaggtgggtggatcacgtgaggtcaggagtttgagaacagcctggccaacatgatgaaaccttgtcgccactaaaaatacaaaaattagctggccgtggtggcagacacctatagtctagtcctagctacttgggaggctgaggcggggaatcgtttgaacccgggaggtagaggctgaagtgagctgagatcacaccactgcactccagcctaggtgacagagcaaggcctcatctcaaaaaacaaatggtgggccaggcacggtggctcacgtcagtaatcccagcactttgggaggccaaggcgggcagatcatgaggtcaggagatcaagaccatcctggctaacacggtgaaaccccgtctctactaaaaatacaaaaaattagccgggcatcgtggtgggcgcctgtaatcccagctacttgggaggctgaggcgggagaatggcgtgaacccgggaggcggagcttgcagggagcggagatcgcactgctgcgctccattccagcctgggagacagagtgagactccatctcaaaacaaaacaaaacaaaacaaaacaaagtggtggggcatgcctctaatcctagctacttggaaggctgaggcaggagaatcgcttgaaccccggaagcagaggctgcagtgagccaagatcacaccactgtactccagcctgggtgacagaacgagactctccataagttcacatgaaaataccaccaattctaatccgacaccgcaagatttactctagccttcaccatgtccatatctttaactcctttctctaatgctgagatggagtctcactctgtcacccaggctggagtgcagtggtgtgatctcacctccacctcccaggttcaagcgattctcctgcctcagcctcctggtagctgggaatacaggcgtgcaccaccatgcccggctaatttttatattttcagtagagtcgcagtttcaccatgtttcccaggctggtctcaaactcctgacctcaagtgatccacccgccgcagcctcccaacgtgctgggataataggggtgagccactgcacctggcctttctgtactctttattctatttcactggtctgtttcttttggtttcagtatcatagtacttttgtttctgtagcttaaaatatatatattttaagactggaatgcagtggcatgatctcagctcactgcaacctccacctcccaggctcaaattattcttgtgactcagcctcctgagtagctgggattacaggcaggcaccaccatgccccactaatttttgtattttcagtagagtggaagtttcaccatgtttcctaggctgatcttaaactcctgacctcgagtgatccgcccgcgtcagcctcccaaagtgctgggataacaggcataagctgctgcgtgcagcctttctgtattctttattctgtttcattgatctgttccttttggtttcagtatcatactatttttgttttgtttctatagcttaaaaatatgtattttttttgagatagggtctcactgtgtcacccaggctggagtgtactggtgtgatcatggctcactgcatcctcaacctcctatactcaattgatcctcccacctcagcctcccaagtagctgcaccaccatgtttggctaatttttaaattttttgtagaaacagagtcttgccatgtcacccaggctggtcttgaactcctgggctgaagagatccgctgacctcatcctcccaaagtgctggaattacaggtgtgcaccaccttgcccagccaaaaatatgtttttggcagatcacctgaggtcgggagttcaagaccagcctggccaacatggcaaaaccttgtctctactaaagaatacaaaaattatctgggcgcagtggctcatgtctgtaaatccagtactctggaaggccaaggcaggtggatcacctgaggtcaggagtttaagaccagcctggccaacctggtgaaaccctgtctctactaaaaatacaaaaattagctgggcgtggtgaccggtgcctgtaatcccagctactcaggaggctgaggcaggagaatcacttgaacctgggaggtagaggttgcagtgagccgagatcatgccattgcactctagcctgggtgacagagcgagattctgtctcaaaaaagaaaaaaagaaaaaaaatacaaaaattagccaggtgtggaggccagtgcctgtaatcccagctactcagaaggccgaggcaggaagaattgcttgaacccggaaggcagaggttacagtgagctgagatcacgccactgcactccagcccggtgacagtgtgagactccatctcaaaaaaaaaaaaaaaaaaaaatccaaaaatacattttaatatctgaaggatacatccttcgttagtactcttcttttttcctcaacagtttgctctttggcataatttttaaaatttacttcagattattttatcacattaaataacatgcctacctcactgggagatgcagattcaacaagtcttaatacatataaggagcttagaacagtgactggttaagtaaatagccagtaaagttaattactatttttaagtgaaaaaagtccaactcaagctatcttttggaaaaaagtggactttattggttcatgtaactgatatctgcagtgtggaactgggcccagagctctagatggtttctatatctctccacgtggggaatgctgacagcctagcactcagcgtcagagctcagcagccacaaggggaagagggcatcttcccagagctctagtggagaagtcttggggaaggtgtgaacggaactagctttgctcaaaggtccatttctgagccaaactctgtggtgagggtgggcatgctggccacagcattctggtcagccccacctgagcggtgtggaatgggctctcctcgggagagggtgattctgcctctagaaggaggagaatgggatactggttagaaaaacaaaaccaaaaaccagatgatactatctttctttgtgttttaatttcttgaagtacttctttgttgcacctatatatggtccacattattagtaagttcttatttaaaaaaaaaaaaaaaagggcgggatattgccaaacttttactttgcccagtgtgtccatcagagttcatttgcagataatggaaacccctctgctagtttaggcaaggaaaggattaataccaggaattagagaattcactgcttacaaactgtgggaactgcaggagcaggctctaggccaggtgtccagaaaggactcccaaaataatgcacagaactggcctgtcaaggagctgctactcctgccattgacaggcattcactgccccatttgctacaaattcaacggtctcatacacggtttgtaaaataagaagccaccacctcacctattggttctgggacctcatcaccacctcgggcacctgccttactaacaatatggttgtcctgtactctgcccataaacacgtgggaagccagagctgcaacacgaggggctgtgctacctctgctgtggaaaaaccaaatgcttccatgttagccgagggctccgtggtggaggctgggccatatcagactgtgagctgagacagcctgggaaatgtagtctgtgttttctagcctatagcatgcagctagacatcccataagggactcggaatggaaggaagtgagccagttgaccaaggaagaacatttagaagaaaaccgctaccatctactttcacatcatttaaaaagggaaagcactttttttagccctcccaaaacacaaaggacgtcatcttacactaaaacacaggtagcaactataaactgatatgcacatatgtgcgtgcttgtttgtgtgcgtgcgtacgtgcgtttgtgtgtccgtttttctcttttcactgtgaatcattgaaaattttataaaaaaccagctgtgggccaggtatggtggctcatgcctgtaatcccagcacattgggaggctgaggcaggagaatcgcttgaacctgggaggttgcagtgagctgagattgcgccactgcactccagcctgggtgacaagagcaaaactccatctcaaaacacaaacaaacaacaacagcaacaaaaacaacagctctgggtcagtaaaacaaccttaaggcctcagggaaatcctgctttactggattgacagagaaaatgaaagaagatgaaatttaaacaagtgttttctgctgtttctaaattagcctctctgtgtttggtagggaagaatctgaagttatatattgttgtgttttgtcttggattatgtgtgaattttaatcatttatttactttatgcctgctttccttcctttttccctttcattccatctatacccccatatttctagcatctcatcacagaaaattggtggggcctatactccccaggctgttgactcctgccccttaatctctgtattttcttgctctgcagctgttactagaacaccaggatgcgtatcaggctggaatcgtgtttcctgattgtttttaccctagcatctgcaaaggaggtaagatgaaagtttgcagactgaatgaagtcacttttacttggttaataggaatagctatgactttaaaaatatatatatgtgtgtacaatatatttttaattgcacagtatattttccattattgttgagaacaatttgtttcccaacaatattgttggttaatgacttagtttacatagttgcattttccatttagctataactgacctagttaagcatagaaattctgagaactattttttggtgaaaacctaagtggcatgatagaagacattttgcaagagatcaaaaggtctgagtttgtgttccttctatattagcatgtgatcttaaaaaagtcacttatccacagaatctcaattttcatgtcttggcaaagactggattgtcctgcctgccctgcctagactggattgtccttggcattaatgcacagtattttgtcaagtgttatgcaaatcgcagatactattatttgtaagagttaaagaaagaggaaagaaacatgaaaagcagcttaacagtcaaagacagatttattttggagaagtaaacctgagaggggcttctggccgatttcggtcaggaacactctctctcttacagactgagagtatttattggtgagagagtttggaatgtttctgtgtgggggagaagtttatggtgggattggaatgtctctagttggaggggaggttatcttggggttgacatctctctggctggaggggaggttatcttggggcttgcacgtctctggttggggaggggtttggaatgtttctgattggagatgttatctgtgatttatggttatgctgactgtacccattaggctgatgccctttggatttaggcaatttttggtcaaggtgaacttaaaatggcagttcttgtccaagatggcaatgcttctgctctgtcattatcagtaaacttgtctcatgagtcgtatcagtcagagccccagcaggacccagaagtcacactcaaactgagtaattggagaggagcttagtaagggcaccattttcaaagatatggacaggaggcgaggaattgcaaaagatagttcaagggagggagagattactggaaccgtggagagagagagctgcatgaagaggaccacttgagagctggaccttcagctaaggggcacagccagcccactgtgaccccacagaaggggagctgggagaatatataccccaacttctgtgtcttctttttctctgatctgtcagttctctttattggccaaacccaacccaatcaaagccagagagccacgaagctagttgaagcaggtgacctcagagtcaccctacaaggtagagaaggatggggagtgggtctggaaggacaaatggaggcccccagcacgctgggtacttgtataaactgcttctggggttttgggtcatctgctattatcccattcctttaattcagtgatgtctttgggactgaaatgaactatctggggctaatcactcctgcagttagaatcccaggcagctagcttttgtatttctcatatttataaggagttttgttctgtttccctcttagtctgttaactatcatttctcaatcctattattttgcctgcatgttatagttctcctttctaacctattatttctaatttagcacttcccaaactgtattcatgggagctctactgtcccttgatagcttctacaaaaaagaaagaagaaaggatatttttgtccattcaatttgagcaacattgcttaatgtacgccatttttagagacagacaaaacccacactaatcaaggttctgaggagagtggaaaaggaatgtaaagtatttacctagcattttccagttttttctgcagcaataaatagtcttgtgtgatgaaaagattgggactggtatatgactagttacagggaatttgcatacaaattccacttattccacttaggtttttttgcatttttccacattttaccttgtctcatacatacctaattcaactgtagttttccttttcttatttggtgatgattcactttcattgcatctttccaaagcacttagctttcttagatacttaattgccaaagaaaaaacaccttttttttaaagttatttttacattttttagagacagggtcttgctctgttgcccaggctggggtgcagtggtgcaatcacagctcattacagcctcaaactcctggcctcaagcaaccctcctgcctcagccttctgagtagctgagactataggtgtgtaccaccatacctggctacttttttattttatttttaaatttttgtagagatgtggtcttgctatgttgcccaggctagtctcaacctcctggcctcagggggtcctcccacttcagcctcccaaagtgctgggattataggcgtgcactactgcacccagcaaaactcttcatttgtattagtttacctaatactgaattagcctttataattacagtaacaaggacatctggtttaaacaggattagaagtgggtctgattgaccctttgtgagctatggtatagacaggtaagttcaagtctctgggcagtggcttgccagctgtcagcatctagtatgtcctgggggactttctgcttccagtctgttggatttacagagggatcagaaagcttcagttaatctgccaatttgtttaagttgaagttgttcaaaagagctactgccatatttaattctggagttttactgtattctggagaacaagaattgtttaaagctttatctctaggaaaactgtgggagcaaatcaaatgtcttgattctaactcctttgaaaatcattttgaaaaaaaaccaatgatttaaaactggttcggcaatttttactttaggaacggcatagaaaaattgaactgagggatctgaactcggcagttttgcttttagttaccctcgtaacatttggcactccatgaggcatttgtggctcttggaggtttagcacagaggccagttctgtctttcctacccctcttgtgggaataaagagctacatgggacacgcactggcccactcaaacgacacttgcataaaatgctcactggggcctgtgccattttgcaataattattataaaatcaaatgcttgaaagcatatgaaatatctgcttttatttcttgtactcttaaggaggctgactgtgagggacaaggaagatactttttaaaatcccaacaaataaacaaaaccaaagtacaacttgtttccttagttttagggcacagaaatggaaacaattctagcctctattctaaccaggtagccgggcttgcgattccgtgagccagtttaggctccgtccctcttactgtagggctctttttagtcatcaggcagacagtaccatgcgtattccaaaatctcagctggctcttccgttttagaggcttcttttgaaagtcgacagaagaaactgaggggcatggagggaaggaggagaagggacacagcagcgcagcgggtggtgtggaagatttgattgagactttccaacttttaagagagaatctagagccctgcttttgttttgtcaggaaaattccatgatgtgtctgagagcactcactggactccgtttcttaatgcaagcgttcattatatccgagagaactatccccttccctgggagaaggtaggcgtggtcctccaatccttaaaatatttagcaccaaacctgccatgcactgtgtttgcacccgcattgaccccatttgtaccgctctgtaagggctgcccaccattccaccttcagtgtcatgcacattgcttggacatagtagatggctagctaatacttgaattacttataaacacggtttgggatacatcacttcatcattttgctccaatagtaattaatctgaaagcacttccaacacatcgtaaaacgtttccaaaagtccttatggttttgtgtgtgtgtgtgtggttttgtttctgtttttgtgtttttcagacagagtgtcgctctgtcacccaggctggagtgcagtggcgcgatcttagctcactgcaagctccacctcccgggttcatgccattctcctgcctcagcctcccaagtaactgggactacaggcgcccgccaccacgcccggctaatttttttttttttttttttgtatttttagtagagacagggtttcaccatgttagccaggatggtctcgatttcctgacctcgtgatccacctgcataggcctcccaaagtgctgggattacaggggtgagccactgcgcccggcctgtgtgtggtttttttttttttgagacagagtcttgctctgtcgcccaggctggagtgcagtggtgcaatttcagctcactgcaacctccgcctcccaggttcaagcaattcttgtgtctcagcctcctgagtagctgggattacaggcaagagccactgcacctggcctcttatgtggtttttaataactagaaactgcaatttacttgcctgaaattttttgttaggtctcagtaacataaatgaatttatatttattaaaacttttaataggattgttattataaaatcacccaaacacacatgactctaatttgcttgtttggcaggacacagagaaactggtagctttcttgtttggaattacttctcacatggcggcagatgtcagctggcatagtctgggccttgaacaaggattccttaggaccatgggagctgtgagtacatccctttatggggaatgactttatgggagtgatactgtctcacctaagatcaaaacctgaccgttttaaaagaaaggaaaatgttaggttattcagacttctgcccaaagcagtgtttggttagagtcccatcttttccaatttgttccttttttttttttttttgagatggagtctcactctgttgccaggctggaatgcagtggtgcgaaggcgcgatcttggctcactgcaacctccaactccctggttcaagtgattctcctgcctcagcctcctgagtagctgggattacaggcacgtgccaccatgcttagctaatttttatatttttagtagagacggggtctcaccatgttggccagggtggtcttgatctcctgacctcatgatctgcctgccttggtctcccaaagtgctgggataacaggcataagccaccgcgcccggtccaattcattccttttattcttcttgccaactgggtagattcatccacaagagcagagtggctaatgtgtactgaaaacagtcatagatgtgatgttttgttttagtcacaaaaataattgataaatcttatgctttattcaagctgtatatcttaagaaggatatgaatacctgccacttggttctatttaaaagtaatacttctactttattggactttttctctctctttttaactttctatatgaaaatgccatgtcctcaaactgaaaattgtgatcttacctgatgacttagcctctggaaggccccctggtccttaatttatgttaattacattctgttagaagtttcaacttcaactcagagatttttatatatatcctataaggcagagttgtctgtagtagctttattgccagacatatgtatccaactcagctgcatatatatgtgtgtgtgtgtgtgtgtgtgtgtgtatgtgggtgtggttttttttgttgttgtttttttgtttgtttgtttttgagatggagtttcactcttgttgctcaggttggagttcagtggtgcaatctcggctcactgcaacctctgcctcccaggtgcaagtgattctcctgcctcagcctcccaagtagctgggattaccagaacccgccaccatgcccggccaattttttgtatttttagtagagatggggtttcactatgttggccaggctggtcttgaactcctgacctcaggtgatccacccgcctcaacctcccaaagtgctgggattacaggcgtgagctaccgcgccctgcctttttattattattatttttttactaataaaatgttagtgtgaaaattgagtctattatgcgtcctcagcagttcattgagttagctgtcatctcccaccacttgcttgactgtggaagtaagagttggggctacaatttgtaatacacaccagatggttctctttctttcttagattgattttcacggctcctattcagaggctcattcggctggtgattttggtactgtttatttacatttgctaaattttctcgtggtatagttcacttataatgacatcactactgtgctttaaatatgtgtgtctttaatattttgctggttgcatgtattttctatttaatgttgcagttcatttagagtagagatgtacctcatttaacatagagatgtatttctaaaaacttgtgtctatatgtatttttttgttaaaaaattctacactttgttgttgacatgtcataattttagaaaaactttacttatacattgggttaaaattcattagctagtgtctcctactttcctaatactttagctttaaactagtaaactccaccttttgcctgtagtagtaaattgcttttaaatatttaaactaggtggtgaatggtgtttattaaacccttatggtcgatatttccttaaagtaaaacaaaaaacacctttggttatatggccagttctttcttaatttatatgtttcactaactaagatttttaaaagataattttttcttaaaaaaaaaaaaaaaaaaaaggcggcctggcgtggtggctcacacctgtaatcccagcactttgggaggccaaggcaggtggatcacctgaggtcaggagttcaagaccagcctggccaacatggtgaaaccccacctctactaaaaatacaaaaattagctgggcgtggtggcgcatgcctgtaatcccagctacgagggaggctgaggcaggagaattgcttgaacccaggaggcggaggtttcagtgagccgagatcacgccattgcactccagcctgggcaataagagcaaaactccgtctaaaaaaaaaaaaaggcatgcctttacctaaaacaatgaacaaaaacatgtaataatgtgaaaaactaataatccaacttgtcagacctcatgttgaatagatgcatgctatgtttgtcactaatccaccaaatgtcaatatttttctcataccctaggaggagatgtgttgagccagtttgaatttaattttaattaccttgcacgacgctggtaagagcaatgtacatctaaatatgtggtatctaagtggcatttagagccttgactttttttcttagaaaatataactgacaatataattagaagtcttctgcactggtaaattttgaaaagtaaaattgcatattagcatagtttagattctttgagaaattgaattccactcaattttgaatggagtggagttgctgagtcatagtttactttttcaaaatgatcatcttaacttatgctcccattagctttgtataatcattctggttcttctgcattctccaatacttggtattgtccaactgttaaaatttccagcctgtttgtgtgtaatggtatctcattgaggttgcagtttgaatttcccagattgctaatgaggttacacttttcttctattttatggatcatttgtgtttgattttaagtgaaaactttttccagttttcagtctatttttctgttgggttgtttatcctttttatttatttgtgagtatttatatattctggcttctactctcttgtcagtttgtcacttagttattacaaatgtctttcacagtttgtggtatgtcctttcacttattgtgtatcttgacaaacaggatttgttaatattcatgtagttgaatagatcagtttttcctttgtaatgtgtacttctgatgtcttatttaagaaatccgttcttagctaggtgtggtggcacagcatctgtagtcccagctactcaggaggctgaggtgggaggatcacttgagcacaggagtttgaggcttcagtgagctatgatcgcgcctctgcactccagcctgggcaacacagtgagaccctgtctcttaaataaaaagaaagaaaacctttctaccttgagggcaaatggttattctcttacatggacttctaaagcttttatagttttatatcttagctttatgtctttgatttaactggagttaattttttgtatgttctgagatgtaaatctaattttattttttcctctggagataatggattgtcccagaatgatttatcaatagtctcccctttccttgctgatctacaataccttctctgttttggttttctgtttctttctgtctttttttttgagccagtctaactctgtggctcgggctggagtgcagtggtgtgtgatcttgggtcactgcaaactccaacttccaggcccaaatgatcctcccacctcagcctccacctggctaattttttaatgttttgtaagagatgaggtcttgccatgttgcccaggctggtctcgaactcctgggctcaagtgatccgcccaccttggcctcccaagtgttgggattataggtgtgagccactgcaccccctttgggttataaattaaaatgttatgtatatgtatgggtcagtttctgggctttctgatatgtccttttggtccctgaacaatattgattattttaattgctgtagctttataataagtcttgggctctgttagggcagatcttataactagtccttctttttcttcaaaagtaccttgcctattctttgcctttgttctttcaaataagatttaggctcaagttgtcatgttccaagaaaaactttgctggaattttgattaagtgtttattgaatctagagatgaattggaaaattaacaattttgaaatattgaggccaggcacggtggctcatgcctgtaatcccagcactttgggagggtgaggcaggtgaatcacctgaggtcaggagttcgagatcagcctggccaacatggttaaaccctgtctctactaaaactacaaaaattagcctggtacgatggcacgtgcctgtaatcccagcaacttgggaggctgaggcaggagaatcacttgaacctgggaggcggaggtttcagtgagctgagatcatgccattgcacttcagcctgagagacaagagcaaaactccgtctcaaaaaataaaaaaagaaaaaaaaatttaccattcaaataaaaagatttgtaagttataagtaagataacatcactatttatttctttactttttatcaggtttatctactgattattaagagagaaattagtttcaaagatctcccacatgagggtagatttttcaatttcttgtagttctgtcagagtttgctttgctatatagattttgaagatatattgttaggtacattcaatttcaaaaggataccttgtgaattgagctttttatcgtgaggcaaaatccctctttatctctaataatagttgctgcattaaagtctcctttatcagatgtgactggagttatactggtcatgtttggtgatattccatggtgctagaataagtaggctcaagttaagaactgccgagatcatgccactgcgctccagcttgggcgacagggtgagactccaactccatctcaaaaaaacaaacaaaaaaaaaaccgtccaggttccaaacctaacgtgtagggtgtggcacacgttctcagggcaaaagctggttgtcccatttgcttacctcccagggtttttttgtttctagttgtttttggcctttgaaaaatttctgctgtcctgctagcttggtgattcatttaaaaaaatattttttgttattttgtctgactttttaagctatttttattgggaatgccattccagtgctcttataaaataaaaaatgagtctctcaattgtttctttcttttacctactaaaagaaacctactaaagttagattttattggttgcgattttttatcttgtttattctgaggatttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacattggggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgacttttgaggatttttaaattaaaagatgattgagtataaatctggtttttaaatgctgctctttgcaatggaaataactaatatttgtgaaccaaaagcctgatttagaattcttttcattgctttatactgtaaaccaagaagtatctgagacaagtctcaatcaatttaggaagtttgttttgccaagattaaggacacacccatgatacagcctcaggaggtccggatgacaacatgtgcccaaggctgttggagcacatcttggttatctgtacattttagggagacttgggacatcaatcaataaatgcgaaatggctattggccagttagctcagttgtggtgctaatgacaccagggtcgcaggttcagtccccttacaggtcagttgttttggccaggcatggtggcgcacgcctgtagtctcagctgcttgggaggctgaggcaggagaattgcttgaacttggaaggcggaggttgcggtgaaccgatatcgcaccactgcactccagcctgggtgacagagtgagactccatctcaaaaaaaaaataaaaataaaaaaataagtaaaatgtccattggttcagtccagaaagatgggacaactcgaagcgaggaggaggcttccaggtcataggtagctatgagacatccttccgaatttccaattagcctttcactgaaaatgcagtttacagtaatagtgtcacttatgctgtagtctggtttagtgaaacaattaggcaaaggaagcaatcagatatacatttgtctcaggtgagcagagggatgatatttgagttctatctgtcctttgcccacatgaatttccttgtgggcaaattgtgagggaggtatgtagcttttaatctttgtagcaatctcacttagaaatagattgggagggccaggtgtggtggctcacgcctgtaatcccagcactttgggaggccgaggcaggtggatcacctgaggttgggagttcgagaccagcctgaccaacatggagaaaccccatgtctaccaaaaatataaaattagccgggcgtggtggcacacgcctgtaatcccagctgcttgggaggctgaggcaggagaattgcttgaacccgggaggcggaggttgcggtgaacggagattgcaccattgcactccagcctgggcaacaagagcgaagctccgtctccaaaaaaaaaacaaaaaacagaaaacaaaaacaaccacacagaaaccacacagaaatagattgggaggcaggtttgccctacacggttcccagcttgacttttccctttagtttagtgattttggggttctgagatttattttcctttacaatacttttatactttggtatacttttttgtatactttatatactctgaaattaagatgtcagggtgaggagacatttttataatagtgtttttaaaataattcttttcaattcaacttgaaacaatgaaaatactttaaattacttcttgaactctgaattcacaaaattaaccactctttttgtacgttatagttagtttccaatctgagtatacctacataaatatttgatttaagttaccagttgtttgctctgcatcattgggccaattatttaacttttctgtgccttaatcatttcttcttatgtaaaacgggaatatgatagtactaaccacctgaggtcattgctaggattaaataactagtgcatgtaaagacttttacatggtgcctggcacaaaataatcacggaataactggtagctgctgctgctgttgttactattttcagcttcagaatcaaaacaactcttactttattctgcatttttcaggtatgtgccagtcaaagatctactgggaatttatgagaaactgtatggtcgaaaagtcatcaccgaaaatgtaatcgttgattgttcacatatccagttcttagaaatgtaagcgtaactcagaggacaatttgcagctgattttgttgtgacttcctttgcacagtttttatgtttttgtttcctgagactggattttggatttatggattctgcttattcaaaggcagttgcatgacggtggaaaagggtggatggaactttttcttcattatttgcttcatttctctgttacaaactgcaactcacagccaaaattattgtttattttgcaggtatggtgagatgctagctgtttccaaggtaaaggcgtcattcttccaaatcttaaaggattataaagataccaggaatagtaccatattcattttattttttctttctctctgccatagttatatcccacttactctacaaagtccccgtttttggtggaacaattccaagagtattttcttggaggactggatgatatggcattttggtccactaatatttaccatctaacaagcttcatgttggagaatgggaccaggtgaattcatattgcatttctattaccaatcactctctgcctttttaccccatcccccaacataactctcaggtttttcaactgatcacataaaaacaaaacaaaacaatctcatgaagtgcttttctaacctattcaaagagggaaagaatggaaactcagtgatcttataaacttgactggttcccatccagttggcttggttgatgctgctcgtgttttagaaatagagagacagttattgcaatatttggggtctgtgagaaatggctcagccaggcaggaatcagcctccacaggtggtgctccatttgtttctttctttttattttgagacagagtcttgctctgttgctcaggctggagtacagtggcacgatctcggcttcactgcaacctctgcctcctgggttcaagggagtctcgtgcctcagcctcccaatcagctgggactacaggtgtgcaccaccatccctggctaatttttttgtatttttagtagagatgaggtttcgccatattggccaggctggcctgaaactcctggcctcaagtgatccacctgccttggtctcccaaagtgctgggattacaggcatgagccactgcacccagcctccatctgtttcttttgggaaaacccatgctgggggctggagtgccaggtctccacaggtcccagagtggctgtgttcttgctgtggtgacacacctctccaccctgactacactctcagggtttcagggtgtcaaaggatacctcacctaatactaaaaaaacagaagcaaatagagctatagctacatgccccgacacacactccaacgtaaaatgagaaataaatgcatttgtaaaacattctgttgaaatttgacatctagcccagatgggacagctgctgaacctccagttccttttcttctcctaagcatgctcaggacaagaattaatcagaaactcagccgaaatatagataaggtagactgtgattgtccccacttctagctgtagtagatcattagactctcacagagtcttacactacccctagatcagagggagccaaggcccttctgataacccatttctttctttttcttttttttttaagagcacatgtgtttttgttttttgtttttgagatggggtcttgttctgtcacccaggctggagggcagtggcattatctcagctcgctacaacctccacctcctgggctcaagtgattcttgtgcctcagtctcgagtacctgggaccacaggctcacaccactgcaccaggctaattgtttgtatttttggtagagatggggttttaccatgttgcccaggctggtctccacctcctgagatccaagtgatccacccgcctcagactcccaaagtgctgggattacaggcatgagccaccatgcgtggccggaaaacccatttctttttttttcttttcttttcttttcttttctttttttttttttttttgagacagagtcttgctctgttgcccaggctagagtgcagtggtgcgatctcggctcactgcaacctccacctcctgggttcaagcaattctcctgcctcagcttcccgagtagttatgactacaggtactcaccactacacctggctaatttttgtattttttgtagagacagagttttgccatgttggttggccaggctggtctcgatctcctgacctcaagtgatccacccacctctgtctcccaaagtgctgagattacaggcgtgagccaccatgcctggcccagagaacccatttctgatcatgctgttggacatgcagcctctccccactactgacctgaaccgggttgagatgtgggtgtggctaggaagcacagggcagcccccgaatcggggaaagggcagagcgggaagcttaggctgtaccaccagcagtgggaaagagggttctctgggcgggacctgtgcctgggagactgttccaggtcaggatcatagcagagttagctgttcataagttggaatggcctacagaatgtagatccagaatattatactgggtgatattcctttacccttataaacatttgctagtacccaaacagtgttaaccataattatatattgtgttgatttgaaacaaaattccctttgatgacaaattcgaccttagcttggtacataataaacttgtttttaacaatcggtgagtaacaatttggcagggatagcaatctcatatgaatgccacttttaatagtgaaataaacctcaactaaaatccccaagctctcccgtggacctgggtttttaggtgcatactgccgtggttgtacagaatttaagggatctgccactcactactgagttatctggaacaagttgctaaaccttccaaaatcttatttcctcacctataaaattgggacagcaatactatttttaccataggatttttgtgaggagtaaattagatcagtcatgtaaagggtttagaatagagtaagcacttactaagtattggttactattattattagaaggaagcaaagtttgtattggaaggactcataacataagggcatgtttgagtgattgacctgcacttacttgttttatataatccaaactggaaaacattttttggtgttcaattttggtttggttctccaaatagctaaggaaagatagctggaccttattctttcgttaggaaaagataattgagaaagaacatatttcttgtctcttgatccctgtcccaatttaccaaggtgtaaaattccatgagttgattgcttgtttgcatacatatacaaagaaagattcatcagaatttatgaaaatgtatgggaaattcagagaagtctccaaaaagagacaacacaaaaaaattcataacagaaaggaaaacataaatatgttcatagtaacaggcatttcccagcttactaacacaggttatcttccaaagctcacttatgttatttggtatattttccttaaaaaagcaatgaagtagtggtagttacattgccaagaactctactcacctcaaactctatttgaaagtatagtgctaatgctgtaaggctgccttttgtgtcctgtggtggacaagaaaaggtccaaagagagaaccttttcctcagctcaaacctggccagagaaatgttttggtaggaagagtctgccttcagctttttcccacctcctttttggaattcctttttcagcaactaattttcttcacccctacactccacattacttttgtattaccccagcctccctcagtgacctccatacaaatcttaagatagtcttcattccagaatactcttcttatattaatacctgcttcctcagtgcttctgttcagtgttgggggaaagcctctattgggaagagtttatctcttatgttctcagaggctttttcacttgtaaaaggggatccttcattagctatttaattattgaaattatggaattttttttaaagaaatgaaattgagaaattcagacacatttaggcataaatgtgtataattgggcagaaggtgacataattggtaaccagtgttgataacactctcaaattctgagacgtttcgtgttagcgtggaacagctcagcaggtggagcggggagggaagaggaaggctgagtctggggtgactggcagcatgagccttcctggattaccatgatagtgacaaccgtcagcctacccaccctctctgggagaacatgggctcttaattagtcctgtatggctaggtaataaacactttaagcctttgggagatgattgaagcgcactaccgattctcggtaaaattcatgcttgtgaagaagtagataaatggctaactcatttgactgtttcctcagtgactgcaacctgcctgagaaccctctgttcattgcatgtggcggccagcaaaaccacacccaggggtaagtggattccaaaattgttcatagaaaaagtacatctcacctggaggagatgccctatagaggttgagaacacgggatctgttgagagacagctgtaggttcaaattccagatttgtcacttgcagctgtgtgatttttaaacaagctgcttgatttttggagctatagcttcctccttttgcaaaatggaaaaagcacatcaacactcccagaattatggtgtggatgacatgcagtggtggatgtaaagcaattagcacatgttgagttgctcattaaacggtagttagtggctgggcacagtggctcatacgtgtaatcctagcactctgggaggctgaggcaggaggatcccttaagtccaggagttcaggaccagcctcagcaacatagtgagacccctatatctacaaaaaatgaacaaaattagccaggtatggtggtgtgtgcctgtagtcccagctacttgggaggctgaggcgggaggattgcttgagcctaggagttcgaggctgcagtgagctgagatcaggccagtacactccagtctaggcaacagagtgagatcctgtctcaaaaaaagaaagaagaaatgtagttagtattattgtaactatcaatattattgtcttactcataaacttcacccagattttacatgaaaatttatttattgatgagacagtgttgggagaagccctcagtgttaagggccagaagcctggtttgtattttaagaaatgatattttctgctggagtcaggtaccaaccgacagtcatttatgcattcatttaataagttattaatattacaaatatgtgtatatttattaataaaatagaacaaaataacacaaataataaaatatcatttattaatcagtacgtgccaggaactggttcaggcactagagatatcattgtgaacaagacagaaacagttcctgctctcaggtatatggcctggcaggtagctgggcactaaacaagtaattgtggacattgttaagtgttaggaagaaaaaatgcaaggtgctctggggatttgcaagcgtcctggcctgggcacaggagggttctccttgaagaagtgatggcttaacagatatttaagtgtcaggaattaaaaatgcagggtgttctggggatttgcaacagagcgtcctggccctgggcacaaaagagctctccttgaagaagtgatggcttaaccgggatatttaaggatgatcaagagtgagatatactcaaaagtagagtattgcaatgataaaggtactgagaggaatgatcttagcactttggaagaatgaaaattacacagaaagtgttcagtgaagtcgtcattgttgtatttgaattgggtaacttttttttttctttttctttttttcctagcaaaccattccttcaacatactttgttgttgtttaatcacattgagcaccttttgattaggcttgcaatctttcttggggttgccagaaccctgacactagttggtgtcatgcccagggccccgtcacttacggctgttgtccactccctacttcagtcatttctgaagcctctctggctccctgagtcatctgctttttggctggttgacatctttgaatgtgaaaatgtatttttattgtataattaattttagcatgtctttgaagataaatcagtatgctggctgggcgtgatggctcacacctgtaattccagcactttgggagaccgaggcaggtggatcacctgagctcaggagttcgagcccagcctggccaacatagtgaaactccatctctactaaaaatacaaaaaaatcagctgggtgtggtggtgcatgcctgtagttccaggctactcaggaggctgagacaggagaattgcttgaacccaggaggcgaaggttgcaatgagccgagatcgtgccactgcactgcagcctaggtgacagagcaagactccgtctcaaaaaaaaaaaaaaaatcagtatgcttgcaaagcagtttccccaccagctgatacctgttgctaaattttttcataatctggaaagaattgaagccttttactcctaccatagagctctgatattataggaaatatgttttataaggataggcttttaagccttagaaatgtgtttactaaaagattttgtgaaatgaaggttttctaaaactttctgtgttgctccttcagccttctgacgttaaaattttgtggtcttttaacctgtgattaacatgactatattcttcaactcagttttacggggggttgttttctcagtcgtaaccagtttattcctctttctcttcaacagctcaaaaatgcagaaaaatgattttcacagaaatttgactacatccctaactgaaagtgttgacaggaatataaactatactgaaagaggagtgttctttagtgtaaattcctggaccccggtaagaattttctgctctaagttgagaaagaggaatgctgcttcttgagataccttgtttcgctgagtccctgggtatttatttgtccattgaaatttacctgtggtgggatgtggtggctgggaggctgagttgagaggatcccttgagtccaggagtttgagacctgtctgggcaacatagcaagaccttgtctctataaaaaataaataaattagctgggtgtgatggctgtgcctgttgtcacagctacttgggaggctaaggcaggaggattgcttgagcccaggagttcaaggctacagtgagctatgatcatgccagtgcactccagcctgggtctaagcatgtgccaggccggcaaatactcttggcatccatatgtggtttgttctggagatgccctgagtctgcacctcagtggtctctgtcaagtcaagatgaccctgggcacccaggccaatccttctttggacttagtcccaaaggcgttcacaatgttgaaggctcactgtgcatagccccattgtgtatgaaattaatcaatgaagttagctgttaagtgaagacactctactgggggatataaaatgaaagacaaatgaactctgacccttaaaaaatttcagtctgaaaggagtgacaaatacaaaaataaccattatgtgagtagactgcaacacataccatggtgcggtaagtgcatcattagatagtagggagaatgggcgtggtggctcacgcctgtaatcccagcactttaagtggctgaggcaggtggattgcttgagctcaggagtttgagactagcctgggtaacataatgagaccctgtctctacaaaaaagtaacaaaaaatcagctgggcatggtagtgtgcacttgtagtcccagctattcgggaggctgaggtgggaggactacttgttcctggaaggcagaggttgcagtgagctgaggttgcaccactgcactccagcctgggtgctagagtgacaccctgtctcaaaaaacaaaacaaaaaaaaaatagcagggagaaaagcttcaccttggaggctatcagacagagaaggcttcctggaggaggggacattcaagttaggtcttggacagtagatagtatttcatcagtgagagtacatttctgttagtgggttgggaaagtttcaggtgttgggaaatctgagtagtcgtatttgcctggagcacaggacaaggaatatgagttactgtgagaggcttaggaagctaagtaggcattggattgtagtgggctcttaatgtcagaagggtttagacaactttgtgaatggggtctctgagaattgcggaagggcctagtttaggtttaatatactgctgtcactgccttaaaattcttaacaatttttttttttttgagacagagtcttgctctgtcacctgagctagagtgcagtggtaccacctcagctcactgtaacctctgcctcccgggttcaagcaattccctgcctcagcctcctgagtagctgggattacaggcacccgccaccatgcccagctactttttgtatttttagtagagatggggtttcaccatgttggccaggctggtcttgaactcctgaccttaggtaatccgcccacctgggcctcccaaagtgctgggattacaggcgtgagccaccacacccggctttaacaatttttttaacaaaaggctgcatgttttaattttgccctggcctccttaaattatgtagctggtcccggaccggggaggggaacctctatcaaagcacatgtcattttgtcttgccatatttggattttctcctttgcaaaaaaatgaattgtctaaggagggactttatgttcccagtgtctgctgtggtacctggcatatagtaggagctgattaattgcttcctggatgaatgagcaagtcagagctaggctttaggatgaagcaatctatgcatggcctgccagtgagattagaatgggcaaagcagaaggcatactcgtgcctgaaagatcctcagaccctgtgcttttgcagcgcctgagccatctgggctgccttcatgctctgagccaactgtgctctgctttggagcagacctaggaaatcttgtttggtctcatgtcacccttgggcagatttagagttgtgtccccttaacttggatggatctagtatctggccagcttgttcagggccactctcgtttgtgttttttgtctctgcagtaaccacattaagaacgattcagcatcccaagctgaggggcttgttgtcccccaaattctgtggtgtacggctcctagcattctgcatgtgacctctcgtgcctgcctggcagcaaatacaaccacatctcagcttgggtgtggtttggaggatatcgttttttttttttgagatggagtcttgctctgtcacccaggctagcgtgcagcggcacgatctcagctcactgcaacctccatctcccaggttcaagcgattttcctgcctcagcctcccaagtagctgggactacaggtgcccgccaccactcccagctaatttttagtagagacggggtttcactatattggccaggctggtctcgaactcctgaccttgtgatcctcccaccttgacctcccaaagtgctaggattataggcgtgagccaccgcgcctggccggtctggaggatatctttggcatcctgttgttccagtttatttgtttgttaatatatatacacatatacaaatacaattaaagttctgcattgaaaggacttgttctttttcttgttgttgagacagagtctcattctgttgctcaggctggagtgcaatggtgagatctcagctcattgcagcctcaacctcttggatgcaggtgatcctcccatttcagcctcccaagtagcagggattacaggcacgctccaccacactcggctaattttttgtattttttgttgagatggggtttctccatgttgcccaggctggtctcaaactcctgggttcaagtgatcctcctgtctcagcctcctaaagtgctaggattacaggtgtgagccactgcacatggacagacttggcttttaaaaaattttattcccctgggcatggtggcttacgcctgtaatcccagcactttgggggagccgaggcaggtagattgcttaaggtcaggaattcgagaccagcctggccaacatggtgagaccccatctctactaaaatacaaaaattagctgggtgtggtggcgagcacctgtaatcccagctactagggaggctaaggcaggagaattgcttgaacccagggggcggaggttgcagtgagttgagatcgtgccactgcactccagcctggtgacagagcgataactctttctacccatgctggtcccaacctcttgggctgtaactctgccatccctcagcataatttgggggtatgatttcactatcctaattgcctgtcctaagtgatcttacttgctgataggacctaatgttttattttattgtttagcacttctaaaaactcatttcctttacacaagtccaatactttggacaggaaacagtagctttgttgattatgctacgtgtctttactgtctataatgattcttttatttcaggattccatgtcctttatctacaaggctttggaaaggaacataaggacaatgttcataggtggctctcagttgtcacaaaagcacgtctccagccccttagcatcttacttcttgtcatttccttatgcgaggcttggctggtacgtataagtttatctaacttgtgaatgttttcttcagtattaattttattcaatcattctgcaactgttttttatttcattttattttattttatttttgagacagagtctcacttgtcacccaggctggagtacagtggcttgatcttggctcactgcaacctctgcctcccaggttcaagtgattctctgcctcagcttcccagtagctggggttacaggtgcgcgccaccatgcctggctaatttttatatttttagtagagacaaggtttcaccatgttgaccaggctgatctcgaacttctgggctcaagtgatcttcccgccttggcctcccaaagtcctgggattgcaggtgtgagccactgtgcccagccctctgcaactgttttaaatggtgcttgttagcaccttgcttgtcaatgaattcatcatcaacaaaagcattaatttatttgattaaaaaaatttttttttctgtactagagatggggtcttgctatgttgcccaggctggtctcaaactcctgggctcaagcgatccacctgcctcagccccccaaagtgctgggattacaagcatgagccactgcacctggccaaaagcattaatttaatggttaagttattgtaacaatgaaatgatctccttacacttggtcaaatatgtttaaatacaaggaactttcggtttactaaataatcacaacaataaaggattgtttcatggaatttttgtaaagctctgatgttcttggagataaattcttacagatttcttttgtaatctagtcacatcagaaggatataagcagatagctgttatagtgatttaaatattgtaacttcatatggtaaaagctggtataccatgacagttttataaagagaatgttaggaattcctctgattttaaaattcaaccaaaactaagcccccaaaataaataaaaaaataaaacaaaacaacaacaacatacaaaactaaccccaagtatataaaagtgactattttctggaagtttggatgaaggctttttaaaaaaatcatactccttaattccaaagggcattgcatttccttggcacaatttcctgacagtccttcctttcagggcttctgtgcattcagctctagtgcaggagatggggaggtgaatgctgtctttactggtcgttcacttgtgtgtatggctacctccctgaaagatccgaaaggcctcctgctgggctggcagctacataagcacagccagccacaggggcatccctagggccattactggccagcattgagcctccaaagtgcagagaacagcaacgggtccactggagtgtctgtccctcccaccaggtatcacagccttaaacaactgctcttgactttttcctttgttctgccgtttgttctgatttcggctcactgggttctctgcctcccgggttcaagtgattctcctgcctcagcctccaaagtagctgggattacaggcgcctgccaccatacccagctaatttttgtatttttagtagagacagcatttcactgtcttggccaggctggtatcgaactcctgatctcaggtgatccacctgccttggcctcccaaagtgctgggattacaggcgtgagccaccatgctcggcctgccatttgttctttatgtgatgataagcactagaataaacaaatgacttttggtctttccagcccctgtagtgacacttgaacctttgactcggtttatccagctctgtaactggtggctcttggaatctcatctaggagcctctactaaacatgtgggactcttgatttggcccactgccaggtgcctttgtggctgtggtaaaaacatagtctatttcacacaagctcgtctttgatcagataacacattgaaacgaattgagcagatcagaaagtggcctgcgccattggctagaggggcttggctggacatgaatttcctctctactctcaggcaagccctggttttgtgtataagacaagcttcatgagtatacttttcatcctctcaggttatgtagtccagaaatgcttagaggccttgatttgtccatttttattttatttttccccttgaagaatgagactgaatcacactaacaatacaacctgagaagtgaatattcacaacagtcacgcagggtggaaaagtcagtgagagaaagttaatggactgggctctagaaaggaaagaagcaggcgacagctttaaccctagtgctcagtgcataccatggtgggtcccttcacttccctaagggcaatgacctcagctgacctcaaccaggatgggcacggtgacctcgtggtgggcgcaccaggctacagccgccccggccacatccacatcgggcgcgtgtacctcatctacggcaatgacctgggcctgccacctgttgacctggacctggacaaggaggcccacaggatccttgaaggcttccaggtgagacaccatctcatcctttctcttctagtggttagtagctactcttgcattttgtggcagattctccaggatgagtaactaataacaagaataattacagtaacaaacagctggtggtgtacatttgtgaagcactttttagttttagaagcatgtttacatcatttattttattctatcattagtctaataccttccaaaaacacacatgctattgagaactgctttgagtggccagttgggatgtgatttcttgataatataattgataatataaaacctctttatacacacacacacacacacacacacacgaaatgtatgtatttataaaactttgtaagtattttattttaattaatttatttatttatttgagatggagtctcttgctctgtcacccaggctggagtgcagtggtgcaatctctgctcactgcaacctctgcctcccgggttcaagcaattctcctgcctcagcctcctgagtagctggtactacaggtgcacaccaccaggcccggctaatttttttatttttagtagagatgcagttttgccatgttggccagtctggtctcaaactcctgaccttaggtgatccacccaccttggcctcccaaagtgctgggattacaggcgtgagccactgcatccgtccagaattttagattcacagaaaaggtataaagacagtacaaagagttcccatgtactgtttactcattttcccctatgttaacatcttacataattatggtatacttgtcaaaaattaagaataaaaacaacactctacatcactattaactaaacgccaggctttctttagatttccttcttttgtcctaagtggttattcatcacctgaaaaaacccgcagtgactacaaacgttcctcgtggagtccaagcattaattcctcccgagagcgctagggtcctggaaagtttttctaacatcagaggctttagtttttgtaacagcaataaggaggagcgtgggggggtggggtagacagagctctgctactagtcaccaatgagtgtggggcttttggtgatactggcctggcactgcattctctgagtgtcaagtgctagggggagaaccctagacttccagtcagatcgtcgtggttcttgttccaggcaaggcacttaccctttcgctgtgaagtgaatcctgtgaagagaaaataagatggcacacctgaacgtgcttgctttttttttttttttgagataaactctcactgttgcccagactggagtgcagtggcatgatcttggctcactgcaacctctgccttctgggtttaagttattctcccatctcaaggtcacaagtagctaggactacaggcatgcaccgccatgcccggctaatttttgtatttttagtagagacggggtttcaccatattggtaaggctggtcttgaactcttgacctcaggtggtccgtccgcctcagcctcccaaagtgccgggattgtaggtgtgagccaccacgcccagccatgaacacgctttcaaaaataagaagtacaatgatttatgatctagtttaggctctgatgaaaggagctctgaatccaacatgtacaaataaggtgactggtcagtgtgtaaggtcacagtcccagagggacagcatttttcagggccttctgacaccacatgaaaaatttccaaaataaatttatctaatcttgttgcttcttacttctctacaaagcctttccccgacagactgttgtgtaaagtgtaaacctttgggcacatatagacagggaataaagagaggcacctgcttcctgtggctgctaaactctctcaaagaccacttgggtgagaaaggaagtggctccatgccctcctcccctagtgacctttgatcatttcaaagatggcaagataaaggcatggacgaaggatggaaatcctgccctcaggccctgactgcagtgagcatctctgtgtcctcattgatacaatgaaggtttatgataggaaactcaaggcctggcctgctttaaagttctgtgctcctctcggaatgactggctggcccgtaggagggccggatggtgcagctgatagtgataaaatgaaccagtcctcagctggcagagccctgagttattggttcccaccctgccctagcgtgttttgtgtccccaggcaaccttatcttgtttatcaagtttctgccttacagaaaggggcagcacttatagatgccactgcacacgggtgtggagagattacctaataaataatggacgtgggtccttcagcatgtgtgttatgtggcaagcaccactgtgtgaaaggccattcgttgttatgtaagttgtgaaagaattggagaacctggccgggcgcggtggctcatgcctataatcccagcactttgggaggccaaggcgggcagatcctgaggtcaagagatcaagaccagcctgatcaacgtggtgaaaccccgtctctactaaaaatacaaaattagccagatgtggtggcatatgcctgtaatcccagctactcgggaggctgaggcaggagaatcgcttgaacccaggaggcggaggttgcggtgagccaagcactattgcactctagcctgggcaacaagagcgaaactccatctcaaaaacaaaaaacaaaaacaaaaaaaagagaaagaattggaaaacccagtgaattactttcaggtttaggctgattccagacggtaggataagaaagatctagaaagtccactttggaaaaaaaaagtctgaagagattgagttttccatctgtacactgttaaagtgaggatgctaacagttcctaccttaatccatttaaagtgcttagaacaatatctacaccgtcctacaggactttctgcactgataggaatgttccgtagctgtgctgtccagtgcgggagacataaaacacaggctttgaacatttgaaatgtggctattgcaactgaaaaactgaatttttatttatttatttatttattctgtttgtgtgtttgttttgagatggagtttcacttctgttgcccaggctggagtgcagtggcatgatctcggctcactgcaacctctgcctcccaggttcaagcgattctcctgcctcagcctcctgagtagctggaattacaggtgcccaccaccacacctggctaatttttgtatttttagtagacatgaggtttggccatgttggccaggctggtctcaaactcctcaggtgatctgctcgcctcggcctcccaaagtgctgggattacaggcataagccactgcgccagggtagaaactgaatttttgattctatttaatgttaattactttaaatttaaatgtaacagccctatttggctaggggctaccaccttggtcagcatggctctagaacatcctgagtattcaacaaatgttagctattgttgctgatgttatatgattattattttagatactttcttttttgtttgtttgtttttttgagatggagtctcgctgtgttgcctaggctggagtgcagtggcacgatcttggcttactgcaacctccgcctcccagattcaagggattctcctgcctcagtctccagagtagctgggattacaggcatgtgccaccacacccggctaattcttgtagttttagtacagatggggtttcactatgttggccaggctggttttgaactcctgacctcaggttcaggcctcccaaagtgctgggattacaggtgtgagccaccgtgcccggcctattttagatactttcgaagataagttttgtgcttaatgtgggtctgaacatacacgaggctattttctacaaatctagaactcataagaaccaaccctctactttctggcatctctgcttcccctcaaggcagacagacatgctgaaaatatacttagggcagagctacctaactgatgtgttgcagatatgttatagcttactgcaccttcggcttttgggtggcggggggcgggggttgtcccaggcctctctactccctgggggtcaggagtgctctttccgaggccgtggctcagcccaggggaagtaaacttgtgcctcttcagccctcaggtcggtttggctcggccttggctgtgttggactttaacgtggacggcgtgcctgacctggccgtgggagctccctcggtgggctccgagcagctcacctacaaagtaaggctgctgctggatagggttggaggagaatggggtggcagggaggggactctgagggaggccaacgctgggatgagcccctggagcaaagcagacagccagtgtgtgagacagagcatttgtgagcagataatctcaggcccctatggggttcttgccgtgaccttgagttaccttgtagcacctgctgctgcctccctggccttattttggccctatggtttcccaattccaccaggtacttagccctttttttcatcccccaccatgctgaatgccagtgaagggagacagaaatcccagctcatctgtagtttctggttatcacaacagcgaggtgacttccctgggcctctcctcaaatggtggatccccgcctgttgcctcctttcttactgagttagagatcctggaccctggcccacagggcttgcttgcttcccacagatgcttcctaccatagcagggaccacgcatccgggcaccatgtgtgactgtggaggtcgagggccctcccttgccagctgccctctgcagactcaactcttgccccttcctcctcacactccatttctagacatgccagcagtctgtcacgtcctgaactcatcaggctgtctcactttgcgacctttgctcgtacagtttcctctgcttgaaaagctttttctcccctgtctttctttaggagtgacatgtcacttcttgcagaaactattacctaactcctgggcgaggctgatacttccttgtccccacttagcatcctgtgcttgtacctgttatatccccttcttccctgggtgtcataatgacctgtgtgccagcctttcaggaggaaagagattggtcttatttgtcattgtgtacctagtacctggcttatgatggaaaagaagtgcttgtagaatgaatggggatggagacaggcaagttataagaggaactgattggtaacacagaataaaatagcacagtgtgtatcctcaggcaggtaagtggtacagatgtggtatgttggcattcagatgtgccatgggtacaacaggctgtggcccgggggcttcatggaagagcctgaaactgtgctggtccttgaagtgggcaaggagttgagtaagtcattctgcaagcacactgcacaattgtgtgtggaggatcttgagtaagacatcagggaggcaaagatataaatgacatcatttctgcattgtggactctcatagtctgatggaagtgacagactttaaaaaaattcctttcagcccagcagcaatgcacagaatggatttctgtctgtcattaagctcccaatcattgggggtggtgataatttgacaaggtctcgctttaattaaaagtttttttcgtggacacaggatctcactgtgttttcgaggctgctcttgaactcctggcctcaagcaatgttcccacttgggcctcccaaagcactgggattatagacatcagccaccatacctggacccagagtcagtcctttttatcttctgttatttaaggttcttgggtcaccaccagagcctcatgtctatctgctgtttgtccttatctagggtgccgtgtatgtctactttggttccaaacaaggaggaatgtcttcttcccctaacatcaccatttcttgccaggtatgtttaccactttagccaggtgcagaaacctagaactcgctgtatcctaactgccaccagggctgggtaaaatgtgctttcctggtttcttcttaaggacatctactgtaacttgggctggactctcttggctgcagatgtgaatggagacagtgaacccgatctggtcatcggctccccttttgcaccaggtggagggaagcagaagggaattgtggctgcgttttattctggccccagcctgagcgacaaaggtagtgcctgagggggaatgggtgagaccatggctgctctgtgggtctacgacaacttatcctgcataggggtttatatcctttttccttattccatatcatttcaccaacattttctaacagtctgttactcttaaagatgtgttggcaagtgatgtgcatagattcactgaaaatacaaaaggtgacccacagtttctaggtagagagccaaagagggcaaatagactattcccatagtgtctccatgtaaaacagaaacactgaggaggctttgcaccggaggcatctcagtggtgctctcgactgtccatagctgttgttgttgttgttgttgttattgttgttttttctttttttttgagacagagtctccctgtgtcacccaggctggagtgcagtagcataatcttggctcactacaacctccacctcccaggtttaagcaattctgtctcagcctcctgagtagctgggactacaggtggggactacaggcgcatgccaccatgcccggctaatttttgtatttttagtagagacggggtttcatcatattggtcaggctggtcttgaactcctgacctctggtgatccacccacctcggcgtcccaaagtgctgggattacaggtgtgagccaccgcacctggcccagagcctttttaaatagcatcctctgctccacagaagtgagctctagaaatgtatttcttgtatgaagagtgagattcaatgacattggggtcctgggatcagcatggggacatataagacctctggcaaaaactcagcaaaatgaacccacttctattaggctacgagaaggaccctttcttttcatcccagtagtcctctcacttaaagtattagtaaaaaggatgagttgtcttctttagaaaaactgaacgtggaggcagccaactggacggtgagaggcgaggaagacttctcctggtttggatattcccttcacggtgtcactgtggacaacagaaccttgctgttggttgggagcccgacctggaagaatgccagcaggtgaggctgatgctgggggctgggaaccatgaacacaggggcaggtacctgctgctatggagcgcactgagcatgaggctgagggaaaagggctaggaaatgcttgacttttgaaggaaaagccaaggctctgggcaagattgcaaattctcctccttagaaatttaaaaatacaatagacaagtgtattattttctcacagttctggaagctagacgtccaagatcaaggttgaggtcagagggttggtttctcctgaggcctgtctccttggcttgcagatggctgtcttccctctctgtgtgtctgtgccccattcctcacttctgttttttcttttgggaggagggggtgagggttcactctgttgcaaagggcagagggcagtggtaactcactgcaggctcgaactcgtcctcctgcctcggcctcctgaatagctgggactacaagtcgtgtgtgcccatgcctagctaattttttttttttaatttaaaaacatttttatagggatgggtttttgcagtgttgcccaggctcgtctcaaactggcctcaagtgatcctcctgcctctcctcttctttgaaagacaccagtcctattggatcaggatccacccaaatgacctcatcgtaacttaatcacctctttaaagactctgtcttcaagtagtcacattcagagatactgggggttagggcttcagtgtagggatcggggggaccaccactgagcccataacagtaggtacccctatatctctatcccagagagtctgctgggaggcctgtcagttgggaggcaggatggtgggtgtggcacctggagagcctggatgttgcgattaactccaatagtccccacacttccaggcctggggtcacagagacagagcctgctgggaggcctggatggggggaggtgcatttcctttccttgctcctgagtacctggccagctgtcagtcttgtgccctggcagctaagcccagtgtgcttcattctaggctgggccatttgttacacatccgagatgagaaaaagagccttgggagggtgtatggctacttcccaccaaacggccaaagctggtttaccatttctggagacaaggtatgacaagccctccccacacaggagagtggacactccaaggaagttttctcacctatacaatattgatttattgtgtctcacaggcaatggggaaactgggtacttccctttccagtggccacgtactgatgaatgggactctgaaacaagtgctgctggttggagcccctacgtacggtaggtcacacactgtgaaactgtgcttcctttcagtcatgtggctgcttgtacacgtcgtattggaggaaagtgatgagatctggagctgaacagatctaggtttcaatatttccttttttcattaataacattctgtgtaactttggggaagttacttaacctctcagaacttttgtatcaccatctacaaaactgaaattgtaaatacctatttcaggccgggtgcggtggctcacacctgtaatcccagcactttgggaggccaaggtgagagaatcacttgaggtcaggagttggagaccagcctggcaacatggtgaaactttgcctctactaaaaatacaaaaattagccaggtgtggtggtgcatacctgtaatcccagctactcgggaggctgaggcaggagaatcgcttgaatctgggaggcagaagttgcagtaagccaagatcatgccactgcactccagcctgggcaacagagcaagacttcatctcaaaaataaaataaaaataaaataaaataagataaaataaaatttgtgtttcaaagctttgttgaaaatgacatatgaaagtaacttagtgtatttttaaagcccctatcccatggaacttggagccagagaaaaattgtataggtcagttcactaggaataggtccactatgaggacctatcttttatttttcttttttgagacagtcttgctgtgtcgcccaggctggagtgcagcggtgtgattatggcttatggcagccttgacctcctgggcaaagtgaaccttgcacctcagcctcctgagtagctgcgactacaggcagtcagccaccacattatctaattttttattttttgtagcgagagggtctcaacatgttggccagactggtctctaactcctgggctcaagtaatcctcccaccttggtctcccaaagtgctgggattacaggcatgatccactgcacccacccctgaaaacatactttatataaaccattattttgtttactttatgggaaagatagtctttaaaaaaataaataaataagaaccatttcctcccagattataaaggtgaattatgcttattgtggaaacttctgaaaatacaaggaaatatatagaaggaaaaaaaaaacaccccttacccagatatttaaaaactgaagcttatactatatatgatattgtcatgcctaatttttttacttatatcttaagcacattctcatgttagtaaatattcttctaaaacatgacttttgatatctgcattgcatttttttaatgccagcatttactaacatcatcctgttgctggaattgtaggctcgtttccagtttcacactattgtgaataagtaattattgaacactcatgtacctagtctttgactgcctttctgattagttttttggatagattcctggagatggaattactggagtagaggttctaatctttctaaaagctcttgttatatatcatcaaactatttttcagaaagattgttgtttcttgcaatatgggaaagatttgaataataagcagaagtgggtcagacaggcggggtgcagtggctcacgcctgtaatcctggcactttgggaggcagaggtgggtggatcagttgaggtcaggagttagagaccagcctggccaacatggtgaaacctgtctaaacctactaaaaatacacaaattagccaggcatagtggcacgctcctgtaatcccagctactcctgagcctgaaccacaacaattgcttgaaccctggaggcagaggttgcactgagccaagatgacaccactgcactccagcctgggtgacagagtgagactcagtctcaaaaacaaaaaaacaaaaaaacaagtggattaggcaaaggaatggctaaatttttcattaaatcgaagacacagcattataacaaaaaaaaagtgctgacttagctttggaatcatgttggaagccaaaagaatgagggtcgtgataactcagtataccactggaggctatttgagtaagcagcaaaactgtttctcataaatgcagaatgttggcaaactgacaaactgcatttgccacccagaaggaaagctgagggcagtcacgccccaagtgccgtgtttcttgtgattaggcacatctgaagcctgttaataataatatgaacctgtgatcaattaagcagctgaccaatcgttacctcctcctccctgcttttgctaaccaataaatgggaagggctgtggaagctcgggagctagctgcctttgctcactagaagccgggagctctcttcttcctcggttccccttcctttaaaacagtttcttttgcttcaagttttcatttctacgttcgtcctccttggttcagtcttgtaatgacgctctcaagcagtaacagtagtaattgctgtgatgacggtctcaagtagtaaccatagcagtcagccacagaatcatttttgcttttcagagtctagggaatgatttctaagctcttgcaacacacattattaactttattttcttcaccactctttctacccaagtgttgtgaattagagtttctcaaactttcttggttttggtgcccttactctcttgataattttttttcctatgataaagtccaatataaaatagaaggtcaggcatggtgggtcatgcctgtaatcgcagcactttgggaggctaaggcaggaggatcactggaggccaagagttcaagaccagcctgggcaacacagtgagaccctgtctctacaaaaaattttaaaaattgggccaggcgcagtggctcatgcctgtaatcttagcactttgggaggctgaggtgggtggatcatgaggtcaggtgatcgagaccatcctggctaacacggtgaaaccctgtctctactaaaaacacaaaaaattagctgggcgtggtggtgggcacctgtagtcccagctacttaggaggctgaggcaggagaatggcgtgaaccccggagccagagcttgcagtgagctgagattgcgccactgcactccagcctgggtgacagagtgaaactccatctcaaaaaaaaaaaaaaaaaaaaaaaaattagccagatgtggtggcatgcacctctggtcctagctactcagcagactaaggtgggaagattgcttgagcccaagaatttgaggccagcctggacaatatagggagaccccatctctacagaaaaagaaaaaaaggtaggcatagtgatgggcacatgtagttccacctactgaggaggctgaggtgggaagatcacttgagcccaggagttcaaggctgcagtgagctatgatcacacccactgcactccagcctgggcaacagagtgagaccctattttttaaaagataaataataatagaaaataagtttaattataacttttatgtatgtatataatatgctaatttataaagtgtatataagtatactaatatataatataaatgtatataatatgtatatattatatatacatgtatgtgtctatatataatgtatgaatgtatatataactatatattatatataaatatgaattaatgtcaccatcaggttattgttattgatatatttcacccaaattgttcagattttcccattattacttgtattttacttgtatttcacccacacagtttgcggggcccagttccaaataaaaatgcagggccccttgttaaaacattgttgacaatttcaagtcagagacaggacaacatgaagacaggcataggtcctttcgaaatgcagtgcctgtgtgaccacaggggcacatgccctgcatttatgtcctaaccacttagcttctctcggcactgtacagcttttcaagtcttggaatcaggttagacacaactttcctcatttcctaatccacagcaattttttcattagtgcctgctttttatcacaaccatccctgaatatgcagctttgcaaagatgtggcatcactgaaacgaatgcaggactctcgtgtcgtaactgtgaccggcctccacccagtagttcgtgtggtgtcagatgtcactgttatctttgaaatgtcaaaatatctacagcatctttgccagttcactgaagcgcttcagtgtgcagtttgggaatcacagctataaggcacagattaatctaaatttgagatttttgatatacttttttttttttttttgagatagagtctcgctctcttgcccaggctggaatgtagtggtgtgatctcaagctcactgcagcctctgcctcccaggttcaagcagttctcctgtttcattctcctgagtagctggaactacaggcacgcaccaccatgcccagctattttttttttttatttttagtagagatggagtttcaccatgttggccaggctggtctcaaactcccgatgtcaggtgatccgcccgcctcggcctcccacagtgctgggattacaggcgtgagccactgcgcccagtcactataccattttatatcaggggcttgaacatccgtggattttggtatctgtgagaggccctggaaccaatccttcgtggatactgagggatggctgtattgtttatagtagtaaaaagctagaaatagcctaaatgtgaaaagaatcagatttaaaattttataatccacaaaatctccattttgtttaaaatgtgtgtttatagatatctgcctacctacctacctatctcactttccagaaagaaatatatatagtatatacattttcttctttatgctttttttttttttttaatagttggagtcttgctatgttgccgaggctggccatgaacttctgggctcaagtgatcctcccatctcaggttcacaagtagccgggaccacaggcatgtgccacaacacctggattatgcttctttttttttttttttttgagtattttttacacttttgataatgatcaaatataaaagatcttcttgacatcttcatagttttgacttttgcagtaatcctgaaagctggtgacattaagtaacttacagttgataatttttctttttctttttaagccatagggtcttgctctgttgcccaggctggagttcaatggtgtgatcacagctcactgttaccttgaacacctgaggtcaagcgatcctgccgcctcaagcctcttgagtaggtcagactacaggcacatgccaccacaccctactttttgtagtgatggggtctcactgcatttcccaggctggtcttgaactcatgagctgaagtgatcctcctgcctcagcctcccaaagtgctgggattataggcatgagccaccatgcctggcaagtttatagtttttctgagacacaaatatgaaccacattacaagatgatatcctctttcctgtggttttcaagagagtagagttggtgagatgcacctgtgtttcacaatagctcttttgttttctgctccctccactggaagaaaagttccacatgagaagtaaaacacttgtgtgtgtatttaaaaaatacccaccacccctgcatcccaaacacaaccctagggactagtgctcgtggcagaaattaaggcaatatggaggtctaaaagataatggtccttaatcagagggtttaagcattacagaaggaattctatgttaactagaaggtataagcattacagaaggaattctgtgttatagtagcattctagaatttgggaattcataaaggcctctgcatgtagcccttttaaaagccaaagttcttcagaattattttcagtactgaaataatatagaaatgcctacaacattaccttgagttttttctccttgtctaaatgtgtatgataatccattgtttaatttgcatgattgagaaggtgaggtgttttgaatggctgaaatttccaagtgtctagattcttctgttttaattctgaagaattaaaaaaacactttgatgaaattattttaaattatatgcttctcttctttaacagactgtgatgcgtgttagagatttgggagtattgattaattacaattcttcctcatccttgtgcatttcaaatcatttctgaaatagattcatgaatcattcagagggatatcaaaatatgtacttttgaagagctgacatagttggattagagaacacagtctcaatgggcagccctattcaggctttctaattcttgctccgaaagctagaccttggggtgacttctctgagattctcccacatgcactggggccagtgttcatcctgtgggcggcagagccagagggagaagcctcaggtatcctcttgccatggaaggactgaagcagggagtagacagagagctggaagtgttactggattcctgggcgctccagggagctcatggttcctttaggaggcacgaaaagaaagggaatgtggctgggcttggtggcttgcacctgtaatcccagcacttttgggagactgaggcaggcagatcacgaggtcaggagatcaagaccatcctggctaacacggtgaaaccctgtctctgctaaaaatacaaaaaattaggcgtggtggcgcgtgcctgtagtcccagctactcgggaggctgaggcaggagaatcgcttgaacccaggaagcggaggttgcagtgagccgagatcgcgccgctgtactccagcctgggtgacagagtgagactccatctcaataataaaaaaaaaaaaaggaatgaagattttctcttatttcaacttttcttgatattttgggctttcactctgaatattaactgttgtgctggcacattgttctcttaggagacattgtgttaggtcatgttgtttgccctgtatcagaaagctccagattgctgagcttttaaaatactctttcttatttcctactgttttctagctgttatatctgactgttgttgccgactctgctttgagccctcagtggcttctagtggacagtttcccataaacaaggcacaagtttgtccgaaaaaacaggtcagattagctcagttttacacacaaaactcagtggacgctgacgtgagattgtatccacgcactgacactttgccagcatacggcaaacttctcagagggccactagccccatcaacccacaggtgccatttatatttctgaaatcaaagctgtgttccaaataataaagtttacagcgaaattccaacaactagctttgagtttgttcaaaattcattaattcaaaaaacactttattgaatacttgtacagaaccaagcaccatgctaggtacagtggatagagagacagagacgtgaccgcatttcttgtggaatgggcgcctgatgcaggagacacagaagtgaatgcagagcgatgctgccctgccgtgggtattcagaaggcactgggcacagctcatgtcccctgtaaaatgcttacctgaactcagaggtcctggggtcaggacacaatcacttgcccatgttttgtgggccccagctgtctgcagttcttgcagttctgtagcgtttgtgcccagagctaaagtcccactggactcggtgttattatgtatgggagcacatggaagcggcctcttctctagaccagcgagattaggaaaggcttcccagaggaggggacacctgagccaaattctgcagggtgacaggagtagccagcagagggatgtggacaggggagcacgcggagcatatgcctctattccaggcagagagcacatcatgtccaaaggcccaaatttaagacatagattgggctgtggtttaagttcattttggtgaagtgtgggtgaaaaggttaatggcgctagatccccaagtgggagtcagattctgtaaggccttgtgaagagtttggactccatccagagtccacttgcgtttggatgtgtcagtcatgggggtgacctagtttgtgatacgagaaaataaaaaggtggctgtgtggagactgtattatggggataagactggaaaaaagaatacctgcctggagggaaatcactgaagctctctggtgtttgtgccttggtgcccaagctggttgtacctccctgactgccggagatgaccagcaccgaaaccgactgtcctgtaggatcccgagtgatcagtgtcacttgaggatggggtgctattccgtgttctgtaatgccttcctttctgtgaggccagcaggaactgtggttcgtttcagatgacgtgtctaaggtggcattcctgaccgtgaccctacaccaaggcggagccactcgcatgtacgcactcatatctgacgcgcagcctctgctgctcagcaccttcagcggagaccgccgcttctcccgatttggtggcgttctgcacttgagtgacctggatgatgatggcttaggtaagaaaggaacaggaccctttgacaagaattgagtccctttgcccagggggtgggtcccctaattgggtcatctgggctctgcccttataattgacagcccagtggcccaaggacctttagacagatcttgaatgaggcaagaccagagagggagttgcacttcttgaagctggtaatatgagaatcacctgtagtaattgctattgatgaatgaagtaggaaacaaaagcctttgccaggatgaaatcacagccgactaaaggagatactaatattatttgtaagaggttgggttaggatccagtagcggaacaaggaaaagatgacagtgaggagtcaaatacttccttctgtcggtttttattgttttcagatgaaatcatcatggcagcccccctgaggatagcagatgtaacctctggactgattgggggagaagacggccgagtatatgtatataatggcaaagagaccacccttggtgacatgactggcaaatgcaaatcatggataactccatgtccagaagaaaaggtaagtgttctacaaaattctataacttattgggaaaggatcactaattgctgattccttgttaactcatgtccactataaagtgcttacctgaattcatacctcctagggtcaggacaccatcatctgtccatgttttgtgggccccagctgcctgcagttcttacagttctgcaacatttgtgcccagagctaaagtcccactggacttggtgttatgtaggtccctggtcacacagcctgccactgcttggttaggcacccacagcacagaagaaagaaaacaggccatggccattggagtttctctttttaaaatagagacgggttcctgttccattgcccaggctggagtgcagtggtgtgatcatggcccactgcagcctcaaactcctgggctcaggtgattctcttgtctcagcctcccgagtagctaggactacaggcatgtgccaccacacccggctaatctttttattatttgtagagatggggcctcactatgttgcccaggctggtattgaactcttgggctcaagcagttcttctacctggcctcacaaagtgctgggattacaggcatgagccaccatgctcggccagccactggagtttcattaaaacgtcctctcttttgctttttgtttcatttctttgtttattccttttttgggtgagtttccttaagttacatttcctgggcctaaagcatttggccattatttaactttttttttttttttttttttttgagacagagtctggctctattgcccaggctggagtgcagtggcacggtctcggctcactgcaacctcctcctcccaggttcaagccattttcctgcttcagcctcccgaatagctgggactacaggcatgcaccaccacgcctggctaattttttgtatttttagtagagacagggtttcaccatgtcggccaggctgggattacagcccaaagtgctgggataacaggcatgagccaccgtaccccacctattttaaaaaatttaaaattattttttaaattgcaaaattagtgaaagtttattatggaaattttagaaaatacaaaaatgtacaaagagaattaaaaattatctacctaaaattccactctgcagagctaatacctgcttacctttagagcggatcctgctagtatttttcctatgaatttaattactaccatttattgtgcatttagtatgcatatgctaagaactatgtatcatttaatccccataaaagctatgaaattggccgggcgcagtggctcacgcctgtaatcccagcactttgggaggctgaggcgggcggatcacaaggtcagaagatcgagaccatcctggctaacactgtgaaaccctgtccctactaaagatacaaaaaattagccgggcttggtggcgggcgcctgtagtcccagctactcaggaggctgaggcaggagaatggcgtgaacccgggaggcggagcttgcagtgagtcgagatcatgccactgcactccaacctgggcaacagcaagactctgtctcaaaaaaaaaaaaaaagaaattaatattatgcccatttacagattaaaaaaattaaagatctcagctgagtgtggtggcttatgcttgtaatcccagcactttgggaggctgaggcaggaggatcccttgagctcaggagttcagcaccagcttgggcaacatagggagaccctgtcttttttttttttttttttgagacggagtctcgctctgtcgcccaggctggagtgcagtggcgtgatctcggctcactgcaacctccacctcccaggttcatgccattctcctgcctcagcctcccaagtagctggggctacaggtgcccactaccacgcctggctaatttttttgtatttttagtagaaacggggtttcaccgtgttagccacgatggtcttgatctcctgacctcgtgatccgcccaagaccctgtcttaaaataaaaaaattaaagatcagcgaggaagtttattcaaggttacactgccaggaaggcagggcacaacagagatttgaaccaagatctgattctaaagcctacccttaagtattacactatgtgcgtgcatattttggttaacaattgtgatcctattgtgcataatttgtgcataattttgtaacttttttttttttaatggagtctcactctgtcatccaggctggagtgcagtggcatgatctcggctcagtaaaacctccacctcccaggttcaagcgattctcctgcctcagcttcctgagtagctgggactacaggcgcacaccaccgtgcctggctaatttttgtgtttttagtagagacggggtttcaccacgttggccaagctggtctcgaactcctgacctccagtgatccgcctgcctcagcctcccaaagtgctgggattataggtgtgagccactgtgcctggccgtaacttgatttttctttctacctaacaatataccgagaacattttcttatgttatctgatattcttatataatatgatatttaccggccgatgagtattttatctacagacaaaccatagtttatttacccattattcaggcaaccattgttagtcaattgtgccatttccaattttcattgttttaaataatatggtaaatagtcacataaatgtttttatacatctggttatttttctgacctgtatttctataagtagaatttctggggtcaaagggcatgcacatttgtaaggctaatcaagaaatgtagaaatgaggctgggcgtggtggctcatgcctgtaatcccagcactttgggaggctgaggtgggtggatcacctgaggtgaggagttcgagaccggcctggccaacgtggtgaaaccgcctctctactaaaaatacaaaaaaattaaccgggcgtggtggtgggcgcctgtaattccatcaactcacgaggctgaagcgggagacttgcttgaacctgggaggcagaggttgcagtgagctgagatcacgccactgcactccagcctgggcgacagagcaagactccttctcaaaaaaaaaaaaaaaaaaaaaagtagaaatgagggtataagggtataattaaaattgattttaaaaagccacacaaacagtaataacattgtctctctcctcaatttttttcttcaggcccaatatgtattgatttctcctgaagtaagtatcccttgaaagactgaagaaagaaaaattaccaaaacaatgccccttggtttattttaaacggataaagtattacactatgttcttcaaagcccattaacagacggcatgttttacaggccagctcaaggtttgggagctccctcatcaccgtgaggtccaaggcaaaggtgagcccaaggactgaacttcattgatgtttatgttagtactacgggtgggatttggtggtctcacttgttaggtttatttcagattttatttttatttgaaaaggagaggaacacacagaaagtaacattcacatataatctcatcacttccttggtggaaagtttccctttttactcttcctattttatcctctacagcaggggttggggccaagtcgtctgccacctaattttgtaaagccatgaactaaaaaagtcagctcatgttgagatggttgaaaagaaatcaaaacagaatgttttgtaacatatgaagtttaaacggcagtgcagtttcagcgcccacacagctgtagtggaacatagccgggctcgtctgctgtggactgcgcgtggctgccgtcgcgctgccgtggcagaactgactggttgctttggagactgatgccccacaaagcctaagtattattatctgcctgttctccaaaattgtttgctggcccttgccttagaaaataaccattattagtattttgctattttcttccagactttcagagttttttctttctttattattttttatacagaaccttgctctgtcgcccatgctggagtgcagtggtgcaaatttggctcaccgcaacctccacctcccaggttcaagtgattttcctgcctcagcctcccaagtagctgggattacaggtgcccaccaccaggcccagctattttttcaaaaactttttgtagacatggggttttgccacgttgtcaaggctggtctcaaactcctggcctcaaatgatctgcctgcctctgccttccaaagtgctgggattataagcatgcaccactgcacccggcccagagtttttctgtttttctatggcttcagagatacacacacacaccttttttttttttttttttttttaagacagagtctggctcttgtcacctaggccggagtgcaatggtgtggtcttggctcactgcaacctctgtctcctggactcaagtgatcctccaacctcagcctcctgagtagctgagaccacaggtgtgtgacaccattccatgctagtttttgtatttttaggagacaagagtttcaccatgttgcccaggctggtcttgaactcctgggctcaagagatccacccaccttggccccccattttttttggctattacagacaaggccatagtgagcattcttgtacgtatgtgtagctttttataattgagcaagtatccccacaggtgagaatcttaaaagtaggattgctagatctaaaagtgtacacagtttaaatttcgatatggcagattaaaaagtttaaccttggctgggtgcggtgggtcacacctgtaatcccagcactttgagaagccgaggtcggtggatcgcctgaggtcaggagttcaagaccagcctggtcaacatggtgaaaccccggctctactaaaaatacaaaaaatagcccggcgtggtggtgcatgcctatagtctcagctattcgggagactgaggcaggagaatcgcttgaacctgggaggtggaggttgccgtgagcctagatggtgccactgtactccagcctgggtgatggagcaagactctgtctcaaaaaaaaaaaaaaaaagtttaaccttaaaatatacctgtaaaccactgattgcattcatccactgtataggctataagaaataaaaacagagagggcagagtccctgttcttgaaaataagattcatatacatggaaagtcaaataaaatgcaaattagtataggattaaatgctaatgagtagtctgaagaataagtctttacagtgggttgaagggctgcagaagccttcatagatttatatatataaccaggtctgtaagacttgttaagtgctgtggaccaggttcctgtggaccagggtggaaggtgggaggaggaagaggattaggaaaaattgtggtgaaactgccctctagtggccagtaatttaagtgacccatttacaggcaggtctaaaaatgtaggattaaccacataacaaaaatatggttattaactttatgggaagattctcggaaggtctgatcacagggatcctttatatgacaagcttggcttatatctaaaattttatttgtttcaaaaattaggcattgtcaagaacccatgtattatataaaactatacatatatcaactatagcttacatcagttgagagtagtggtatatataatctaaaagtaacttatattttattcctttttgtaaaacactgcaaatgtaccttcctaattattgtttacctgggttagtgttaaaattacttcacttttccagaacatacctgagcttgggggcattgaacgctctgggtgtaaagataaatcagatgttatgtttcaaaaatgggtattgacaatcagaggatgatcagagtggcctttttctgagatttgggtacaagttatgttctgaagattccttcctttctgtggcataagagcattcagtaatgaaattagtcgtaacaaactagaattaggatccggcgtctacttaagtagtgctctcactgtctctgtatttcagaaacttctcatggggctgccttccatcagctcaggagcctcagcagagcagtaacttagtgtatagtgagcagtgttgtatcaagcacctgtgagatagacaaagaaacctgagacatggtcccagccccaggtgcttgtagtctaggtgggaaaatacagcaggcccacaagaccatccaggttggtgtatgatgaccaagagccaaacgaggtcagacagcaactgcagcagaagtctttgctggtggagtcagggaagggcctgcagagatcatgggcccggagctgcatctggaaagatgactagactctgacaaaacagagagaagccgaaggccaggcaaatttagtaaatgagtaattccataaattgggaaagagagggagaataaagtaccatttgatgctgttttcttaagtgtagattttccctattaattgacactgggtattaagggataagataagcacagggctaagcatagtgtctgacccatgatacaacctcaacaaattttagctattattattatttctagatttcatcagtagttttcaaaattaaataagaaactgtcatatcctgctctgaccaaaatactgtcagccagtttgatcacccgtacctcatgtgccagctttggttcagaataacttttgtcagtttccacaaatcaaatccgacctcggagtatgaagatttgccaccactgaaaatatttaaagaccaggcatggtggctcacatctgtaatttcagcactttgggaagccgaggcgggtggatcacttgaggtcgggagttcgagaccagcctggccaacatggtgagagcttgtctctactaaaaatacaaaaattagccagatgtggtggcacatgcctgtaatccccgctactcgggaggctgagacatgagaatcacttgaaactaggaagcagaagttgcagtgagctgagatcacatcactgcactccagcctgggtgacagggcaagactctgtttcaaaaaagaagaaaatgttttaaaaacttgcagcaggttttgaaggcaattctgaaagatgggtcctaaaatgttttaagcagcagggtaggtgggaggtacgctaaacacattgacaaagccagcttctaggggaagtccttactattcaagatatgttttccacattgtaccagaactaagcatgcactgccctacttctcctttatgatttatgtgccagaatagggattggggtgagcatccttagctgcggttttcagaacttatagatgtgagaaagcggtctgtaaacaaagggaaagtggcatttgagttcaagccaggggatctggccagtgtcttattcatctttatatttctagagcatagcatgatgcctggactaccataggaactcaatagatgttatgaatgagccatgaattctgtcttgtgtcccttacagaaccaagtcgtcattgctgctggaaggagttctttgggagcccgactctccggggcacttcacgtctatagccttggctcagattgaagatttcactgcatttccccactctgcccacctctctcatgctgaatcacatccatggtgagcattttgatggacaaagtggcacatccagtggagcggtggtagatcctgatagacatggggctcctgggagtagagagacacactaacagccacaccctctggaaatctgatacagtaaatatatgactgcaccagaaatatgtgaaatagcagacattctgcttactcatgtctccttccacagtttacttcctcgctccctttgcatctaaacctttcttctttcccaacttattgcctgtagtcagacctgctgtacaacctatttcctcttcctcttgaatgtctttccagtggctggaaaggtccctctgtggttatctgttagaacagtctctgtacacaattcctcctaaaaacatccttttttaaaaaaagaattgttcagccataaagaaagaacaagatcatgccctttgcagggacatggatggagctggaggccattatccttcataaactattgcaggaacagaaaaccaaacactccatattctcacttgtaagtgggagctaaatgagaacacgtggacacatagagggaaacaacacacactggggcctatgagagggcggaaggtgggaggagggagagatcaggaaaaataactaatggatacttagggtgatgaaataatctgtgtaacaaacccccatgacacacctttatgtatgtaacaaaccagcacttcctgcgcatgtacccctgaacttaaaagttaaaaaaaagttgaacttaaaaataacagattggcccatgccaatcaaagtataatagaaagcatagtatacagaaaaaaaaaaaaaaagaaactgagggaggaaaaatagtacagagtaaagcatgggggtgagggataacctcacattccaaatcacttgtgacttagtcctttttaacttttattttaggttcagtggtacatgtgaaggttttatcttttctgttcctcccaccttccccactcaagtagaccccagtgtgtgttgttttgtgttcataagttcttttaacttagcacccacttgtgagaacatgctatacttggtatttggttttctgttcctggtcgtgtgttagtttgctaaggatgatagtccttttttttttttttttttttttgagacggagtcttgctctgttgcccaggctggagtgcagtgatgtgatctcagctcactgcaacctccgcctcccaggttcaagtgattctcctgtctcagcctcccaggcagctgggactacaggtgcacaatactacgcccggctaatttttgtatttttagtagagacagggtttcaccatgttggccaggctggtctcgaactcctgatctcaggtgatccacccaccttgacctcccaaagtgctgggattacatgtgtaagccacaggacctggccgataatcctttcttaatgaggattaataccttttcaatgtttatatagtgaaggacaaatataaaaaccaagactatcacccttctgtgccctccaatacttttgtagagttggctgttctaacacctaaagagcctagcgacactgctagttttaagccatctcatgagggacctttgtcgcattaggttacaacttgtgccaaaagaactagagggaaaagatgcggcctgagccacacgctactgtaagggccggagaggaaagcaggccttggcctcgcttgttcctgggctgtttttcgtaggatggatttcatttgtcagtcctgcagcgtggcacacttaagggaatggaatgtatcatagggtttcagtttcagtaaacattagcgggcattatctgtaaacagtaactagtttattttgtgttaaattgggaagaacctctttcttctgccacgggtgagatgatactaaaagcaggagaaaataacaaatgagaagagcccttctcttctcagcttctctcaagagtagagactggtgaaaaggggacaggaagaggaatccagctgaagagtggaaagttaacaagaacatcaagaggtacatccctagagagcatctctgggtcactcccaggatgacctcatttttctggaagaggtacatgtgctagctgcatagtaacctatggcacagcaaaagcacaaggaagcgccatttggttttgtttagggacaattattggtagcccaacctatctgaagaattacttttaattaaaaggatggttatttttaggggaccagaaattacttagttgtattcacttatgagttgagcagttagagcagactctg

SEQ ID NO: 11958 - DNA, 21352 bp, Human
acaaaaggaaaaccaaaagcgcaaaaatcctcgatctcgtggaatttacattctaggaatctacagacaaataaataaaaaagtcctgttagatgacaatacatgttattaaaaaaaagacaagaagtgtgtgtgtgtgtgtgtgtgtgtgtgtgtgtgtgtgtgtgtgtgtgtgtgtgtgtgttggacagggcatcattctagacttttcttcctcctcccttccctttgatctgattagcaaatgctttaccacctacctccttagtatttcaccttttcttactcatattcttcaaactcatggtgctactttaatttacacagacacaagaggtttctttctctacccctactaccccaattcattcgcctcactttggccagagaaacctattgaaaataaaatctgatcatgttagcggctgcaattgttcagcacccaggcttgtcaagcaaggtactctcgagcgcccccgtgggtgaagaaaataacaacatctatagcctgagaaatagcagaagctgcctctaaaaacaaaatttattttcgaaggcatatatttcaaactttgaaatccatgtgaattttgcaattgttccataatatagccctgatagttttaatatatttttaatgttttaactaacttgccagccaaattattcttttagcaccacccccaactccaaagacccccttccaaacaggtgctgacttgagaccgtgactatagagcacttgtctctaaaatgtacaaaatgaagagaaatctcaagatgtcccactgagatgaagaaagaaagaagaaaatatgtatgtttgtatacatgtatacatgtatatatatgtatacacaaaattagaaaagttagggtctactgtataaattaaataagcgttgacagtgcttttgattttaatctgtatgtggtactttgcctgcttaacacccttatgtggatttcctgacggacttgacattcctgtcaggaaagcattgcgtacttgctgattaaaaagcatctaagggccgggagcggtggctcacgcctgcaatcccagcacgaggcaggaggatcacctgacgtcaggagttcaagaccaccctggtcaacatggcgaaaccccgtctttactaaaaatagaaaaattagccgggcatggtggcgcgcgcctgtaatcccagctactcgggaggctgagtcaggagaatcgcttgaacccgggaggtggaggttacagtgagccgagatccgtctcaaaaataaaaaataaataatgaaaaaaattaaaaatttaaaaattaaaaaacatttaaaaaagcatctaacttagatgggtaatgggtcaaaagaaaggcagactgccacatgcagcgcctcatttggatgtgtctggagtcttggaagcttgactaccctacgttctcctacaaatggaccttgagagcttgtttggaggttctagcaggggagcgcagctactcgtatacccttgaccgaagaccggtcctcctctatcggggatggtcgtcctcttcgaccgagcgcgcagcttcgggagggacgcacatggagcggtgagggaggaaggggacacccgcctagccagccagatcagccgaatcaaccctggcgatcaatggggtgacagatgtcgcagccagatcgccctcacatccgaggtacccaggcggcgcacaagctatataaacctgaaggaagtctcaactttacacttaggtcaagttgcttatcgtactagagcttcagcaggaaatttaactaaaatctaatttaaccagcatagcaaatatcatttattcccaaaatgctaaagtttgagataaacggacttgatttccggctgttttgacactatccagaatgccttgcagatgggtggggcatgctaaatactgcagtctccattggtgaggtcgtcccggagcctcgcccagctcccgcgcgctagagccgcctgctggtctcacccagccgggaccgctgacctggcgctttgtgcggctccaggcctccgagtggactccaggtctgtctccctcctgcggtcgcccccttcctcgccctttctctcttcttttttttccctcccctttactctctgagtctcactctcgcattcttccctcactcccccagttcagtccttctcttgtcttttcttcctcttgtcctttgtcctcctgctccatccagtctgggcagaggtgggccccttggctggagctggggtccttcttggctcagtgtgcgtatttttttttaaaccccttctgcggagtctgaatgcattggtggaaggtgggctcggatcgtccccgggcctggctgggctgccgctacgcccctgcatgggctgagcggggaagacgagcatgggagagtgcgatctcagatggccaagccctggcccccggctcgttttacaaggccgggggctcatctccctgtaggggtggtggacacgcgggacccggggggcgcagccaccgcatgcgtgacggtggacgcacattttgcagacagtagtagtactcggcctgttcaccttccagttgccgtgataataaaatatgatgatgtatgtaaaagcatgaatacttgaagagcttccagtggctgtgcgattttccttcgctaccctcttcaacgcctgccaccccctatcccccagctgaatttggaaaatctgagattctcgaggtcaaaatatataatattctgaatttgtgaaatcccgtactgctagcacatatgtttttacaacaaatggccccagcttcccaagatccaggataagaagtcataaatagaaatcatataaaagccaaggtttttttctccatgttttaaaatggtggtttttttttcttgagtgagggaaaatgcagcaacaaaaataaagaacagtttcccgtgccaaaatcctgaatattcatttcgcccctgagcactgggttgaagacgcgaaattgggactgttggtctgcgacgagctgctgcatttgtatttcagaaagcctgaaaagctatcatggcagcaaggcccaagctccactatcccaacggaagaggccggatggagtccgtgagatgggttttagctgccgccggagtcgaggtaccttatatgctgtttcttcacggatttgtcatacagcttttgagacctttgaaagaaaaatacgttttgaagcaccgttcagttctagttctcgtccaccaaaatcacaggcacgcttcactgagtcagataccatccctgaagggatttttctttataattagaacgtagttgatggaattctattttccttttgacttttacttaattattggcttctgatctagcaccagtgaatatttattaataagaagaaaggaaatttacctgaaaattgtcagttactctgagctcttattaattatgcattctcagggtaaatttcttgttttcttcagtggcttcaaactggcagccttggtatcttgcttacatatgtgtgtgtgtctgtttttgttttcgttctgttcttttagcttcttagtatggaaattttcaaataccaataaatgtagagagaacattgccatgaattctatgtactcatcacccgacttcagcaatcatcagctctatgctaatcttgtttcatctatcacctcccttcccttgttttgtgggagtattttaaagcaaaatccaaacatcataacatttcatctgggagttcctcaacattttcctctaacagatgaggattttaaaatgtaacaatattattatcacatccaacaaaattagcaattctttgtcatctaaccttcagtctgattgtctcaaacaggcattttgtttgtttgtttgtttttatagtttgttttagtttggatctagacattggtctacgcattacatttaaaatggttatgtttctttcggtattttaaaaacctgtaagtttcctcttcattttttacaaatttatatttgggaatattttcagatttatagaaaagttgtaaaataatacagtccctcattcagtctcccttaatgataacatcttacatcaccatgtcatattacaaaattaacattggtgcatgactaactaaactacagactttattcagatttcactgttttttctactaatgttctgggtttttttttgacggaggctggctctgtagcccaggctggagtgcagtggtgtgatctcggctcactgcaacctccgcctcccaggatcaagcaattcccctgcctcagcctacctagtagctgggactacaggtgcacaccaccacgaccagctaatttttgtatttttttagtagagacagggtttctccatgttggccaggctgatcttgagctccagacctcaagtgatgcacccacctgggcctctcaaagtactgggattacaggtgtgaaccaccacgcccggccctttgctaatgtccttttactatcccgcgatccaacattatatttattcatcctgtttccatagttgccaacaatccatgacaatttcccagtcgtttccttcattttaccatcttgacggttttgaaaagcactggtcagatatttttgtagaatcctctacaaattgggtttatcttgtttttttcatgattagactgaggttatgggtttggggaaagaatgccacagaggtgaagtatgttcacgtcatcatattaggggttacgtatcaacatgagttgtcactggcagtattaacctggatcacatggttaaggtagtctctgccaggttgctgcattttaaagttactatgtttccttgtattcttctgaagcagatcatgaagtccagcccacattcaaaatgatgagaattaagctctacctcctgggtgagggagtatctacatttggaatttttatataaggaagatttatctccactcatttcttcagttattcaattctttgtgtcactatagacctaagtatattgattttatattttagattatagtctgatgacttaaattgcctaaattgtttcagctttagccactggtgctctttcaggtttacctttttttatttcagattggcctcttttttgttctcagcactttctgacagtataaaatgctctgtgctcatcttgtattaatattttcccttccctagccctagaatcaggaatttcttcaatagaaaaatggtattaaccagccggcacggtggctcacacctgtaatcccagtactttgggaggccgaggtgggcaaatcatgaggtcaggagttcgagaccagcctgaccaacatggtgaaaccccgtctctcccaaaaatacaaaaattagctgggtgtggtggcatgtgcctgtcgtcccagctactcaggaggctgaagcaggagaatcgcttgaactgggaggcgggggttgcagtgagccgagattgccccactgcattccagcctggacaacagaacgagactccatctcaaaaaaaaaaaaaaaaaaaggtattaatagccaagatctgggtgctagatgtctacgtttgtttctagtgccatttatttttggaagaaactgccctgtagaattttccctattctggatttggtttacttaccctccaggtgttgccttgaggtaacatggtaaagtgaggatacctttattttaacatgctcctctattctctgtacttcccataaattactagctggacccagaggcatgatcacttcaggctccttttttctttctctttaactttttttttccctgccagactatgtcagaagagatactgtgaacacacttctattgtatcacatcaggggttgtctcgttttcagtgatgccgaccttcatcggtgtgttcctgtgatatcaaccccaatccacacattatagtttctcccatattcttttcaacttgtggttttactagctattgatcatcatcattgttagggattacaaaatggcaattctttcaatttccatcatttcacctatgtttatgaactgtgattctcttctaagagagtacttgtcactcattaactatttaattactttaaaatatgcttcatataggaaaggcgaggtaaatgcttgattataaattttcacaataatgcgttgttgccctagcaacctccaaagatgcaaatgtgagttgttgggttatgcgttttgtgtttgttctttgtttttattttttgcctatgacaacttgccacatggtgttttacaattttctaaatgagttgacatcattttcatatgcaaattctgatttctgacttgtctttagaaattggaagatgtggtgatcctgagctcattttcacagggcagcaattgttggatctgaataaggactgccccacctcgccctcttgtttcagggtgtgtttgctaactgttaagaggaaagtgaaaaacattcatggtcccctgaacctgctcaacttcacttgtgtctgtcatttttctaacccccataggcttctgagtttgtaattcttgatttatttcataggttttgaatggatgtcttatatatgtatgcaatataaccctttgtcaaatcttctctcttcattctaccctgcccctcctactcacctatgagtcaacatttttagttacagtaataaaaactcaaccctaaataagttaaacaaaaaaagaacatgagtcatctgacccacctaccccagtccaatcacaggaacaggctgatcaggtagagtaatgagcccactcctcagaccagactggatgaagctagattggtctctctcccagggtgaccacatggtttacaaggtggtggggaggggccctccccgtctctttgccagctaagtttgtgctcacatagatctgagacagtcgggagggaccagctggcagccaccagacaagtccatgattctcaatatcccacgattgggttgaacctaaagttgaagcacacacatctgagtaactaggtcactaaaacctactgaaaaacagccttttctaattcagggagttctcaatgctggtcagtcacttaatttgagtcatcattgacattgctctatgttggttgtttcttccatgcttggaactttacttgcccgaagaccccttaaaacccaggcaaatcccctttgagacgtggaggatttacaccatttctaccattaactgggagcatcagttgagcaccttgtccctgcatatatcatataaactttctgagctaaatgtggtggcttgagcctataatctcagcttcttgggaggctgagggtggcaggatcccttgagcccaggaggttgaggctgcagtgaactgtgattgagccactgcactccagcctgtgtgacagacctctaagaaaaaataaataaataaccctttctgttaactaatatgatgttttgacttttgattttagtatgttgtagtacaaatatccagggacaaattcctcaactgaatctatctgagagacaaattgtcaattgatccaggagtactgcctgcactacatctgaccatctaggcttcgagcattgttgccccaaggatactgttcatgagcattagatggagatcctctgggagcattgaggctcctttcctcacaccatgagcacccactctggcaagtagcagaagccaagcctatgatcctgattctgccccacccctccaagttgaatgtttttcaactaaattcaccaattgttaacattttgctacatttgctttctcccttccttttttttctgaattgtttcaaagtagttgcagacatcagcatgtgtcttcctcccaatgttacaggaaaggggtcctgatccagaccccaaccgagggttcttggatcttgcagaagaaagaatttcaggcgagtctgcagtgcaaagcaaaagcaagtttattaggaaagtaaaggaataaaagaatggctactctatagagcagtcccaagggctgctggttgcccatttttatagttatttcttgataatatgctaaacaatggggtaaattattcatgcctcccctttctagatcatatagggtaacttcctgacattgccatagcctttgtaaactgtcatggtgctgtttgggagtgtggcaatgaggacgaccagaggtcactctcatcaccatcttggttttggtgggatttagctggcttctttaatgcaacctgttttatcagcaaggtctttatgacctgtatcttttgctgacctcctgtctcatccagtggcttacaatgccttaactgtctgggaatacagccccccagtaggtctcagcctcattttacccagctcctgttcaagatggagttgctctggttcacacgcctctgacaccaaggcaaaataaataattgtcctaataaccacaataccattgtcaccaccaagaaaattaacactgccttcacaacatctaatatgcaatccatattcaaattttccgttttcccccaaatgtctatataatggttacacgtctgtttagcagttataacagtttcctctcctctgaaatctacttccaatttggttgttaagtctctagttgattttcatcaacaggacctgacttttttttcatgccttcgactcttgagaagtccaggccattatgttcgtaaggtcccacatcctgaatatacctgattttcaccttgtgtgtagattcagggtaaatatttttggtgttgttttagcaggtgtgactgtgcccttctcactttgttaacaacagaagcctcaggatgtcagagtgttctccactggggagccaagtttgattgtttggttagacagagggtgagagatctcccgatctctccattataaatcgacactttccctttatcataattaagtaacttaattaagtcttctgtaaaaaagagcttttccttcctcctaccttttttttttttagcatcatcatttatggacatagagattttattgttgggtgttataatccataattgacatcattctttttgatgcttaaattttcccagatttggtagggattccccttacagggccctccatgcctttctctttcacatttgagcacttccttgctttctggcataacaaaatcaaccttctcttataggacccctagttccttttagggggcagtgatatttagaaaccaagatgtggatgctaagtctgctctttctctctgcttcttaagactgtttaacttggcattttttgtcctgagcctgtatgatatttacctccttttggagggtgaggatatctttttaaaaaattgatgcataatgtacatatttggggaatacatttgatattttgatacatgtgtatcatgtgtagtgatcaaatcagggtaattaggatatccatcacccacctcaaacatttatctttcctttatggcggaacattccaattctcttctagccattttgaactgtgtaatacgttattgttaactatagcctactgtactatcgaacactagattttatttcttctgtctagctgtatttatgtaccattaaccaacctcttttcacatcccattcctctctacacttcccagcctctagtaagcaccaatcaactttctatttccatgagatccacttttttagctcccacatatgaatcagaacatgcagtctttgtctttctgtgcctggcttatttcacttaacgtaatgacctctgtttctgttggtgttgctgaaaatgacaggattttgttttcttaatggctgaataatattccactatgtatatatacgtttcttttttaaaaatttagtttgatgaagaatttctggaaacaaaagaacagttgtacaagttgcaggatggtgagtatgaaaatgaaacaactgcctctaatactgattttcctttaagagctgctgtttatgtggaagggcaaaagtattcaatgacactgaacattcagaacagtatcctaaaaccaaaaaaagcaagagggaataaatagttgaaattgccaggaaatcacttcttattcaatagttccataaaagctggccgaagggggtgagcagttccttccacatcccggtgaacagctcctctccatccctttcttctcccctctcccctccaatctcttcctccccctttctttctctcccttgccccttccctccttctcatctttccctacttccttcacactatctgaggcatcctggcctgcttgaagtatgcaaataaatatccccatttacatggggtactttctgaagtaaatactacacagaagtgaaatcaacgaactgccccctcccttcacctttaattcctggtcagccctgctccctccttgcccatccattatagcaggagccaccagcagacccataaagaatgcgcccatcaaccctgtgagcagcctccctcccagccaacagcagggtcctcaggcccagctggaggctcccctgtgtggtaccggctctccagggctgtaaggccaccttttgtgtgtgacggtggctggaagccactaggcatgtgctaagtactcctcttgcctctcccctcacctgctccgaatgctcaaaccctcaaggccaagctgtaccctataccggcatctctccccagggtttggtatgtggaaagtgttggattcaggtttgttaaataaaacaatgggttgtttttttaactagtgacagcaaacttggtagtaaacggtctgttctgtggctacagagtagccatagagtatacatgagccaaagagtatacatgagtctcagctagttacttaggtttcatgatcagattctctaaaaacagtgctgtccagcagaacattctacagtgaaggaatcgttctattctgcattgtccaatatggtagccactaggcaaatgtgactgttgagcacatgaaatatgtctagtgcaacttagggactgaattttaagttttaaaaattgtaattaatttaaatttagatttacatagctgcgtgtagctggtgactgctgtattggccagtgtagcactgaagaaatatcttcactacattcccctcaatcccttatcactgtggataggtatttttcctggggtgaaaatgaaaagggaacgtttataacaatgctagttttcagccttcttttttttttcgaggtagagtcttgctctgttgcccaggcgtgcaatggcgcgatcttggctcattgcaacctccgcctcccgggttcaagcaattctcctgtctcagcctcccaagtagctgggacaacaggcatctgctaccacacccggctaatttttgtatatctagtagaggcggggtttcactatgttggccaggctggtcttgaactcctgacctcatgatccgcctgccttggcctcccaaagtgctgggattacaggcttgagccaccacgcctggccccttcaggcttcttttgtggctaaatctgctctcctgaatgaagttaaggttatctgtcatctggaagctttacactatttcctaaggccatgattccaccgtttcttttcattccacagagcattttttaggggttgggggacagagaagaaaagatcacttctaactctgggcttccattctcaggtaaccacctgctgttccaacaagtgcccatggttgaaattgacgggatgaagttggtacagacccgaagcattctccactacatagcagacaagcacaatctctttggcaagaacctcaaggagagaaccctgtactgtggcccctctcgagtgttgtcacttgtcagcttactgatgccttagctgattagcaacctctgtagcacaccacatttactttatgtcttacatagttagtgagatcagggaacaaaaacccaagaaggtcacgaagaccagttggaacttcagtagagagagtctgagtaaaacaaaagaataggattcagatattgaatactatatctagggtgtcattgtttcagatttcaacatttttaaatgctttgatactgctttttccctttcttgcacattcactattgttaagtattaggaatgaggagctgctgtgacattcaaggcctgggagagtgagcattagattataatttgaaatcaaagcctggtccttgcaccccttagatgtatgaccctgggcaacgtgggtataagaatagtacatttctcatagtgtcatgtgatttaatgagataatggatagagagtgtttagcaccatgcctggtacactctaagcactcaataagtggtattcactatttttataaagttgaagtttgacccatacgaagagaccaaaacatggatgctggggtaaaagtggaggagtaggatgccaggagagagagcactcatgactgtcaagctgtctgatctgtgacagatttttctgagttacaactagaattgaccttatatctttgctcttaagagacaggtataggtaaatgcttctagggacttaagttgcagcatctttaaaaaaaaaaaaaaaaagcactctgaattcttagttgtggaaactgatggcttcaaagagaggagaaactgagacaactgcttttttgttttaaggattgacatgtacgtggaggggacactggatctgctggaactgcttatcatgcatcctttcttaaaaccagatgatcagcaaaaggaagtggttaacatggcccagaaggctataattagatactttcctgtgtttgaaaaggtaggtggcagagatgcctacatacacagagcaaccaaaccacaaaccacaaagaagctgccacaaacacccttttctgtccaaggattttaaaactgagcccagttgaactaacctaagcgctaatggactcctaagagcgaatagtagccacagcacaaagctggtgtcttagagccccttggactctgctaggaccacatgattcagaagtctagaaaaagtatgggctccctgcctttgttccttattgttccttgcattcaccaagttcccaccttgtgtggatacagcagaaacttcagaagatacagaaaacaaaaactacctcattcattcattcaacaaaagttgtcgaacagctgtctcagctgacatcctccctgataatttgatatgagtagaagaaccatttccattttatttatcttccctttgctctttttgtttttggttttgttgtttttctcttcttgttatatctgcttttctgagcttcaaattctttattcctgaactgggaggaacttttttagtgtttcaatgcaaacactaaagaagagggtgtgaaaatatgggaagacctatttggcaagcttcctctgaccatctttatggaactagatttaggaaaaaggagaggtattttctggggtttctgtagctaggttttatggtatctttcccacaggcactttgtgaatgtaaaataggataatgaagaaatgtggtctggaacgggcacagaggacctggtgctttggcaaaggttcactgctcattcttaggtcccaagggcccagactgtgtcagggtttcttgcaacacgcctatgaggtgagaaccgttgtcccttttacacataatgaaatgaagtcatgaagagattcagtgacctgtccaaggtaacatggccagaaaatggagagcagggttggaactctggcctctgactacaaattcaggatgcattgtactatgccactctggctccagtagctatatttgacctggaattgtgttcggagtccctgtgacacacacacttgtgcacatgcagacacccatgggcatccaagagttgactgtgaaggggatctcccctttgctactactgcttcttgcctctccctaatcacaatctattcttataagccccacacctatacgttaccctcagaatgggagtcaagatgaactcaagcttttcattttctctgttttgggacatgtaagaggaagtctaattttataattgggttgagtttatgactacacctcttgatgttctagcagcagaactgggaaataagagtgggccccttgaagatgatctatcacttagatttcttaaatcaccctgcccctccccaagcctcctgcatgcatttctgtagatacatttttggagtagatatatcctttcaaaacaccagatgctaaatccagaaataaggaattttcccttccccacttcaatgtctcattcagatccacagcagatatttaaggatgctttcatttccacaccttttttgtactttctctctctctctctcgctctctctctctctctctccccctctctctcactctctctgtcagatatagggtgcgttctcttaattgatgttatttatgaaagcatgaaatgacaaggtcatagtttcacctcttctcagatactgcactgattcaatagcctcatcactctctccatgtggaatattgtaactgatgcacaccatttccctacagattttaaggggtcacggacaaagctttcttgttggtaatcagctgagccttgcagatgtgattttactccaaaccattttagctctagaagagaaaattcctaatatcctgtctgcatttcctttcctccaggtaaataaaactatgtattagaagattggcctagaactcttgggccttccttcagtgtctattgtttggttggctttggggagtgtgtgtgtgtgtgtatgtgtaatatttttaagattctagtttggcaaatgaaatgaaagtaaggacccaaagttatttttctggtccttaaatccttcaagttgaaagatcattgaagtgtaaaattttttttttttaaggtgggatcttactatgttgcccagaatggtcttgaactcctgggctcaagagatcctcccacctcagtctcctgagtagcagggactataggcatgtgccagcacacccagctcagaaattttcatcttaattttgttccataactgcactcctggaaaaaactccatgcacagggagtttgcctcaggggactttccatagaaataaccatagagatgaggtggtctcacactcacatgtatctactgatggaatagtgggcgagataaacatcaaaacagtctcattcatcaggctatgactccctttctcagaaatagtatggtctcaagttaggaaattctaagcctgagctctgagagcaaatgagagatgttagcaccctaaacatcaccccaaaggattcctaccattctccttctgagaattccaaggaaagacttgtgtggttcaaattatccctcagggttattctggcaggattgatcatagaactttaaaggagagaagggcctttaaaaaaaaactcatttaatgacttcaatattcacttgaggaagtagagacccagaataaagaaatcagcagccaagctggcttaggcagtggatgcttgagttttatctagaaccttagccttttatctccaagtctaatgtgcagactgtaactcctgggccaaacctggcctgccacctgtttttatacagcttgtgagttaagaataatttttacatttttaaatggttgaaaaaaatctgtggaataatatttcatgacacataaaaattatatgaaattcaaattctagtattcataaatttcattggtacaaagccatgcccactcatttacacaatgtcaaggttacttttgtttttctacagcagagttgagtagatctgatagagaccatatggcctgcagaacttaaaatatttgctgactggtcctttatggaaaaagcttgccaatccctgaaacagcctggatacagaccaaattgctatatgtttgaccaagttatcaaaagccaagagagatacactaactctccaaagagtaacacacatacttaaaacaattttttgccaagtctattaaatattttgatatactaatgagagcaattaccaccagttcaataagtacacccagaaaatgagaataaaaatcttcaacaaggcaataaaccaccatatcatttatgttatagtttatatttttttttcaatttttttttcatttacttttgcagacacagagattgactttccttaatttgattttattcattcagaacttaggatacttttcacctgaagtattcttttgcactgttaaaaaagttacttgtttagcagagaagggaaattagaggaagggatctgcaacttgttgagtgccagcttcattccagtcagtctgctaggcacttacatgcatttgctcatctgtcccgtcaaccccaccccaataaccctaggagatgggcttcactatctccattttacagatgaaaattaccagcttggaaacattacattctgcatagttgcaagactgtggatgactgagttgggagccacaggggagtcagggatctaagtctgtactctttccactagactgtgtggtttctgagaaacacatttagaagtactagaagtacctttggccccaaataggtgggatgctgaacccagaagtaggtagaatgctaagcttattaaaggtgaaatctaggccgggcgcagtggctcacacctgtaatcccagcactttgggtggctgaagtgggtggatcacttaaggtcaggagttcaagaccagtctggccaacatggtgaaaccccatctctactaaaaataaaacaattagctgagcatggtggcatgtgcctgtaatcccagctactcggaggctgaggcaggagaatcacttgaactggggaggtggaggttgcagtgagccgagatcatgccactgcactccagcctgggtgacagagcaaaactgtgtctcaaaaaaaaaaacaaagtgaaatctttccaggcatgcatatatatacatgcttgtgtacacatagacacacacctcacaggcagtaaagtacttttcattgaatggacacaaaagattttaaaagtctagggtaaatgatagagatcaaggttttttggtaaactgtagcaccaggacctattggtattttacattgatgatactataataacaacccttttttaagccccaagcattatctgcgtaaatacagttttaatctgtgatcagattgagcatcaatattttaaaacttcagaatcggacaccagatctgtgttgaatttaaagggttattcctgtgttgattaatggatttaaaaagtcacaaaaattttactatactttgataactatgaaccccagataaatcttgaaacaatacatcatttggaacaagattctaaattttggtataatatttaaaatcatacaagtagagcttaagtacgtaatgaaaagagaaaattgtcatatttatatataattaattggcatcattattagggtttttgttactattagtgacgtatgtatgtttgtgtgtgtgcttaattaaggctgtgccttgcacataataggcaattaataaatagtagctatttaaaatgacctcttcacttttaaataaatggttttatttaaatatctttaaaaggttttattagaataattatatatgatgagcatatgcttcttcatatagttcagatttttcattagatcaaatgggcttttcttctcagttactgagaattggtaagatttgattctgtgaatgaaaaatacaatgtttttcttccattccagtttatataaatatctggtatctgagccagaggctatgaaaaaaatgcaactggctatttcctgcacatagccagaaagaggattcacttactgataggagtaaaaactctgaagaagctgaatcttaagatataaattgtaccatctagtgactttttaaagcacctttacttaagtggctcatgcattttctcccagcagatcagtgcacttcaggtggctagtccgagtggtgtttacagctaattgatcacaaccagttacagatttctttgttccttccccactcccactgcttcaaattgactactgttaaaaaacaatacaaaacaatacactggaggtgttttcagtgagttttccccttccttttttttcaccttaagtgtcataattctattttgagtatgtttttacttttgccatttctgtaaagagtgcttacctttttgtgaacctggagatttgtgtaaactctgatcttgataccggtgattgatgacagagattgtaaataatcatagagatcagatcttaacctagccttgtccaacccacagcccgcgggctgcatgtggctcaggacaactttgaatgtggcctaacataaattcataaactttcttataacattatgagatattttgaggtttttttttcagctcattagctacctttagtgttagtgtattttatgtgtggcccagtgaagccaaaagattggacacccctgctaaacaaatgctaaatttcatttctgcttggaactcttcaacaagtatttattgaacaaattttggtgggccattttgcataaccatatcttcgtagtatctaataccttttttgttagccttaaagttttggttttcctttttcaggaatacacagtgaaactaagtaatatccctacaattaagagattccttgaacctggcagcaagaagaagcctccccctgatgaaatttatgtgagaaccgtctacaacatctttaggccataaaacaacacatccatgtgtgagtgacagtgtgttcctagagatggtattgtctacagtcatgtcttaatggatcccagctctgtcatggtgctatctatgtattaagttgggtcctaagttgggtcttttgtgtcaacgagatcatctcttctagaaatatcaaccttttttgtccagtaaataattgttaggggatctttattggaaaacttttttggagaggctggtatttaagttagatctgattgggctactcatgtcctgtagccagttcatcctcataataagaatgggcaggatctcttgttctctcctgagtgtctttctactctcctgagcgtctttctgctctccttatcctgttctcttatccttatcccctccagtctctgcctaatttttagtgtttaataacaaccgaatgtctagtaaatgactctcctctgagctgtaataaataaaatggtagtaatgaatgcaatcagtattagccaaaataaagaatttatgagtcattgctcattgtcttgttgtgagaattttttaattagtttttttcaaatatagaatacatttgcacggttcaaaaatcaaaaaagtataaaagggtctacagtcttggaagtcttttcaaccctgcttccccgcaaccgaatcctgcttctcacaggcaaatgcagttactatttgtgtacccttccagttacatctgacacatgtataagaaaatgcaaatatatattatttttatcttcttactacccaaaatggttatttgtaggcttctaattttttgcatttcagaactaaaagtatggtctgttaatataatgctgctgttaaactggtgttgattcacgtctcaaatactcatcaagcatcaactgggctcagggtctcccagcactttaggaggccaaggtgggtagatcacctgaggtcaggagttgtagatcacctgaggtcaggagtttgagaccagcctggccaaaatggtgaaacctcatctctactaaaactgcaaaaagtagctcggcgtggtggcgcacccctgtaatcccagctacttgggagcctgaggtgggagaattgcttgaacctgggaggcggaggctgcagtgagctgagatcatgccactgcactccagcctgggcgacagattgagaccttatctcaaaaaaaaaaaaaaaatactaatcaagcacctattacatgccaggcagactgccaggaggcagaatcgtagagcaaagcccctgctttagaagaattcagcatagggtagggggagacacacatgtaaacagcagaagtaattttaaaaaggaaagaattgccgcttttggagtatctactactcagaaattttaaaactaaggaaaggcaagtttttgatgagagtctcactcatttatctcgctacagaagggattttttgctcagtggaaacaaaagaagaaaagacaagtgggaggtgatcattgtctgatgcaatcaatactgttttcgtcagaggaaaatcaagcgcaaacatcaaggcagtgatttgccttcatatttacataatgtgagcactctgttatcaccctgatatttaaaattcctgcaagagcaaaagcctggtggcaggggcagccccgaggcaggcctgaggaacagtgctgacctaggctgctgttctgagaaagaggcccagccctggccaggcccctgagtgcagtagccaataataaaaaaagaaaatgggaagtgtgtagtaaagactttcaccctgccccaacagaggtgtggcctttgcttctggaaggcagtctctaagtcctttgaatgctagacctgacaggagtgtctttgtttgcctgggggtcttgggccacccagctagtaacaatgtgatttagggtgagagctttgagccacaccagcaatgtgatactgggtgagagctctggttcacgtggtatcagctcaactctggagggagtgaaaacagatcacctgttgggcagtcagccaggcctacctgatggaccccccagtaaaaaacctaggctccaaggcttgggtaaacttctccagttgacaatacaccatgggtattgtccttcgaatgaatcatgaatcatccaacctaagggtggttcccctcaaacttccctctaaactcttcagggaagataaacattttacacacatttagagactatacatgagaacaaacagttgacttgacaatcctcaggggtctgtattacaggtggagcagcccaaatctgaaatccgaaatgctcagaaattcaaaatgctttaaaatccgaaactgagtgccgacatggagctcaaaggaaatcttcattggagtattttggatttgggattttttggtttgggatactcagccagtaaatataatgcaaatattccaaagtccaaaaatgttctgaagtcagaaacacttctggtcccaagcatttcggataagggatactcaacctgtactgagttttgtgggatgg

SEQ ID NO: 11959 - DNA, 69834 bp, Human
  misc_feature (1)...(69834): n = A,T,C or G
tgggttcaagcgattctcctgcctcagcctcctgagtagctgggatcacaggcacccgccaccacgcctggctaattttgtatttttagtagagacagagtttcaccatgttcgccaagatggtctcgatctcctgacctcgtgatccacccacctcggcctcccaaagtgccgggattacaagcgtgagccaccgcgcccggaccttctacagcttcttgaaagccactaggtttgtggcaatttttatggcagccacagaaaactagtacatagatcccagttgtgacaacctaggtagtctccaggcactgcccccgtcccggcaccacctttgttggaggcctgtgctcagtgctggtgccctgctgctgctgccggccacccctgtggccacgttacccaccaggaggccggctctgggcctcagcctgaaggaggcccgggctttgcctctgctgccaccaggaaaagctgagtgccacctgaccctgttcagctctgagtttccggacgggcccagtagctgccccttgctctcttcaaaacttttcttggctgctctaattcctttttgcttccaactgaactttagaatcattttactggagtctttaaagagtgttgttagtatttgtttgggattcagttacattcattgtgaagccagaggccgtgcctgttctgccttgtctgtgctggtggctgcccctggatgacgctgaggtccctgcctcatggtttccctggagggcctggccccaggctccagcgattggctttctgcttctgcatcctatccttccagtgtcctccgacaggccctacacacttgccttcccccaagtggccaaggttgtctgcgcgtcccgattgcagcagcctccagtcctgtgtctgtgctttgtcacaaatgcactggcccctgtgccaaccactgagggccgacgctgcggggcggggggcactttccagctctccccatctttgggcatgcctggggcctcaccttactgttctcgttggaagatcaggccgcagcgtttgggttggtgaacctggtgaacaatccacatgtccaccatgctcattgggagatcaggctgcagcgatcgggctggtgaacctggtgaacaatccaaatgtccacctgatgtttccagaggtaccagggccaggtcttaaccccgaagccctgcagggcagaatgtggtggacgtcgtaggcatgctgtcagttggcagagcttcggagtagagtgtccagcaggttcagctgcagcctccccatgggtgggtggactgaggcgtgggggccttctgcagactggctggttgcagtgccttggggcacatgggatggtacctgcgtcccctgcagtccagcagggaggtggatgtgttcacatgtggtcaccatgcaggagtgatatctgagtgggctggcctggggcaagggggacggccagcccatgctgtgtgtgcaccacttgcagaggtttggaggtacatctgtgttctcgcccggcagccatttgacagcgtccactctggacttgcagtgtgttagggacatggttagaaaatgcagaaagtgcctgtaatcccagccgggcgtggtggcgggcacctatagtcccagctacttggaaggctgaggcaggagaatggcgtgaacccaggaggcggagcttgcagtgagtggagatgggaccactgcactccagcctgggcgacagagggagactccgtctcaaaaaaaaaaagaaaatgcggaaagtgcagttggcccaccctcaaccctgctggctgggcagagtgagagatgcttcccccactggggttcctggctcagtgacggaggtgcggggggccgacctgctgcttcccccatgagtgctgacccccgctttgttctcactttgtgtctgtggatgttaggaaagggttgtaaatgcagatctccaagttttggctgatctgtctttttttgtgtttccaggtgctggcaaaaccccgactctgggtggcggcttccacgtgaatctggggaaggagtcgagagcgcagaccctgcagaatggtatttcccaccgcggatgctgctgagcgtgcggcgggtcccagagatggggatggtggtgctagggtggagggcactgactcagccatggacctcatggcctgccacttcctcgtcaccctgcacgcccagcccaggctgctttccaggaggaattgtgccctgagtcccctcctgggtgtcctgcagactctgccagggctgtttggggagaacccagtggatcccacaggatccacagccattgcttgatggcctcagtgagatggaggcagaaataacacatttatagcagttggatattgtagtgacattctcactgcgttttgtcaaagtgccagttcaccacaaactggagaaatgtctgctgggttatttgtcttatgattgagttgaaaaagttctttatgtgttttaggtacaagtcttttatcggatgtgtgattttatatattttaggtgcaagtcgtttatcggatgtgtgattttatgtgttttaggtacaagtcttttatcggatgtgtgatttataggacattttcagccatttcatgcgttcttttcattttcttttgtctttttatttttcgctggtatcctttggagcatgaaagttttaaattctgatagtatccagtttacctatttagtctcttgatggctgtgcttttggtatcataactaacaaatgttgcctaatccagtccaaatcgtgaagatttgtgcttatgattttttggagttttgcgccttcctctctttccagtaggttttggtccatattgagtcagcgtttgcatgtgatgtaaggtaagggcctgccttcactcctgcacgtgcagacccagttttctcaggaccatgtgttgaaaacactgtattttgccagttggcatcctcttggtgcccttgctgaaaatcgattgaccgtaaacctaaaagctcatttctggatcctcagtttggcttagtgactgcatgacagtcctggtgcccgttccacgctgttcaggacactgaagcttcgcagtcagttttgaaatcaggaactgtgagtcctctaactgctctctttcaaaagtgttatgctgcctgtttgaagtcccttgagtggcaatatgaattttaggatcagcttgtcagtttctgccaagaagtcagctgggattttgacggggattgcgttaatatgttggtcattttggggaacactgccgcctaaacagtgtaaagtcttctgatacctgaatacaggatttctttccatttatttgggtcttctttaatttgtttcaacaattttattagttctcagagtataagttttgtacttcttttgtcgaatttagtctcagttgatatgtattgatcttgtatcttgcagcctggctgaactcattttttatgctgaatagttttttagcggatcacttaggattttcggtacaagatcgtgttatctttcctttctagtctagtgcctgttttttgtttttgttttttttgtttaccacattgaatagcagtggtgtgaacagacatcctcttgtccttgatcctggggaagcatccagtcttcaccattgagtgtgggttggccgtgggtcagtccaggcagggatactttgtgctaggatctctttggcttcactgtttcattgagtacactctcaggaacctgaggaccacgtgagggattcttgtgatcggtgcagccatgtcctgcagccttagtgtggatgctggaaggtggtcgggacaggtagaacatctcttgtggacagcacgtcaccctggctgttttctcctgggccatctccaggaggccgggctcttgagcacctgcctctgctcctggctgctgctgccgacgggtggccagcaccgacacacctaggctggcaggggtagttgggcttgcgatgatccctcacagcagagtggatggatccttacgcttcccttgtgcttttttccttgtcctgctgtggacttactagtagaggagtatagtcagcgcctttcttcctgactgccggtgtgattcttctgcagtagagagcaccctctgtgtgatttcagtcttcggaaatgcttcgagccgtggccgggtggaaggccagttttgtggacgtgcatgtgtgttgggcgcttgaatgcgtttcctgcaggaagcgggtgcagcgcagcacatccctcttcctctccactggctggttctctgtgtctgccaccgagagtgtgcatgaagacctggcacagtgactggatccgtcctgtcctacccacagttttgtcagttttttgttttgtctgtttcagggcttcctggcacacacgtttacagttcctccaggtgggggctggggctgcgctgcccaggggccctcctgacctcaggctgcctgggttggggcccagctctgcccattgcttgtggtgccactaggctatctcctttttttcttctactgacttcaagattttctccatgtgaagagctttgttctccacagagaatgtagtctgtattttcccaaaaactcgcggtatctttactagagttggtcgtgcctcagacctatacaaattgcaaagagtagtgtcggtgcagacgcgtgcattgcaataggattggaaaccaacaacagagaaagagaaatggctcatcttaccttttcaaaagccttttaaatacctttggttcaagaaagaaatgaaaattggaacatacatgctccctaattaggggtgagtgtcagtgaaggttgtgacctgcaggcccaggaggccccgtggaccccactcactgtgtgggggaagctgcggggcccccacccctcttgagtcttactggggatgggtggttctgggggaccctatgctgatctttgtacctgggttcccacctgaggttctgcagctgcagcctgggtacctgcagcatcaggggccatgccctgctgcccactcagtgagctctcccacccgcctgccccgggccaggcaccgctcctgcctgggtggggtgtggggctgagggaggccattggtccagcccctgtcctgtttcctgctgacttttcgccggagtcgtcccttttgctgccagtcaggccccctgctgtggcagtgatgtcctcctctgccttggctggctgggcccgccgtacctccttgctgtcgagtgtcctgggagcatgtctgtgaggcagatcctaacgtatttttcaaatacttctggagacacaagaggggattttggcccattataactggcacatttctgatgctttgggctcttcctgcctcttattttgtatttcgtatttatcttaccttttgtttgtttgtttgttttttgagatggagtctcgctctgtcacccaggctggagtgcagtggcgcgatctgggctcactgcaacctccgcctcctgggttcaagctactctcctgcctcagcctcccgagtagctggagttacaagtgcccaccatcacgcccggctaatttttgtatttttagtagagacgtggttttgccatgttggccaggcttatctcgaactcctgacctcaggtgatccacccgccttggcctcccaaagtgcttgaattagaggtgtgagccactacacctggctgtatttatcttacttttaaaaaaccctttattttgattgattgatttatcatgggttatgtttgtttaaattttgtttattcctcctttgttctccccataccgccttggttgaagttttcatatcagccctggtcccgctgcaagcttggcccacggcttccactcccgcccgccacccagcctgccaggtttggtggaaatctgtgaatgtagcttccgactgttactgttttggtgaagtcttgattgcctttcttagaaaactgcaaagatggaaataaactcacgggccacccttcctgcccgcagcgacagtcatgttctgcgaggactctgtctcctctgcttgcctccgtgcaccctgcgaggtcacaggcccctcctttggtttgctggggacacgctgagactgtatttagagaaagggtctgggagagagaaactcctgccccttccccctgggatggttgccaaggggttgagacaggcaccccatggaatgtggggagcatctgctccgggtccaccagcaagagacgttgaatgccagtgtgttttgatctctgtttttaaaatctcaggccttttgggatgatttctttgatgttctgaagcgacggttctgaaatgccgctaggtggggctctcttcattgacctgatgagcctttcgtttgggacgcgtttctcagggaaattctttttctgttctcttggtctgtttttcctagtatagcacgcatagtaaagtgcatgaaatgtgctgaccttccatgaaccacctgacaaatccacatgagtcaggcctgcagcagctcagaaagcacctgctgcccactggcttcacttggttttctgcttcatacagtgggaatcatatagaaaggaatttaaaaaaaaaaaaaagacttgtaatttttagagcattttaggttcacagcaaaatggatcggcagagagttcctgtagactctgagcacctcccaccacacagcttcccctgaccccgtcagtgcccccctccactgtggtgcacgagctgcagtcagccgccccacatcgactcatcaggatcacgcaggctctgtccacacacccgggctcaggatcacgcaggctctgtccacacacccgggctcagggtcacgcaggctgtatccgcacacctgggctcagggtcacgcaggctgtatccacacacccgggctcaggatcacacggcctccacctcacacctgggctcaggatcacgcagcctgtatccacacacccgggctcagggtcacacaggctgtatccgcacacctgggctcaggatcacgcaggctgtatccacacacccgggctcaggatcacacaggctgtatccacacacccgggctcagggtcacgcaggctgtatccacacacccgggctcaggatcacgcaggctgtatccacacacccgggctcaggatcacacggcctccacctgcacacctgggctcaggatcacgcagcctgtatccacacacccgggctcagggtcacgcaggctgtatccacacacctgggctcagggtcacgcaggctgtatccgcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagtttttatggttagggctgtttgtgacttgttcaagaaattcttatctactccaaggtctgaagatactcttgtgttttcctctggaagctttattgctttatactttacatgtaagtggtgatatgcctcaaatctttttttttttttttggagacagggtctcgctctcttgctgcccaggctggactgcagtggcaggatcatggctcactgcagcctcaaccttccaagctcaagcagtcctcctaccttggctgggcctacaggcttgcaccaccacacctggctgattattttagcagttggatctcactatgttgcccaggctggtcttgaacttctgggctcaagtgatctacctgcttcagcctcccgaagtgctgggattactacaggcatgagccacggcacacagcctgagtttacttttagaattcatttgttggaaggaagtctaaggagactcgcaggctatggctagctaattagtagttggtttctatgtgaatatctgtttattaataacatatttggccaggcacagtggctcatgcttgtatcccagcactttgggaggcggagatgggtggatcacaaggtcaggagttcgagaccatcctggccaacagtgtgaaaccctgtctgtactaaaaatacaaaaaattagctgggtgcagtggcatgtgcctgtagtcccagctactcaagaggctgaggcaggagaatcacttgaacccgggaagcagaggttgcagtgagctgagatcgcaccactgcactctagcctgggtgacagagcgagactccatctcaaaaaagagaaagaagatggtaaaaaataacttactgcagtcatcataagcccccattttagtccttttgggctgctgtaacagaacaccatagaccagaaaggcaaaacagcaggaatgtgtttctcacacttttggagctggaaagtttgagctggagatgggggagacagttgcctcctccccagctctctagtgagggccgcctctcagctccttctcactgtggcctcctccccagctctctagtgagggccgcctctcggctccttctcactgtggcctcctccccagctctctagtgagggccccctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccccctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccgcctctcggctccttctcactgtggcctcctccccagctctctagtgagggccccctctcggctccttctcactgtggcctcctccccagctctctagtgagggccccctctcggctccttctcactgtggcctcctccccagctctctagtgagggccgcctctcggctccttctcactgtggcctcctccccagctctctagtgagggccccctctcagctccttctcactgtggcctcctccccagctctctagtgagggccgcctctcagctccttctcactgtggcctcctccccagctctctagtgagggccccctctcagctccttctcactgtggcctcctccccagctctctagtgagggccgcctctcagctccttctcactgtggcctcacgtggtagaagagctgggctagttctctggggtccggtttttaagggcactgagctcatcattagtgctctgcctcctgacctagtctcccgcaaaggccctgcatcttaataccatccccgtaggggataggatttcaacataggaattttaggagtcagacattctgaccatagcagccctgcatgctgggaacacgagctggtgcctgtggggtcggggcttgggatcgagtcccagcctcaagtgtgtggcctcagagagtacctctctcttaccttttattacagaattttcaaacatacagcagagagctggtaggtaaggagccgtagcttcagcgggtcccctgtcagctgactctgtttccctctgggccttgctgggccgcggggacggtctgtgctggtgtgtctggctggtgctgcacatgtgcaggtggcagctggcacgatgccctttctgtccattcttttggggtcttggcttggcccaggcctcagctctggggacagtgaccagccttccacgtcagctcagctggactgcaggcctcagagctgtatgagctctaggcaggtggccttaggtgctcaaggtggcagggccacagccgggctgggggctccatgtgatgctgctgactgccaggggcctggcagtgtgaggcttgacctggacctgccagactgtgtaccctggccaccggcttccttgggatgcaggctcagcagctgcccacctctggctgctggtcatcattagtgaagtttggcgtgagcaaaacatcagccctcactttctccagctcatgtgcccttatcaaataaatctgggaggtcagtttttgactttatatggggatggaggccgcctcaggtagtctttgcaggaggactgtgggtttgggtgccagaggatgcagtgggaactggaatctccatggcggcagcattcctctgcatcgagccgtgacccaccacacatgtcctctgggtaccccatggggctaattgcctggagcaaggactctgcctgcccacgacgcccactgtgcagacagaagtgggggcagtaaagttggctcaggtgctccccacacagcctgtgctctgcagacagaagtgggggcagtgaggttggcccaggtgctccccacacagcctgtgctctgcagacagagtggggcagtgaggttggcctgtactctgcattgacatttgtttcccaaggttcctcctgcctgcagggcagctttgccatttccctcctgatgccatcatgtggcccgcagctttgggagggtcttgctccagggaggcgcgtgtgctcggatgttgccgtcctggccacctccagcacctcgcagcccctaggagggcgcagtggcctccggtctgctgggcatgcccttaccatggtgaaggggtggcctgcccctccacacctgtgggtatatctcgtcaggtgggacgagagactgagaaaagaaatgacacagagacaaagtatagagaaagaacagtggggccaggggaccggcactcagcataccaaggacctgcaccggcaccggtctctgagttccctcagtttttattgattattattttcactatctcagcaagaagaatgcggcaggagagcagggtgatagtggggagaaggtcagcaagaaaacatgtgaaccaaataatctgtgtcataattaagttcaagggaaggtactatgcctggatgtgcacataggccagatttatgtttctctccgcccaaacatctcagcggagtaaagaataacaaggcagtattgctaccaacgtgtctaatctcccgccatagggcggtttttctcctatctcagaattgaacaagtgtacaatcgggttttatatcgagacattcagttcccaggggcaggcaggagacagaggccttcctgtatctcaactgcaagaggccttcctcttttaccaatccacctcagcacagacccttcacgggtgtcgggctgggggacggtcaggtctttctcatcccacgaggccatatttcagactatcacatggggagaaaccgtggacaatacccggctttccagggcagaggtccctgcagctttccgcagtgtattgtgcccctggttcatcgagactggagaatggcgatgacttttaccaagcatactgcctgtgaacactttgttaacaaggcacgtcctgcacagccctagatccctgaaaccttgattccatacagcacaggtttctgtgagctccaggttggggcaaagtggctggggcagagttacagattaacacctcagggcaaagcagttgttcagggcacaggtcaaaatggagtctcttatgtcttccctttctgcatagacacagtaacagtctgacctctcttccttttccctacaccatggccctccctctgggcaggtgcaggggatggcgctagcctggctttttctcaggccgggtggctggctcttagaggagaggctggcgggcgcagggctgagcagaatgggccctgctgagaagggacgggtgggctgacccagactctgtgcggttggggaaggcggtggcgctggggcatgtggctgtaggaaaaggggcattcccactgtagcccagggcagtcaggggcatagcacctgccagccagcccaaaccaagcccttgccagacacgccgcacctcagagccctggagagaggcacattcagccacaccgcacacgccactcagagcctaaagaagggaaacaggtagaacaggatctcatggcacatggagatcacagaaaattcacatttcagtgtccttaaataaaaagtgattggaacccacatataaaaagtgagctcagaaacttacaaggaaaagcacaaatctatattcttaaagttgctgctgtggccgtgtgatacttttcatgttctgtgggaacatttggctaagagctgcctcgtgctgtgtcctagggaggcgccacatccaccacctggggaaccagctgcagctgaaccagcactgcctggacaccgccttcaacttcttcaagatggccgtgagcaggcacctgacccgcggccggaagatggcccacgtgattgctgcctgcctctacctggtctgccgtacggagggcacgccgcgtatcctttggtttgagagcctcccagagggccccatcttgatgcttagttggctcccctcgaatattgggacttggtagttgcagtaacttggtgtttgtctttaatagaaaaacaccttactggaagaactgtttcagttgatccagggctttctgaatttggggtctccttttactggatcgaagaactggggagctgggcacctgccttcctcgcacagcccttgggcatgcagagcgagggttctgtcggtgcctgagaatcatgccctggattctccccacttgtggacctactgcgccttgggtgctgtctccacgtcccctgtggttcaggccgccctctggcctgagcaggtggggtgctgttgctgagtgggctgcagccaggcgtacaccgagtgcctgcagctgtggacaccgtgactgtgggcgatgggtggggaggccgccgaccctcagcggtgtgcagctcggccttgtgcgtggataccgtgactgcaggccgtgggtggggaggccgccgaccctcagcggtgtgcagcttggccttgtgtgtggacaccgtgaccgcaggcggtgggcgaggaggcccccgaccctcagcggtgtgcagcttggccttgtgcgtggacaccgtgactgcaggcggtgggcggggaggccgccgaccctcagcggtgtgcagcttggccttgtgcgtggacaccgtgactgcaggcggtgggcggggaggccgccgaccctcagcggtgtgcagcttggccttgtgcgtggacaccgtgactgcaggcggtgggcggggaggctgccgaccctcagcggtgtgcagcttggccttgcgtggagatccagtgtctggtgttctcttgcactggtctctgtgcatctggtcctgtgcccactgctgccatctgcagacacacacatgggtcaggagctgccttcggcctcttgacagggagcccagagccttccagcctcctctgctctgtgctgtgctgtccacacctgctgtgcacctgcatcttttccctgctctctggggactccccgcttcctggtccacaccctcctcatcttgtgaggtgcctcctgcaatggctccctgggagagggaccttttccgagctgcgcccctctgaaggtggtccccctccctgccctgtgtctggtgggcgtggcgtgcccggccacatgtctgcctcccagcctgcgcccctgccgtcgccttgcctccagcattctcactgggcagttctgtggccctctggctcctggcccttgctgtgcagctgcggggcttcagctccttgcctctaatctccacgttcagaaatctcacggcagtgtgagcccatcaggcctttgctctctgacagcttcctgtcctgagcttctgttgaattcgtcgttagatgtgtctcccttcttctctgttactctgcctgccacactgaacccatgtgttatctcatccttttttgcacgtggctatctttttgctttgggacagcacctgaactttagcttccagcaggctgtttcatttctttcatgtttttcatctctaagagctctgggtcttttccgaatcttttttataatctcccgtcttcctgagtgtggcatcttctcaccttgagctcttttctgtcttggtctgtttttctggttggtccccctcgaggggtgtcctgggtgccaggtgatcctggtggcctgcttctcttttgagtggggtgcagggagggctcctggagatgacgagctggtagcctgctgacggtgcctctggccaggcaaccctcagtatcaggatctttcattaaaatgttactttttttttttttttccagacagggtcttgctctgtcacccaggctggagtgcagtggtagtatctcagcttactgcaacctctgcctcccaggttcaagcaattcttgtgccttagcctctcgagtagctgggattacaggtgtgcaccaccatacctggctaatttttttgtatttttagtagagatggggtttccccatgttggccaggctggtctcaaactcctggcctcaagtgatccacccgccctggcctcccaaagtgctgggattataggcatgagccactgcatccaaccctgaaaatgtccttttaacattttgaaatttgggctgggcatggtggctcacgcctgtaatcccagcactttgggaggcctaggtgggcggatcacgaggtcaggagatcgagaccatcctgtctaacaccatgaaaccccgtctgtactaaaaatacaaaaaaaattagccgggcgtggtggcaggctcctgtagtcccagctactcgggaggctgaggcaggagaatggcgggaacccgggaggcggagcttgcagtgagccgagatcgcgccactgcactccagcctgggctacagagtgagactccgtctcaaaaaaaaaaaaaaaagtcctttcaacattttgaaatttgtcatttctgcgtaaaagtgtttaaagcacacgtgtgcctttagggacagggatgatgcagagtgcccaggcagcccactgcagggcgagagacagagcccacgcccgcgtccctgcccgccccgcctgctgtctgcttgccccggctccaccctggggtcccactgagaggcctgctccgatcctgctctcttagaagcagaccaaggtcctgagcgagaagctgagcagagcccagggtcagcccatggccctgcctcccttgtgtttgtaggagctgtgtggggactgctgtggagcagggcctagggtgcaggccggcactgggaccccagcgtcagcaaggtggggtggaaccacgtccatgctgctgcctcactgggcctcctgtgggggggacagatgccctgggacatgggccttcatggggtgatgacaggcaggacggagagcagtcctgtggcactgccggggctgcctctgagtctggcaggaccacctttagccacaaagttcccacacgctccagcgatcctcctactaagtgtgtgcccaagggaaaagagtacctgtgtccccaccgaggctcacgcacagtgctcacagtggcagcatccaggaagccaccccgtgtcccccacgcattctaaaattagatcctggtggtggttgctcagctctggggatttacgaaaacccactgcccggtgcactgtgaacaggcaggtttgtggcacaaacttgtaccttataaagctgctaaggacaagacagcttggaacaggactgtgctcacgggaggccgcactctatcccctctggctgctggtggcctggtggggctcccttcagcatcctcagaggatgcttcgggctggtctcgggtagctgtagccctcacttcccagcccacccctgctttgccggcactttagagggaagtgggtcaggccaggtgtagcatgtcccgctctgccctcccttcaggttgcgggcagcaccgtgccctaggcctgccagccagagcccccagacccatcctggacacgtctccgtctctcaccgccctccttgttttctcctgcccctgtgccttctccctccctgctgacctgcattggctctggccactgtcctcgcctcctgcagccccagctggctggctgggctcatgtgctgcctcagtttcctcaatagctccacccacttcccttccacagaaaatccacccaggagagggtgtgtgcagccaggctctcttctccgagacagggctgcttggcccagccctgctgcctgcacagctcccgtcaccttctggactcgccacctttagccagggcgcaacagcacccaccaccccacctccaccctgccgtcagcaggacgtggagggtcctgtgcagtgagcttacgttgtggggtgcatggcccccaccccaggagaggccccccaggatcctcctatcgtatcgtccagcccatgggtgggaccagtgccctgagcccagggctggatacaagaaatcctctctcagaaggaacaagggcttgatttaagaacatccaagcttattcctccttctgcccacccttcattgttgcccgatcctcaggtgtgtccactatcaccccgaaagtgccgggggctgtgcacacacacctcctctcttggccccgtagcctggtggctgacacagccagtcccggattcctggaggaggaacggggtgctgctgagtcccactgagtctggcaaggcccggctgaccctaggcctgagtctgctcctggctcccagcccagggaggctgcgtgggcagcagggctgagacacgggacctggacatgccgggcagagactcagctggaatgagcacctctgccattgtcgagcaggtagtttgtggccagtgtgcttttcctggctgtgtgtctcgacttgttattgcagcttttgcccacagctggtttgtgggtctttgacatttgttcctgtccagccaggctgccctaggcctgcatgtgagagggcatcttgggatggtgacaggctggtgagccctagagggcgtcagagccctggggccagcactgtggatggtgccatcacctgtccccacgtaggtctgcaaagagcatgcccagcttccatggcctgccagcctcagcctccatggcgtgcctggccacgcgtgggagcaaggcctctgccgccagccgccacactcccttcagacccagctcctctctcaggctgcagaaccgtccgttcaggtcagcaggggccatgtgcattcagcttattccattctggggtctgggatgggctttcagagcccacacttctctgcccccctgttctggccagcacctccttctgccaccaggcccccttgttcctgctcctctccctctgctgccttctcaaggacagggcatttataacagtttaagtggtcagaagaaggtattaggatggctgatgagggaatcaaatggtgcacacatcattaggcatgaagacgttggcatttcaggtcaggcacagtggctcacgcctgtaaatcccatcactttgggaggcccaggcaggaggattgcttgagtccaggagtttgagaccagcttgggcaacatggtgaaaccccgtctctacaaaagaaaaagaaaacaaaaaaaaaaatccagctggtggtgtgtacctgtggtctcacctactggggaggctgaggtgggaggatcgcttgaacccaggaggtcgaggctgcagtgagccatgatcgcaccactacactccagcctaggcaatagagtgagccccgtctcaaaaaaaaaaaaaagttgccatttcagacttccgaaaggctgacctggaaacaccggcacacccagcgtgggcccatgtgggccccttgtcggtggtgtcttgttgctggcgtagcagaggtttagctgagttttgtatgttgacattattaatacatcattcctaccaaattcaattgtcgatcttactgtttgagttttggagtctctcctttaatgcacacaactgtgtctgctgctcataatgccagttctgcttctttcttttcatttttttcatgagacaggatctcacttgatcacccaggctggagtgcagtggcgcagtcttggctcactgcagcttctgcctcccaggctcaagcgatcctcccacctcagcctcccgtgtagctggactacaggcatacaccaccacccctggctaatttttgtactttttgtggcgacggggttttgctgtattgtccaagctggtctcaaacttctgagctcaagtgatctgcctccctcagtctcccaaagtgctgggattctaggtgtgaaccccccgcccagccttggttcttcctttctaacccacacacctctcatctgtttgtcctgccttttgtatgccgaggactcagcatggtcctggggagggagatgtgcctggctctctcctgtcctgggaggggtgttttctgcccttcgctctatgtatctgcggtagacttttgtgtataggactctttatcagcttgaggatgttaccttgctttctaattttccaagagtttttgtcatgaaaaatactgaattttatcaaacaccaatgtatttattggtatgattttttcatgtacattttccccttaatctgttacctaacgtaaataacactgattaattttttaaaattttttagaaacagggtcttgctctgttctcccaggctgtaccactgtggcaccaccctagctcgttgcaacctccaactccctggctcaggcgactctctcgcctcagcatcccgagtagccgggaccataggtgcactagagatggggtctcactgtattgcccaggctggcctcaaactcctgggttccagttatcttctcatcttggactcccaaagtgttgggattacaggtgtgagctattgtatctggcctgttttttctaacataagcactcgaggctataaatttctctctaggtgagtttcgttacatcacacggttttttgtttgttttgtttttttttgagacagagtctcactgcctcacccaggctggagtgcagtggtgccatctcggctcactgcaacctctgccctctgggttcaagtgattctcctgcctcagcctcccgagtagctgggattacaggtgcatgccaccatgcccacctaatttttttttttttttttttttgagagggagtcttgctctgtcgcccaggctggagtgcagtggcatgatctcagctcactacaagctctgcctcgcgggttcacaccattctcccgcctcagcttcccgagtagctgggaatacaggtgcccgccaccacacctggctaattttgtttttgaatttttagtagagaaggggtttcactgtgttagccaggatggtctcaatctcctgacctcgtgatccatccgcctcggcctcccaatactgctgggattacaggtgtgagccactatgcctggcccatgcccagctaatttttgtatttttagtagagaggggtttcaccatgttggccaggctggtctcaaactcctgacatcaggtgatctgcccaccttagcctcccaaagtgctgggattacaggcgtgaaccactgcacccggcccactacctgcttttaagaaatatttttgtgtttggatttggcagtttgactctgatgtacctagatgtggttttctttgtgtttatccagattattttttgtagaagttcaaggatttgtgacttggctgggtgtggtagtttatgggtgtaatcccagcgctttgggaggctgaggtgggtggatcacttgaggccaggagtttaggaccagcctaggctaataaaagaaattagccaggtgtggtggtgcacacctgtagtcccagctactcaggaggctgaggcaggaggatcacttaagcccaggggtcaaggctgcagtgagctgtgatgacatcagtgcatcagtgcattccagcctgggcgacagagtgagaccctgtctctaaaaaaacaaacaaacaaaaaaaaaacaaaaaaaaggataagtagaacttatgacttgatgtcttttgtctacgttggagacatcttgggtagtatcttttcaaataaagtttctgctccactctctcttcctgttctgggactccatatattagcctttctctcttttgctcatcctttcttttgctgtgtctaatcaggtgttgaacccatctactaacttcttaattttttttttaagagatggaatatcgctgtgttgcccaggctggagtgcagtggtgcagtcacagctcactgcagccttgacctcccaggctcgagcaatcctctcacctcagcctccatagtagttgggactacaggtatgcgccaccacacccactcaatttttttttttttttttttttttttgagatggagtctcattctgtcacccaggctggagttcagtggcacaatctcggctcactgcatgctctgcctcccgggttcatgccattctcctgcctcagcttcccgagtagctgggactacaggcacccgccaccatgcccggctaatttttttttgtatttttagtagagacggtgtttcactgtgttagccaggatggtcccgatatcctgacctcgtgatccgcccacctcggcctcccaaagtgctgggattataggtgtgagcaatcgcgcctggccatcaattttttatagagatgaggtctcactgtgttgcccaggctggtcttgaactcctgggctctttattttttgtagagaatggtgtcttgctatgttgcccagcctggtcttgaactcctgggcagaagctattctcctgccttggcctcccaacgtgctaggattatagatgtgagccatcactaagactccttttattagagtccagttctttggtaagattcttcatttcttcatagttaggtgaaagtcattgataagccaaatagttgaatcatttgtggttctgtttttattatcttgattttctttttgtttttgttcctttggtcttgtcttttgtcatgcttggtaatttttcattgaatcgctggaatattaggtctaaaatattacagagatgatggatacttttccatccagagggaatttaacttttctttttttttttttttgagacagagtctcactctgttgcccaggctggaatgcagtggcaccatctctgctcactgcaagctccgcctcccaggttcatgccattctcctgcctcagtctcccaagtagctgggactataggtgcccgccaccacatccggctgattttttgtatttttagtagagacagggtttcgccgtgttagccaggatggtctcgatctcctgacctcgtggtccgcccatctcacccttccaaagtgttgggattacaggcgtgagccatcgcgcccggccgggaatttaacttttcttgagcaagcagagagcacgcaggtagctcactctgatccagttgctgctggtccgtcttggttcccggctgaaggatcgtggcaggacccaggtgtcccttcctggcacctcgggactgcagaacttcctgctcggctcttttgcctttcagagctgacttctgggcttggcgggcctcagcctggtgcctgtggctccaggggcggcagctgccgtaaagggactaagtgcactgtgccctgctcgcttgttgaagttgcttcctcttctcttggcagcttggcccctcgtgtctggctggctcggaagccactgaactgtaaactctatcttcccttgccaagcgagactgtgagcactaggctcctactttttttttttttttttttttgatggagtcttactctgttgcccaggctggagtgcagtggtgccatctcggctcactgcaacctctgcctcccgggttcaagcgattctcctgcctcagcctcccgagtagctgggattataggtgcccaccaccatgcctggctaacttgtatttttagtagagatagggtttcaccatattggccaggctggtctcggactcttgacgttgtcatctgcccgcctcggcctcccaaagtgttgggattacaggcgtgagccaccgtgtccagccactttttttttttttaaatggagatggggtcttgctatgttgtccaggctggtcttgaactcctgtcctcaggcaatcctggcctggcactgccagactatgacagcttattagaattggcgagaattggaaggaggcccgagctgagacactgcaccttacactcgtgccactcagctcctcctggggccatccatgtgcctggttgcatgtgtgtgcttgaaagccaggggctgggagcgtcaggtgactgcctggatagcagctgcattatccgtgagaccacctcagtgtggctgggacagagccaggctcccagctctgtgggaggctcagtcttcagagcagggatctttgagaaggcacctgggtacccttgaacttcacagaggccatgcatgatgacagcggtgaggtgctagattattcagggtgtactgcacacaggagcccaccgtggggtgtggcagccagcagtggctcagggatttagtcactgtgcaggggatgggcaaggcccagcaatgacccactggctcttccctggaggtcagaggtatctggacaaagggcagccagcaggtctcctaccccgcatcagtcattcagggactcccagagcacctgctctgtgccacacctccaggcggaggagcagggtggtctctgggaagttcgggagggcagggctgctcatgacctaggccctgggtcttgatgggtcctgctcttggggtgctgagggcatccgagctctggggtgagtgaccccattccaagctaggatccgtcatagccccgtccaggcatgtgcggggcctgaggatgcccagtctgcctgccgggctcctgtgtgggtgcttggtcggccgctgagtgctgtatgctgagtgctgccagggccttgcccttggtgggttggggctgggcactactgctctacacggagcttcggccgggccgtgtgttcccgtgccaggtggtgttggctgccggtgaggagcactcagagcagggggggcctgcagaaggggagtggcactgggtaggggcagtgagccgtgggccggtgcagtgctgggcatcattctccagaaggtgtgggtttcgctccttggtcctcacgccgtgtgggcgccgcagtccccctctccagtcccatggggccgggaatgctggtgtccgctcagggtggggccctgccggcccctgcactgctggctgttgtggacacagccctttctgtggggctctatatacaagagcactttccctcgcttctctctttgggtatccagtaagagcatttgtatgtgaggctgttgagagaaatttcttgtttttttaagttttagttctgccttatgtaaatctctgtaaacttttccatgtaaggaaagtgtgtctgagtcaggacccatctgcagtttttctccctgcaagcatcgtgcagccagccagggtgtgggcagcctcagtttccccatcctcttcacagtggagtggcccctcgctgtgttgtccacagctgtggtggggaagcctggttggttcctggagccgggacagtttgatggcacagcagtggggtgcagggctgcaccgtcatgactggaccatttctgggccttgtcatctgctgatgggagcctcgcgtgggcctctgccgcactcaggaatgtctggcgccctttgagggcattgtgtcacctgccctctattgtgctcccgcgtctctcctttgactggcactcagctgcaccgagcagaagaccacccggcacagcgtggcaggggccagaagggaggcagaaagaggccccagctggcagaatccaggctttcgcaccctgggggccgcagacagggcctcttctctgcagacttttttctgattcccagatggtcagaagcagctgctcagcaaaagggaggggctgctgggaggacacaggtaccagccatgctggacacaggagaacctccagagccctgggagctcattagctgggggacctgtaggctgggccccaaaggcattagtaggccctcccgggattggccagagggaatgtgatatcctcacaagggaagcacataattgagcttccatcgtctggaaacttccctgaaagcgcctgatagagccaggtgaatgcggatcaagtgccaggtgattttcatttcaaggaaagcagtaattctaacttcgttaaatgtttaatttgaagctccttttaaaaatgtacacacttatcccattgttttattaagaaaattttctgtggagcttggtggcttatgtctgtaatcccagcactttgggaggctgaggtgagcagatcacctgaggtcaggagtttgagaccagctcggccaacatggtgaaaccccatctctactaaaaatacaaaaaaaaattagccaggcatggtggtgcatgcctgtagtccaagctacttgggaggctgaggcaggagaatcgcttgaacctggtaggcagaggttgtagtgatccaagattgtaccattgcactccagcctgggcgacagggcaagacttcatctcgggaaaaaaaaaaaattcgaacacctgcaaagttgaagtgaattgtggagtcccctcgctcacacctgtggtccgctccccaaagctatgctgccctcaccatcttattttttggcacatttcaaggcaagttgcagacgtctgtgtactgcacacagtccttcagcaggcagaccatcagctcaatgggggtgagcatcgttcctgggtctttttctcctctgaaggtaaagttggcttaaagtgagatgcacaggccctaattgctccatctggagagttctgacaaacggtcacccgtcagcccagagcagggctctgtggacagacctcatgccccttccaacagtcccagccccgcaaaaggcaaccgctgtttccatttccttccactacagaccagttgtgcctgttctagaatgccctataaatggaatcatatgatctgtgccctgtcacttcacatgcttttttttttggtgacagaatgtagctctgtcgcccaggctgagtgcagtatggttccatctcagcttactgcaacctctgtctcctgggttcaagcgattctaatgccttagcctctcaagtagttgggactacaggggcacgccaccatgtccagctcatcttttgtatttttagtagagacagggttttgctgtgtaggccaggctggtctcaaactcctggcctcaagtgactgcccgccttggcctcccaaggtgctgggattacaggcgtgagccccgtgtccggtggacatggttttgagaggcgcccatggtgttttgtatggtgagtggtattgctgtgtgaataccagccagagtattcttgtattaatggacacctggactgctccccgtttttggctgttctgaatgaagctgctatgaacatttttctacaagtttttttgtggacatatttctttttatttttagagacagagtctcactctgtggccccagctcagtgcagtggtgcaatcacagctcactgcaacctcgacctcttgggtgcaagcaatcctcctgccttagccttctgagtagctgggacaataagtgtttgtcaccatacccggctaatttttggatttttttgtagaaacagggtctcactgtgttgcccaggccggtcttgaactcctgggctctggtgatctgctggcctcagcctcctaaagtgctgggattatgggtgtgagccactgcacctggctgacatctgtttttatttctcttgggtaaatacctaggagtggaataggtgggtcagaggtgtgtgtttagctttgtaagaaacttccaggccttttcccaaggtggttgtaccacttcacgcttccatcagcagcatgggtgagctgtgcttgccccacatcctcgccggcattcagtgacgtcgcgggctcgtggcattgtcacagttttgtttgcatttctgatgattaatgcagttgagttctttttcatgtgcttgttggctatttttttttgtcttcatgaagcttctgttgaattgttttgcctttttttattttggcctttattctttttcttatttaaatagagttcttttttttgagactgagtctcgctctgttgcccaggctggagtgcagtggtgcgatatttgcttactgcaacttctgcttcctgggttcaagcaattctcccacctcagcctcccaagtagctgggattacaggtgcccgccaccaccccctgggtaatttttgtatttttagtagagacggggtttcaccatgttggccaggctggtctcaaactcctgacctcaggtgatcctcccacctcggcctcccaaagtgttgggattacaggcgtgagccactgcgcctggccttagagttcatttctttttttttttttgagacggagtctcgctctgtcgcccaggctggagtgcggtggcgccatctcggctcactgcaagctccgccttctgggttcacgccattctcctgcctcagcctcccaagtagctgggactacaggtgcccgccaacacgcccggctaatttttttgtatttttagtagagacggggtttcaccatgttagccaggatggtctcgatctcctgaccttgtgatccacccacctcggcctcccgaagtgctgggattacaggcgtgagtcaccgcgtccagcccagtagagtttatttcttagagcagtcttagtttacagaaaaattgtgtagaaagtacagagttcccatacacccccttcaatccccaatttccctatgttattaacatcttgtgttagctggtccatttgttatggttgatgagcccgtcttgccaagttgttgataagaaaagtccacagttcacattgaggttcactcttggggctgtgccttctatgggttttcacaaatatgcaatatgtgaacccaccagtgcggagtggtgcagagctgcagcgtcctggaaccctcctctcggcccacccaccctgcctttccccagcccttggtggccactgacctaatgctgtctccatagttttgccttttccggaaggtgtatgcttggagtcacacagggtgtagccttctggcctcgttcacttttcccgttggtgtgtgttggctgtcacgggcgtttccccaggtagttcttactgctttcctttggtttcctttgatgtcactggccccacccctgccgccggtcttctcatagtgcctcttgtgaggctgttggctgtgctgcagtcggtcctgcccgttgtctcggccctctgggactgcctgccttcagatgcacctttgttcacgggcctcaccgctcacgtcccagccgtcctgggggttctgctctgtgtcggaatgcccctgtacccagccctggcaccttcttagggtgggaggccttgctgttctgcatggagttgcaagagaggtcaggggcctccagcccagggcgtggatgagtgggctggcgtcctaaccatctgattgcttgcgaggttcttgcgtggtggggctttgctgctctggtcccggggatcttcctttggacccctgctctggactcctgatccagctccaggaggtgtccttagtgacttctcgaagctacagtgggcccatgggagatgtgcacttcagctgtctggcagagtgtattaaccagtgacttgtgtttgataacttatgtatccatgtgagttttgaatcacttaggacacattcttggtcctgtttgttcatctgagcgaagacaggtcctgtgcggggtccccacacctgtctctcgagcgcagcccccagtggcgcctgcaggctcaccactcaccaagggggccccaggtctagttttctgtctctcgggaggactgcctgcctgacgcctgataggtgctcagcaagtgcccttgggatggagcatgagtgccactgtctcttctgtgctgtgtgtgggcagcagatccaccatatggtgggcacctgactgggcaggcgggtgtgtgggggtgcacgctttctccaggatcagatggaagcccccaccgtttctggttcccccgacccggctccaggttccttgcagtcccttgtcctggtactgggttcacagaagtctcacttgtgcctggggctgggaggttctggtgaggcctgagcgtgccgcgcctcgcttccataccacctttccttcctgatcaaaggtggagcttatatttggaggggcgactccagctccctgcaggtgcagtcctgcggtcctgcccatttgaaggtgggcgagtaacctgagcttgcagccactcgacaggatccttgactcctgctgcagacatgctcctggacctcagcgacctgctccaggtagacagcctccgtcctgcatctttccccacctggggttgtgacctgggggttgtgaccagggttgtgaccggggtgtaccccaggtgcctccacgcatctcagtggccggtctgtgctgcctgcccagtcaggaagttttggtctgtaggatgaggggccttcatgacatgggggtcacagtccgagacttgtgggagtgtgggtctccatggcaggagggcacctgccaatgctgggcacggttgggtgttagctaggcctgggtgaacagtgaacttttgtcctacacaaaggagattattttcaattaaaaaatttttttgtgagtacctagtttggtataggagattatttcttttgaccttgcattttatttatttatttatttatgagatggagtctcgctctgtcacccaggctggagtgcagtggcgtgatctcagcttactgcaacctctgcctcctgggctcaagcaatcctcccacctcagcctcccaagtagctgggaccacaggtgcccaccaccatgctcggctattttgtatttttagtagagacggggtcttgctatgttgcccaggctgctcttgaactcctgagctcaagcaaccctcccaccaaggcctccctaagtactggggtcacaggcatgaacaaccatacctggcctcttgcatgcattttaaattgtagaaaaatcttatattacagtctgtttggagacactcactttctgggtaccacagaaagcactttcagttacatctctctttccacatgactgaacaaagtgacagagtggaaagaccaaccccagggacccctgtgcagacaggatacagggtgggggcaccgaggctctgcagggacggtgctgggggctgcaccacaggtccttggtgaccatgctgctgaggactcagaaatattgaaaacagttgtgaccacagtgcagaattcatgtagatttcactcctcaaagggagctctgtccagatccaggtgcccacaggggttctgggcacccacaggctgtgctgccacctctggtcctcaagggctttccgcctttggcagcagcccacagttaggcttctgcccgtgtcaggtggcatctggggtccttgtcctcccagctgtctttataaatggcaactcagaagctactgctgaaacattttgtggtcaagctaaaaatagtctgctggaattgtgataatccagcaagtccacatttcagatgctctctgctcagtgcagggcaaaaccacatgaccctggttccaaccccacgacttcccagggaagatgagtatgagggccagggccagggcagctgctccggaagtggtcaggctcctggggactcagatggtcccatggcgagctcatggagtctccctcttgatccctgccttagggcagacccaggttgttcactggcctgggcacacagctcatcagacacccacgagggcagtctgcaggcagaatccacctgctgcccaggaagagagatggggggggcagctggctgtgccccaccctgacctgccctcaaggagcagccacagttagactgttagcaagagaatttccaataaatggtcctcatacatggtagcaactctgtaaagaactgcatgtatttaggccgggcgcggtggctcacacctgtaatccccgcactttgggaggctgaggcaggcagatcacctgaggtcaggagttcaagaccagcctggccaacatggtgaaaccccgtctctactaaaaatacaaaaattagctgagcgttgtggcggatgcctataatcccagctacttaggagggtgagacaggagaatcgcttgaacccttgaggtggaggttgcagtgagtcacgattgcgccattgcactccagcctgggcaacaagagtgaaactccgtctcaagaaaacaaacaaaaaactgcggccaggtgcggtggctcactcctgtaatcccagcactttgggaggccgaggcgggcagatcaggaggtctggagatcgagaccatcctgtctaacgcggtgaaactccatctctactaaaaacacaaaaaaattagctgggcgtggtggtgggcgcctgtagtcctgactactcaggaggctgaggcaggagaatgacgtgaacccgggaggcagagcttgcagtgagcagagattgcaccactgcactccagcctgggcgacagagcaagactccgtctcaaaaacaaacaaactaaaacaaaaaaactgcacgcgttttgcacacatggctttttaaacgtgagtttccatgtaaaggccctttggagattcctcacttgcagtgttcaggtctcattgatccctgtgtctctgggacacaaggttggggggtgtggagtttgaggtgggcaggcagaggccagcagcagatcatggttctgctgtggcttaaagagagatggtgggatcaggacgatcaagatgcaggggcctggcaggaacccagcacaggggctggggcactcatacatgacatgcgtgagtcacacctagacacactgtatgcgtgtgtacacacatgcatgtctgcacactgcatgcggatgcacacacacactacatgtgctgacacgccccccagtttggtgagcagaccccagggatccctggaacccccagaaactgtgaggaggggaaattccttcagaaggcacactctgtgagccaccagcccttgtgatggagccctcggatataatggagaagatggaagctgcgccccactggggtggatggtgaccaggaggagctgctgtgggggcccagccctcccagcgggcagggtccctgatcagaggcatcccccacaagcgctgcctctggctcttgcctctgtctcttgcctctagcgcagacaggaccctttgtgtgcggtcccttaggtctcccagtaccctggagtcagcaagcacctggaagtgccactggcgggccaggacaaggggacttgtctaagggcccacgagccgggcttggtcaggcgagggaattctttgggggaggctagtggcagagggtcagactggccaagcctgtgaggcccgggggccccaggggcaagcctgggatgaagacagccaagtgtgggcagggctcttgcaggctccagtagggaccaggctattcccgctgtgcacctcatccacacctgccagcagacattgctctgaagtgtcctcccccagccagcagggctccttaggggtactcggcccacggcagggctgtgcacagggtctgcacacaggctagagtccttgttttgctgaggacaagcagcggtgctcccatcactgccagccctcggcgttgcccttctcggtctgggcctcacctccactgccctatggcagatagccgaggcaggggtgacaggatctgtgtggatttggacctaaggtaggaacagtgtggggggcaggggagtcactgaggaacacagatctcagtcccagcaagggggctgaggccaagacccctgggcccatcggaatctgggctggaggtgtggctggtgggagcacatgtggacagaactggttttgtgttcatgggtgtgcagttgtgaatgaaatgctgcgtgcaccgtgtgatgacgccctgggaggaaccttgcagtcaggttttcttctaagcagatgccatcattggcgagacggcagcacggcctaaagcagcggcttagaggaagaaggcagggccctgggagccccagcagccaagggaggccagccaggcttgcgggtgtggggtggctgctccacgggccatcggagtctttaaagactgcacaagagatgcattttaagagaaaaaaagcaaacatttccttaaataccaatgctgtttctggttgtgatctctccatctcaggtgaatgtgtacgtgcttggaaagacgtttcttctcttggcaagagagctctgcatcaatgcgccggccataggtaggcatctgggtgagatgctggggtgtccggcaggctgctgtagggaccagcgtgccaaatgtcctttgaacagtggagggaaatcctgtccaagcatgggacccctcaaggtaagaaatgtttcttaaagctgctaggagctcagtaatgtggggccttattttctaagacacagtctcgctgttgtccaggctggagtgcagtggcacaatcgtagctcactgcagcctcaaactcctggcctcaagtgatcctcgtgccttcgcctcccaaagcactgggattacaggcatgagaccgcacctggcctggggcttgctttctgctgcaaaaccagaaggcctgttgtcagtgcctgtcaggtggcaggaaggtgtagacagggaaacaagtgctgcgtgctgggagcatcttgtgtggacaaggtttaagggacacacctggctccaggtgcctctggacagatggggacagtggggcagctcctggttgtgctttccagccacagccctcttttgtggtttttctgccacttttgttctgtgttgtgtgcgagtttgtggaactcctgtatgcctttcttgatgtgtgttaggtgtagggtaagtcctgtctctccctcgaggcagcagcagtgttcatgcatgcagaatctaacctagcggaaaagtctagaaggaaaggatcaaaacagcactcactgcccgatggttctgacctaccctttctttaccaagcagatgactggtttccatggcccgcttagaggcccctttcttactttgcctgtttgcatctaggagcgtatgtcctttgggtagagaagcaccaggtggggctgggtcaccaacaggactgagcaacacgggctgcagcagcagaggggcaccggctgaggctatacactcggcccatgccctctcccaggtgccaagaggggccatccctcttttcgggggtcatacaggttttccagaaaacaactgcctacagggtatgcagagtgggaggagagagacaaggggtgggagagcctgtttcaccctatagtccactcctgcaacaggctgtcccgcagcagtgtcacagctagtgacagtccccagggtccagaacgctgggcccagcagaatgctcccccgacagtctgttcatagggtaggactctgaggtgctagtgatgcattaggacatagagacaaccaggcacctggtgtttcctagggtggcccagaagccagccagcaacccaggggacagatgggcttcactggggcgcagtttgctcctaaccacatagcatgttcagcatgacaggttttctcctcgggatgggagggagctgttctgttgcatgagaaagagaataccccactgtacaactgctgtagtcatttactgacacgtgggtgttattttaggcaacctttattacagaagtccactattttaagtgactttttgccaattttagatttgaagggaaggtctcaagttaagcttggaaccacttagaatccaagagggtagcaggaagatccaacccctcaaagcaggtggcatgggtgccactgggaggggatctggggcctgtcttgagccgtaaatcttcctccacctgagacgtgcaccccactgtaccagagatgcctaagactccaatccctgggttctggctgtgtggaaaatgtctctacacagtcaagcttcagctgactacatgtcaaagagagacaaagttaagagcagcctttcatggtgtcaagaagcagttagcatcttgacttcccctccactcactcgctgacctgctgcagcctccccgggcacctcaggcatagaaaatgagctcagggatctgcccaccctggaccccagtcccgttggtgctgtccgaggagcactggaactggaaggccacctttccacactgcacttccgtcatcccctcctgcccaaagtagctgagttcgctgccgtccaggacggcactggccgtgtagaaggtgtcttgttcaacctggaccgggtgttcaaaccagaccgggaaggtgttactggatccgtctgacatgaacttggtcaagttctgagccagaaccaccccgagccgcttgagctcaatcttcacgctgtactcagccttcccagagctggagccatacaggcccagccctgcaataaatacccttctgtccactgcaaactggatgctgtcgcagcgcccgcggtaccgccactggttgctgcggtaggcagaagactggaatcggtggcacctctgcggggcgaggcccttcctcttggtcaggggaaagtccaggcggggcttgttggtggccgtgtaccacaggaagatgctgtgggtctcctccagagtcaggatgtctgactgggcagcgccgttggcaaactcctctagggtcatggttggaattcggaccagatagagggctcgccccagaacatgcctcttgtttcgtggggtgattggcagcccctgcctcttgcactccgcctcggcccagttcaggacggcctcgaagaccaccgcctctttggtgttgagggcctcccgagtgacaatgatctccagcgtctgccggtctatctcacagaagccttcggaccgtagggccatctcggcctgtgcgtcaatgacctcccagcagcgctgcgtcagctcgggctcctcaaacagccggctctgggacagcaggacgcaggcgttcttggcttccaaacttgtctccagaaagttgacacaggcttttgccaatgctgggacgatgtacttcttagcagcgtacagagtggccagcaccgtgtcggcttccagatcgatctcatcactgtacatgtacctaggcgaggcagggcccgcgtcaggggctggctcccaagcacccatcgcggggctgggcctgggagaggagtccatcagctcctgtgtgcttcccttcagaagcctccggaggccgcctaaaacggacccacccgtccctccccagtagagtggacttactttaagaggatcagaaaggctgcgggctccacgtctggaatgtgaatttcagatttgacttccgccaggtctccgtagaacatggcatagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcattgttgaacatgagcgcgttcctgcaaaggtagaggcacgggctgggggcgtgggcgcgcgcgggcgcgggggccgcggggcacgggctcacctctcgcgcagcgtggggcggcagcaccgccagccggggctctcctggtggttgttgccgagtgtgggcggcgcgggcgcgggcggcggcggcgcgggcgcgggggcgctgggcgggctgcgcggcccggccttcctgcccacggcggcgccggcgttgctgttggctaggtccgcggccgcggcgctggcgggagcgtagagttccgccgccatcttcgcgggcggggcggcgggggcagcctcggcgcctgtggacgccgcgccccgcgccctcgcgccgcgccggggcctcgggagcggctctgcaagcaaaagcaaggaggtcaggcactgagcgacgcggccgtgcaggcaggctaggggcagcagcatgggcggcggcggcgctgtgacccgcggggctgccacccgctcccctgccacccccgcccctgcgaccctgcccgagcccagcctagcgcagcccggccaggcccggccgcggggggcgccgtcccgcccgcccgcccgagcccgtacccgccgcggcgccggtgcgtcacgctgcgtcagggccgcgccccgcgcgacgtcgctgcctcgcggccccgcccccaggcccgacatcctcgaagctgctcgagcttctgcccagcaaccggcgcgagccgcgcgctgtgcagaggtagccgtggaaggcggctcccggcgctggcaggcggccgcccccagacccgcagtgccatgcgcaggtgcttgcgcccgttcttcagttagcgatcttttggttaggaacgcaggtggacctgcttgtttggccatttgcattccggagtctgcctctggccgcggcctgtgggatggtcgttgggcttcctcgttcgttcagatgcttcgcgatttagcttgctacggacgccagcagccagcgcttgcagagagcgcggtccactctgctctgagggctttacaggggcaggcgctgctatttcccggcattttcctcgaggaaataggcacagagaggttagtcgcgcgctgaaggtcacacagccggcgggtgggcaagtcaggatctggccctgggcctgcagccctggagcttgggccccagggcgcgccctgcctctgtggctctgcctgtggatcgcagtcgcaggctcgctccttgtggggcctctagcctcccggcctggggctaatcctgggaggtgcgtggcatggggcactggctttgctgatgaggagaccagacttcagaggccgtgtcacctggcctgggccgcacagctggtgcatgccaagctcgcgtgcagacgaagctccagaggcctggctgtcaggagggttcctccccgaggacacacacgcaacctcctggaccgccaggctttagacttttaaaacttccatatgcaggaaaccccacaggacgcagccagcatctcgggtcatgggtgcacctgtcaccgcagtcctgggctaaacagtgaacaggagctctgtgtctctgtggtcgttacagttgtagtgaatgttccctgggagagtcctcttcagaagatatttgcggtattttcaacaaaggactctccaggatggaggagcaactacaagtcaggaaggaaaaggctgacaacccagttttttaaaaaacgggcaaaggacgtgaacagacaccatgcaatggcccagagtgcacaaatcatcatttctcccaggaatggggtgcccgagcccccaggcggctgaacttgagacttgtcacgtagtgttggtggaatgcagagcagctggagatcacctgctgcaggtgggtgcgtaactccgcacggccaagccgtttggaaagctgtagcatatgcatgagagtccggaaagttccgagagaaagtgtgtggatgcacccgccaaggacacacccaccgaggccacagctgcgatttcatagtgtgggaccccactggcaaagacacgctggctgctgtggccgtggtttctgtcccagccgtctgtttccatagaaaaaggtaacgggcataagcagtttccaggagaaatacaaatggccagagtggagacagcctacatgtccatcagcaacagaaaggatcagcaggttgtggtgggtccatttggggaatgcagtgagaaggaataacttacagcagcacacaagacctgggcgacagctgtctccgggggtgccaggatagaattgctgagccgccagaggtagtcagcgtcttgatctgcatggtggtgtggagcatgtgaataataattttcatccttagaaagaaaccaccctttgcactttgatttttaaatatgttacagtgtaggttgggcgcggtggctcacgcctgtaatcccagcactttgggaggccaaggtgggcggatcacttgaggtcaggagtttgagaccagcctggccaacatggtgaaaccccatctctactaaaaatacaaaaattaacgggcacctgtaatcccagctattcgggaggccaaggaaggagaatggctcgaaccagggaggcggaggttgcagtgagctgagatcatgctactgcacttcagcctggatgacagagcgagactccgttgaccaggctggtcttaaactcctggcctcaagtgatctacctgcctaggcctcccaaagtgctgggattacaggtgtgagccaccgcgcccaagcctattcttttttgtttgtgataatggtcatcctaatggacatgaggtagtgtcatgtggttttgatttgcatgtccctgataaataatgatgttgaccatctactcatgtgcttgttggctatttgcatggcgtgtttggagaaacgtctgttcaagggctttgccttttttttttgagacagagtcttactccgttgcccaggctggagtgcggtggtgagggtgcactgcaacatccgccttccaggttcaagcgattcttgtgcctcagcctcccaaagagctgggattacaaaagtgcagtttgcccatttttaatcgattttgttcctgagttggagttttttgtatattcaggctgttaaccccttatgagatagatggtttgcacatagtctcttccattctataggatatcatttctgttaatagattcctttgctgtgcagaaactttttagtttgaggtcatcccatttgtctatttttactttcgttgcccttgctgttggtgtcatgttcaagaaatcattgccaagaccaatgtcgtgaagtctttccctttgttttcttctaagggttttacagtttcaagtctgtgtttgggtcttgcatcggttttgagttagtttttgtgtatgatgtaaggtaagggtctatctttatttgcaagtggatatccagttttcccagcgctgcatattgaagagaccatcctttccccattgtgcaagaagttcttgtcacccttgttgaaggtcatctgtctgtcattgtcatttctggccctgtgctgtcctgtcctgtcctgtcctgtcctgttctgttctgttggtctgtaggtctgtctttatgtcagcaccatactggctgttggactttttaattcttttcttgacagtggtaatttatttgcttctttttcttattagtccctttgcctactttaaataattaattttgttaatttttagttttctgttattttagttcattaatttcattgcttcctttatttatttatttattttttttgagatggagtcttgctctgtcactcaggctggagtgcagtggcacgatctcagctcactgcaacctccacctcccaggttcaagtgattctcctgtctcagtctcctgagtagctgggattacaggcacttgccaccatgcccggctaattttttgtattttttagtagagacggggtttcgctgtgttgcccgggctggtttcaaacttctgagctcaggcaatccacctgcctcggcctcccaaagtgctaggattacaggtgtgagccaccacgcctgacccattgctgccttaaatacacaaagcgcttgagttaataaagttacctgaaggattgaactttaatttctaacagcgtttggaggtgaggggactacttgtttttgctcatttttagtttttttttttttgcacttggggtcaaatggcatgtcctatgtgctgttacctgaaatatattgagggtttctttgttctatcatacctggtcattttcataactgtcccacagacactggagaagcatgatgactccatggggtacagaatttagaacatccttgtcagattgagtctatggtgatgtgtcttaagtcgtcccttagtcttttttttcctaatcagtctgtcaaatttcagagaaccatgttaaaatcccctattattgtggttttgaaggttgtttccagtgtttttccttcatttaattcttcctctgtcgctgtgcgcctgcagattccaggctgcttgacatgggttcctttccatgatgaaatgccatgcctgtcccgtgccgctctgccactccgcgtttgcccaccgtgccgccgctgcccaccacttcctcctccaccctagtcactgacagatttgtcttgaaaaaaacactttttgcttgtcttttttgttttttgttttgagacatggtgtcagtcacctaggctagaatgcagtggcaaggtcatggctcaatgcagccccgacctcctggactcaagcaatcctcccacctcagcctcccaagtagctgagacaacaggtatgcatcactacactaggctaaatttttcattttttgtaaagatgggggtctcactatattgcctaggctggtttcaaactcctgggctcaagcgatcctcctgccttggcctcccaaagttctgggactcacaggtgtgagccactgcatccggccccagatttttgttttaagagatggggtcttgctgtgtttcccaggctgacctcgaactcccgggctcaagcaatcctcccacctcggccttccaagtagctaggaatgtaggtatgagccactctgcctggcttgtcttgaattttttgtttgtttgtttgagatggagtctcgctctgtcgcctaggctggagtacagtggcgcagtcttggttcattgcaacctccacctcccgggttcaagcaaattctcctgtttcagcctccttagtacctgggatgactacaggcgcacaccaccacccccagctaatttttgtatctttagtagagatggggtttcactatattggccaggctggtcttgaattcctgacgtcaggtgatccaccctcctcggcctcccaaagtgctgggattacaggtgtgagccactgtgcccagccgttgatatatttaccagtgtttttgaaatgagttttctatttcaataattaatgagcatcaaagtctcacccacattagtacatctttttctttctctctctttttttttttctgttgcccaggcctgagtacagtggtgcaatcacagctcactgcagcctcaacctcccgggctcaagtgatcctactgcctcagcctcctcagtagctgggactagaccacacccactaattttttatttttatttttttttttttaagagacagagtcttgctgctctgtcgcccaggctggagtgcagtggcatgatcttggctcactataacctccacctcccagcttcaagcaatgctgtagtctcagcctttcaagtatctgggactataggtgcccgccaccacacccggctaatttttttttttttttgtattttagtaaagactgggtttcactatggtgtccagggtggtctcgaactcctaagctcaggcaatccacctgccttggcctcccaaaattctgggattacagatgtgagccaccacacccagcctcacacccactaatttttttgtttgtttgtttgtttgttttttgagacagagtctcactctgtcatccaggctggagtgcagtggcatgatcttggctcactgcaatctccgcctcctaggttcaagcgattctcctgcctcagcctcccaagtaggtgggattacaggcgtgcaccaccacgcccagctcattttttgtattttagttgagacggggtttcaccatgttgcccagggtggtctcgatctcctgagctcaggtcatccacccgccctaatctcccaaagtgttgggattacaggcgtaagccgcagcacctggccccggccaaatttttttcaaaaacttttgtatagacttcgtctctgtattgcccagtctataagcgtatcttttttttttttttttttttttttttgagtcagaacttcgctcttgttgcccaggctggagtgcaatgctgcgatctcagctcaccaaaacctccacctccctggttcaagcaattctccagcctcagcctcttgagtagctgggactagaggcatgcaccaccacgccctgcaaattttgtatttttagtaaagatggggtttctccatgttggtcaggccggtctcgaactgcggacctcaggtgatccgcccgcctcggcccccaaagtgctgggattagaggtgtgagccaccgcgcccagcctatgagcatattttttatcgttctctttatttctagctgcgatgattgtatcttattgaaaatcattaaaaatcttagcaattgttttaaattatctaatttttttctccaaataatatctattttagcagccaaatcaccacaaatcattggtttttatctttagttgtgggtgcacagcgggtgcgtgtattttggggcatgtgaggtgtcttgatgcgttcatgcagtgtgtaacagtcacatcagggtaaatgggacatctttcacctcaagcatttatccttcgtgttatggacaccctcagctggaaaggggggctgcgtcgtgagtatgaatggatgcaagtcatagccacctgagcctggtggggcacagcagggccctgtggagtcacatcccggcctcatgctcggcataggggagcgctgcttaggtccatgcagtcgctcagggcccaggctgtgcagcgcccagcctgtcctgctccaggcactcccccgtggcactgtgccgtgctggcagaggtgcacagcgccaggcctcagtgtgcacacacagcccccgtggcaccgccatgctggtagagatgccagaagtgggccctcctctcacccatgagtgtcagctgatgccggccggctggcgacttgtgtacccagcccacgcctgtcttgctctaagagtccccggaccgttgttgcgtgtggtgctgtctgcatggtctggagggaaggctgctgggtgtgcgcccctctgtgtcctgagcagggcggccatgcagtaggagcacgctgcctggccctagcgtgtctgcagcaggctggctggcagcaggtggccagtggctctcctgggttcggtgcgatggctgccctagctgagggtcagagaggctttgtccaggggaggggaactggtggggggcctgggggcctggaaagacaagtgcaggttgccccacccctgggctgcgtgggccgcctgtgcacgtgccatggcacatggaggtgggcactgaggtgctgtgtctgccgcagacccgtgcctgtatattccacgctttgcgcacctgctggaattcggggagaagaaccacgaggtgtccatgactgccctgaggctcctacagaggatgaagcgggactggatgcacacaggccggcgcccctcgggcctctgcggagcaggtacagcgggccctgcctgcctgggggatgctggtctgggtcctggcctcacactttcctgactcctgagtgctggtgggctgggccgtatgtttgcagagcactgagagctgcctccagcctcccggggctgactctggcctggcccaccggggtcctcagccctccaggacctcctggctgccccgttggcctctgcgtgtcctggcataaggggcagaactctcagggcagagcggccttgaccccaggttgcctacttctggggtgcggctgcatgggcatccctgcccgtggtctcgtggggcccggcttctgacgcggacagtggtgtggcctctctctcctgagatgctaggttgttgctcctgagggtgccacagggctgccaggctgtcccccgcccccagctgggcgactacgcggatagtggtgtggcctctctctcctgagatgctaggttgttgctcctgagggtgccacagggctgccaggctgtcccccgcccccagctgggcgactacgcggacagtggtgtggcctctctctcctgagatgctaggttgttgctcctgagggtgccacagggctgtcaggctgtcccccgcccccagctgggcgactacgcggacagtggtgtggcctctctctcctgagatgctaggttgttgctcctgagggtgccacagggctgccaggctgtcccccgcccccagctgggcgactacgcggacagtggtgtggcctctctctcctgagatgctaggttgttgctcctgagggtgccacagggctgccaggctgtcccccgcccccagctgggcgactacgcggacagtggtgtggcctctctctcctgagatgctaggttgttgctcctgagggtgccacggggctgtcaggctgtcccccgcccccagctgggcgactacgcggacagtggtgtggcctctctctcctgagatgctaggttgttgctcctgaggtgccacggggctgccaggctgtcccccgcccccagctgggcgactacgcggacagtggtgtggcctctctctcctgagatgctaggttgttgctcctgagggtgccacggggctgccaggctgtcccccgcccccagctgggcgactacgcggacagtggtgtggcctctctctcctgagatgctaggttgttgctcctgagggtgccacggggctgccaggctgtcccccgcccccagctgggcgactacgcggacagtggtgtggcctctctctcctgagatgctaggttgttgctcctgagggtgccacggggctgccaggctgtcccccgcccccagctgggcgactacgcggacagtggtgtggcctctctctcctgagatgctaggttgttgctcctgagggtgccacggggctgccaggctgtcccccgcccccagctgggcgactgttctagttggacctctgtgaccccccaggtcgcagctgtcactcagactctcactttgcccttggtgctggtgggtggatgtggccgtggcctggtcaactaccccaactccggaattggagccccaggtcggcagggccctcactcctcatccgggcccttaccctcgtgcccacagagtccactctacccggcaggccaggtaccggcatccctgcgctgcaggattcagtccacctgagaagccgttccatctgcacacatgatctccatgtttgcactggaggttctgggcccactgtggccttggtgaacctgtgtcagctgccagctgtggcctcgcccctttcctgcccagcctggctccgcatcctcagagtccccagctcccatcacaagctgtgtttcccgcacagtcatcttagagttagtttgtttgctttgagggattacgtgaagctctcggaagccttcattttaattttccttgatttgaaaatggaatgggtgcagccgccacccacaataagatagagagggtcatgtcgttcaggagtagccatgccaagtgagggtctcactgcctggcacagacacgtcttctcaggccatcatctccgtgaccgggatccgcagtgttgtcctgggccgccacagatgttgccctggttcccagccgtggttgacgaggcccgtctcgttgccttccagcgctcctggttgcagccagaatgcatgacttcaggaggactgtgaaggaggtcatcagtgtggtcaaagtgtgtgagtccacgctgcggaagaggtgaggggctctcattcatggcatggggaccacacagaggcttcatcagtccagctcaggcctgcttgccagagcaggcgccacctcccgggaccctgccgtcccccgcctggctgctggccaggacctagcccagccccggtcacactatggcttggacgtgctggtgggctgcctcgcctccctccagagagttccctgctagtccttctggggccggccctatcctgcggaggcatcctcctcctccgatccctgtattttttttttttttttgaggaacagctttgctctgtcgcttaggctggagtgcaatagcgtgatctcggctcactgtaacctctgcctcccgggtccaagagattctcctgcctcagcctcctgagtagctgggattacaggcgtgtgccaccacgcctggctaattttttagtagagatggggtctcaccatgttggtcatgctggtcttgaactcctgacctcgtgatctgcccgtcttggcctcccaaagtgctgggattacaggcatgagccaccgcgccccgtgtttctaagttgaggcggagggtgatgtgtaaagttgccctaagtcacaaacaggcatgaggctgtctttgacgtcagaagcctggtccgtctcctttttgctgtggcccgtcctggactttgagagcccaggtgacccctgtcccagtgagaagccggagtgccataagaggtccccgcatcagtgaaatgagtggcgtagcaagccaggcaggcaggggtggggctttgcaccccggctttgctgggtggtatttgtcggggttcctcacagctcgcctgcaccgcagccctgtttcatagactttgacaaggtaaatgtgacagtggagttgctgccacctgtaactgctgtgacatttatcacaaatcttaaacacaggactgctgtttttcagctgagattgtgtcctgtggcattttccaaaaccagctgtaaagtatttcactttaaacatctgaccattgattctgtaaaaaaaatctttgatgaaacgtgtttgaaggttgtgtagcgtgtagaggcgttcgtaagaactgagccccatggctcacaggcctgcagggccccttcctgcccgactgccaggtgctgaggttctagcccagcctcctctcttcaggccttctgagtcttccgcctaggattggggttctcttgtgagggatgagggtgcctgtgggcctttctcctagtgagcagaggtccgggcaggatcgggtaggggtggagaagccgccagaagggacctgggcgccgaggggcaaggcctgagtgccaggccccgtggaggaacatccgacaagcacagttcaggtatttgtttttattgttatttattcatttttttgacacagattttcgctcttgccgcccaggctggagtacagtggcacgatcttggctcactgcaagctccgcctcctggattcaagcgattctccggcctcagcctcccgagtagccgagattacaggctcccaccaccatgcccagctaatttttgttatttttaatagagatggggtttcaccgtgttggcctggctggtctcaaactcctgacctcaggtgatcctaccacttcggcctcccacatgctgggattacaggcatgagccacagcacctggccttttattttttatgtattttttgagacaaaatctcactctgctgcccaggctggaggccagtggcgctatcacagctcgttacagcctcaacctcctgggctcaagcgattctccctgacctcagcctcccaagtagcagaaactacaggtgtgtaccaccatgcgtggctaatttttttttttttttttgggtagagacagagtctcactgtgttgcctaggctggtctcaaagtcttggactcaagcaatccacccaccttgggctcccaaagcactgggatcacaggcatgagccacgcccaggcgaaagctcagttttaaacagctggtttcagagccaccagctccatttcccatgtctggctccattttaggctcacggaatttgaagacacccccaccagtcagttgaccattgatgagttcatgaagatcgacctggaggaggagtgcgaccccccctcgtacacagctgggcagaggaagctgcggatgaagcaggtagcgccggctttggtgtctgtctgtgctgggcttgccagccttggggggaagccacacaccccgactggggttgtagcagagctggtgccatcccaaagcctcatagccgctcttcagtgctatgaccagccagagcccgaggctccgggatgcccctcacacagactctgggaagtgccacctcttcccatgggggacacaggcccatagctccacctccatcgctgcgtacccctaagttctagcagcctgtggtccctggggcccacggggcaccccagaggctgcgctgtgcaccagggcctcccttcacgaagcctcttgccctgttccctttcagcttgaacaagtcctgtcaaaaaaactggaggaggttgaaggtaaccaaccaatcttcccatgtaatgcttctgttttgttgggaaaattgattttatgctgactttttgcttttaacttatgacttcaggtgaaatatccagttaccaggatgcaattgagattgaactagaaaacagccggccaaaggccaaggggggcctggccagcctggcaaaagatggtgagtccactgtgcccggcccctattcagacctttaaaatgtgctagagtctcagcagatctcttcaggatcagaaaaagacctggaaagggaaggggattatctacagaatgtaagtttaccaccgggcagggtggctcacgcctgtaatcccagcactttaggaggctgaggcaggcggatcacgaggtcaggagatggagaccatcctggccaacatggtgaaaccctgtctctactacaaatgcaaaaattagctgggcgtggtggtgcgcacctgtagtcccagctccatgggaggctgaggcaggataatcatttgaacctgggaagtggaggtagcagtgagccaagatcgcaccacggcactccagcctgggtgacagagcgagactccgtctcaaacaaaaaaaaaaagaatgtaagtttcccctacaaaagacagctttgcggggccatttcaaaatatgtcaaagatattttggggtaaaatatttttatttctttcagggcctgctacctgtcattgatgttgtactagagtcaggttggaatttggtatctgttgctacaaagtctggtcaatcatcagatctgtgttttgatgttaatgctgatgagctgtgcctgaactccaaagggagggggtataagcgggtataatgaggcgtgtctgaccccgcccccacttcccatcatggtctgaactagcttttcaggtttctttgaaatctccttggccaagagaagggatccatttggttggttgtggggcttagaatcttgtttttgatttgtattctgtactgtgtattttcacttgggggttagtaggagccacgggagggcctgagaacagaggcaggaggtagggaggctgttgcaggaacccagggtgagagacctggcccagcctggtcgaactctggaggtacttttggggcagagccaacagtccagggaatgtgcatgtcccgggaatgtggcagccggagcccccaaggctcctggcacctgcggcctgggcccacttgcccggggaggggcttctgagaggctgctctgtccagaggtcatcgtccactgacagctgctctctggggatcaggtgctttcccccaaggagccattcctcaccatggggacccctccgggactcagtgctagccaggaatcttgtattggaacacattcagaagaaagcagtctaagactagggagtgggtcaagcatggtggttcatgcctgtaatcgcagcactttgggaggcaaatacaggaggactgcttgagcagagttcaagaccagcctggtcagcatagtgagaccccatctctacaaaaaataaaaaaattagctgggcgtgggagtgtgcacctgtagtcccagctcctcgggaggctgaggccggaggatcacttgaacccaggagttcgatgtgcagtgagctatgattgcaccactgtattccagcctgggcagcagagccagaccctgtccccagtatacacacacacaaaatccagagtgggatgttttaagatgagttttgccaaccttaaaggaagaagcagaggcaaaagtaatctacataatttatttgggtcaagcttgaggattgcagccagggtggacatatcccattgccttgaatatacactctggtgagcagcagttacacatggactttttctttttttggagacaggctcactctgtcacccaggctggagtgcagttgcataatctcagctcaccacaacctctaccctgtagtttgaagcaattctcctgcctcaccctcctgagtagttgggactacaggcatgcgccaccacgcccagctaatttttgtattttttgtagaaacggggtttcgccacgttggccaggctgatctcgaactcctgacctcaagtgatctgtccaccttggcccgccaaagtgcgggattacaggagtgagccagcctcagctacagatggatttttaaaggcaaaaagggacagtgattggatagatacaaagttgtctgttgggaattctcattggcttacaatagtaacgttcattcgtgattggctgtacatcgttaaactattgggtgcggcattattgcgttagtttagagctacttgtggcaacagcaagtggtttcaagaaatgaacacgtagctcaaggaggaggagtcacattcctcccgtgaaagttcttttctcagtcttttaaatttaccattgggtgatttttaacagccttattgaggtgtgattgccgtatgaaaactgctcatatttaaaatgtgccctttgatttctgaactttgatgtctgcacacacctgtgaagccatagtgacaaccaagaagacccacagatctgtggctcccacggggtccacaggcccttggtcaccaccccccctcctgccccaggccaccagtgagctacttttttcacgataaattagttgtattctgtagaattccgtaggagtaggatcacatagtatatgtttttcccttcggcttttttcacagtgtaattatgttgagtcacgcatcaatggtttgctcatttgtgttgtggcgtggcagtcggtagtccttcagcacgctgagggtgtgtgttgagtcacgcatcaatggtttgttcgtttgtattgtgtggcagtcggtagtccttcagcacgctgagggtgtgtagccattcatctgttagaggacattgcacgtttgaggctgtttcagatgcgctcgtgaacactcgtgtacaagtccttgtgtggacgttgatttccttttgggtcaattgctgaggagtgaaattgctgggttatgtgaaaggcaagtgtgtatgtctttttttgttgtttttgagacggtcttactctgtcacccagagtggagtgcaatagttccatcatagctcactgcagtgtcaacctcctgggctcaagcaaccctcccatctcagcctcccaagtagctgggactgcaggcgggcaccaccacacccagataatttttacatttcttcatagagacaggatcttgctgtgttgcccaggctggtctggaactcctgagcccaagtgggcggccacgaactgcctgtctttaagaaatgatcaggttgtcagccaggcgcagagcctcacgcctgtaatcccagcactttgggaggctgaggtgggcagatcacaaggtcaggagatcaagaccatcctggctaacacagtgaaaccccgtctcttctaaaaatacaaaaaattagccgggtgtggtggcgggcgcctgtagtcccagctactcaggaggctgaggcaggagaatggcgtgaacccgggaggcggagcttgcagtgagccgagatcgcgtcactgcactccagcctgggcgacagagcgagactccgtctcaaaaaaaaaaaaagaactgatcaggttgtctccaaagggttagcaccatgcgtggaagtgcaagggagcgtgttccccctgtctgggaagtgcggcctggttttcttttcagggctagacattctgatggttgtgaaggaggagcttggggtggtttcatttgcatttccttcaggactggaggtctttgtatatgttcatttacaccaatatgtcgtcttcgccggagtgttcagatctttttccattttttaattgggttgtgttttcttgtgaagttttgggaattcttcatctgttctagatttaagtcctttatcagttacgagatttgcagataagcctgtgggctgtcttcattgtcttaacgatgtctttcaaagggcagttcttaattttttggaaatccgttttatcagtgttttatggattctgcttttagaaccattagaaatgtttgccttatccaaggtcacaaagtttttcttttacgtttttgtctgaaatgtctgtactttaactctccccctaggtctgtgatctgctttgagctaacttccgcgtgcagtgcgaggtgtgggctgaggctcgttctttggcacctgaccgccaggcaccgtgcactgacagccgttctatgggttacctggcagcttggtagcattgttttttgtcacaaaagcgggcaccctggccctctgcctggttaacaggtggattgtgtacacctaggctccaccgaggacaccgcgtccagcttgtgtggcgaggaggacacagaggacgaggagctggaagccgcggccagccacctgaacaaagacttataccgggagctccttggtggtgcccccggcagctcggaagcagcaggaagccccgagtggggcggcagacctccggccctggggtccctgctggaccccctccccactgcagccagcctgggcatctcagactccatccgcgaatgcatctcctctcagagcagcgaccccagtgagttctgatggggccctgggggacgctgaggtcatcgggagatctttcaggcgtgtgcctctcatggggagagccggatgctgccatcctctgtcgggaggtgtggtggtctcgggcggtgggcttgggtggtggcaccaccagtccccccaatggggctgtgtgggcgtcagtggtcctggcgtgaagaattgggtgtgtgccgacgccagaatgcagtgagtctcgtcaccctcactgggaccgccttcaggtcacaggggccacggagaatggagcccacaagttgtgtccaggagtcccatggggcagctccacccctcatccgcttgtccaacatggtcgggggaacgtcacttgctgagcttgggcgtggcaatgacgaggcacccctgccccatagtgcccaggccaggccaccgtgcccatcttgccccccctcaccttgcccatttggctgggagctctaggagaaaggtgggtcccatcccccatccctgccaggacaggcttccctggctgagagcctagaccttcctgcaacgcttcaccctcaagccctgcctcccgtcgggcaccagggcctggcctctgtgtgaggagccaggcgaatgtttatcaagtgatatctgggccggggtagagacaatcctgatggttggggctgctgtgtgggtggaacccaggcgagtcacacagagcaacaggcagaggggacatgcacaggccctggggcagccagcggcacagtgaccctgagcagaaagggccattctggctggagctgaggaagggctgcctgtgagtgctgagaggagccgtctctggcctcggccctggagcagcatggcaggagagcacctcagacagtctggccctgtgctggagttgacttggcagcacggggcaggcagctatggcgtggggctgtggcaaggagaggctgtcccaattccaggctgtgcagatgctgcctggactgcgtggggctgggcaggggtgacaggcaggttttggggtgtcctgagcatgatcatggagggctccctcaggcctggactccggaatcatttctattccctcatttctatccccagacctatgggctcagtgatggggagctggctcccctgagcacagacccccatctcactccgtggcctgacctttccttcctgcccagcttccgtgccctccctcggtctttggggcctgacagcctctgtctcctgttcttaaaaagttgcttttttacaaaaagcacagaagtgctggggttttcctttgcagcttcagttcagtgttctgctggcttcgcttagtgtcctgagctaggcatttaaagaggtgcggtcatgtgggcagacagggcgcgacccaccagtgcagaggaggggacggggttctagaaagcccttagcccagacccagggtcctgagccagcccaggtggtggccacgctcctataatcagtgctggccctgagtgacgcggatgctgtgcttccctccagaagatgcttcaggagacggtgagctggacctcagtggcattgatgacctggagattgacagggtacgtggcagcaccccttcccaagaggggctgggcttgggagggcgctgcagcccaaggagccctgagtggtcgggcggggttggccacctcccctgcccagagcccaccccgctgggtgaagtgggctcctggccttctggccactgttcccgggacccccccccacactctcttctccagtgtcggctcgggggcggcctgtcgagaggcccctggctttgcgcctggtccttgcggccctcggcacatagcctgcagcaggcacacatcgcacaaatagcaccaggggcagcccctcgaggggtctctagacacaagagggcacccactgactccacatgcgctgtgcgcccccaaaccccagggcttccagccattgggaccagctctttgcagtttatctcaatatacttgccctctgtcaggcaggaagtcgtcttccctgatttcatggccacgtggtgcctcagacccctccagcctggcccatctgtacctgagtgggaggctctcaccctcacttggcccctttgtggggacctgtggcctgcactctggctggccagggtcctggtgccggcagggcttgcaagctgccctagagggtctcacacatgtggcctgcgtggttggccttgggacaggccacagagcaacaggtccccaactcgccccgcgcgatgaggcctcagcccaggctccgcactaaatagaggctgccccgggttccccttcctctaacggtggaaatacttcccgctggccagcgcgaccttagcatgccccggtgtgcgaaggctaaaagccagccccacttccctgtgctcgcccagtacatcctgaatgagtcggaagcccgcgtgaaggccgagctgtggatgagggagaacgccgagtacctgcgggaacagaggggtaagcgccacccgcccacactcacacgcaggacgcacagtccccaggcctggggcgtgggccctcagtgacgctggccccctttctgaacttttagaaaaagaagcaagaatagcgaaagagaaggagctcggcatctacaaggaacacaaggtgggcgcctgtgacgctgggcctggccttcttgggggtgtccaggttacggggggcaaatgtctctggaatgtcccttccccatgtgacaggagggtctaggccccagggcaggcagccggaggccatgtgctctggaccccagacccacgtccttaaccactaggtcctgccccgtgctggccacaggcgcccagccgtcggcctcaccttggagggcgtgtgctcagctttggggtaaccttctggatgcagcaccggggcagactgtcgagactcggggctggacgctggggtccctgcctgtgttaacgggtttgctcttctgacgccctgggaaagtccgactgtcatgcctccctgccttgtggccgtcacggtgacttgctctgccagcttactctctggcggaatgtgccttcagcctcgtggtgcaggcagcagtggttgagcctctgagtgactgagcaggagaaaacacggggagccagttccctgcctgcgagactggggtccctcagacgaagctggaggtggctgggatggcagatgtggggcctacccgctcagcaggacccggggagcttgtggtcagagagttaggagcccaggggctccaccccacccagcagcacgtcccaggccttgctgggccacgcaggaaggtcatcgtgcagcggggggcagcaggggtggtgcaggctgattgccctgaagtggtctatggctccagctcctagaaggagatccagggtcttcgggcagctggggcctttgacgtgggcagcggtgctggggtggattgtctgtcttcactgagtagccatctctgctgcagccctcacagtgcagcagcacatcgccctgccgtgtgcatgtggccctgccctgtgtgggacccaggggcagcagggccctgagcacctgtggcatgtttgctgctgttgctgtctggaggccctgccagcacccatgccaggccacgtgccccactcacctgggagggcaggatttgacgtgggcaggcccagagagcaccaggctggcccacattctggggggaggaggcaggagcggcccttctgagggcctgagccaggcctcacccgcctgcactcctggcctcacgtggagcccctgatggtggagtgcagtgggcgtgactcacgggaggcattcttgcttgtttccctcaagcccaagaagtcttgcaagcgacgggagccaattcaggccagtaccgccagggaggccatcgagaagatgctggagcagaagaagatctccagcaagatcaattatagcgtgctccggggcctcagcagcgccggcgggggcagtccgcacagggaggatgcacagcccgagcatagcgccagtgccaggaagctgtcacgaaggaggacgccggccagcagaagtggggctgaccctgtgaccagtgtggggaaaaggtaccatcctgtcctgagtggctgggttagggcagcagcccagggcgggcagaggcccatggcttcgggtcctggagctgccgggggccagccggggccacagaagtgcctggagtggcatttgccacctgcatgctggggactggtgggccttctccggcaccttgacagtgtctcaactctccttggcctggcaggctgtgagcggacgggcgggtccagctgtcaggggggtcctgcagcctaggctctgttttgtcccaaggaggggctgggacaatccgtggggtcggtgccttctccagcctgggttcgggaagaagagtccccagccctgccgccctgtgcctgctctgcgcaccctggctgcattgccgtctctgctgaggtgatgggtgagagcagcacactgctgaggaaggaggatgtgggtggagaacgtggctgagggacgtcaaaggcgggatgtgctggcctcagcgcacagggtcacgaggctctgcagctccatgcagggccgccttggagtgggtcggcctctgtgcacagcttgccgctgggtggcggctgcaggctctcctgacgaggccatgggcagctgggctcacctgctgcgtcttgggggcctgtggctggtccatgtgtccctctggcagtggagatggggttggcggcttagcttctgggtccaccctttggtggttccgaccttcactccaccccaccgagtctccgggctgggtgtgtctgctggtcctactgcttcttgggatctcttgcgttgtctccagctgcttccgcctgtggggcagtgctgactctcggcagccccgtcagggcctcctgttgtttgcggtatttgcggtggtttctccttggccttttgagctgctaggctggccactgcaccccgcgagagttggctgtgctgtggccctgcccctgcccctcccctggggtgcccaggtgctactctgtgagggagcctgacctcctggcaggctggtgcttctcagccggcgtctcagcccctcaggagggccgcatgggctgtctcctccacatcagccatgcactggtcctctgggggtgcattcctagcacagctcctggcatgcgtaggaggtcagtggggcagaggtgaagtcagggcaggtctgtggctcggttcccctgtgcctgagcactcccaggtccgatctgaggctttagtctccgtgtcctctgcctgcctagccagcctctgtcagcgctggaggtgggggtcctgtcccagttgggtgattctggtgcctggtgacagggttcacagccccctctgtcacatctgaccagctggcccagacagggcccgggtgtgcatgtgtgtctctctgtgtgtgtatacatgtacatgcagtgcgtgtatgcctgtatctgtgtgcatgcagtgtgtgcctgtgtctgtgcgcatgcagtatttgtgtgcatgtgtgtgtgtgtgcctgtgtctgtgtacgcagtgtgtgtgcctgtgtctgtatgcctgcagcgtgtgtgtgcatgtgtgtgtgcgcctgtgtatgcagtgtgtgtgcatgtgtgtgtgtgcctgtgtctgtgtatgcagtgtgtgtgtgcctgtctgcgtatgcagtgtgtgtgtgcctgtgtctgtatgcctgcagcgtgtgtgtgcatgtgtgtgtgtgcctgtgtctgtgtatgcagtgtgtgtgcatgtgtgtgtgcctgtgtatgcagtgtgtgtgcatgtgtgtgtgtgcagtgtgtgtgcatgtgtatgtgcctgtgtctgtgtatgcagtgtgtgtgtgtgcatgtgtgtgtgtgcctgtgtgcatgcagtatttgtgtgcatgtgtgtgtgtgcctgtgtatgcagtgtgtgtgtgcctgtgtctgtgtatgcagtgtgtgtgtgcctgtttctgtgtatgcagtgtgtgtgcgcctgtgtctgtgtgcctgcagtgtatgtgtgcatgtgtgtgtgcctgtgtctgtgcatgcagtgcgtatgcacacagtacgtgtgtgcgttggtgcactcagtacgtgtgtgtgtgcatgtgttctggtgtctgcacacagtgtgtgcctgtatctgtgactgcacatagtgtgtgtgcatgtgtgtaagtttttgtgtgcaaatgcaggtgtgcacgcctatgtgtctctctgtgcatgcagtgtgtgtgcatgcaacatgtgtacctgtatgtctacagattgtggtgtgcaggtctttgtctctatgtacacgtgtgtgcatgcatgtgtctgtatacactgtgtttctctgtgtgcgtggggcgtgtgtgtgtgtcttaagtctctcaactgtgtgcagtgtgtgtgcatctgtgagtctgtgtgcacacacatctgcgtgttcgtgcactgcttcctgctttagaaacccatcagtcttccccccaacatggccatgatctgattcgggaatatttagtgttctaagacggaagcatgaagacctcagggctggggaccccccacactcccacccccactcaggcctgggcagctcaggcagttccagcggggcaggggagagggggtctacctggggacagaagggcttgtcccggttgcccttgcagcccatgggggcagcttttcacccacactcgggtgaggaaaaagggatttggaccacttggaaagaggctgaggctccgacgtggggaggggtggtggggagggaccatcaaggaggggttcagctgaggaggcactgcctcagcccagcgaccacagcgttcctcagcagcagctgtgctgccttgggtggcccaggcatggcagtccctccttgctgtgggggaaccagcctgagctgcaccccctttctctttggctgccggtggctgcctagcccatctccctctggccacctgcccctggtcctgcgtcatgatgcatgcttcccctgatgacagacaactgcagaacctgagctgggccactcgggtgtgggcagctgagccacgcaggggtgtgggcagctgagccatgcaggggtgtgggcagctgagccacgcaggggtgtgggcagctgagccacgcaggggtgggccatgcatgggtgtgggcagctgagccacacagggatgtgggcagccgctccctccgagcttgtctcctcctcactctgtggtcactcgggctgctttgaccctcggggtcttcctctagcccatgcagatcagtctgtcctcatgcctgagcgtcccactctggggacaggcagaggggccagtgtgggctgtgggccccagcgcccatatctggaagggggacaaagtgggggcccaccagatgagctgccctcttgcctgcttacaggccccaggatccccccaggctgggctggggccgagcttcagccaagcggggtcagcaggtgctggcgcggctgcgagagggagcagcctgagcccaacagtgggtttgcgtgaacaatgggccgcagcgccccacatcctcaggcccctggctggggacccccgtacaggccaaagccatggccgaggtgatgccaggtgggagcttgttctccaggcgctctcaggccctcccgtgtggcctggctgcctcaggttcacacaggatactgcgtggaagagggggaagcccttgagacaggcccccagctagcccgcagaccccaggagcccttgcggttctgcactcatgaacactacgcaccctctctccagccgggttctgcaggagtagggagctttctggccccccagggtgaggcctggcacagctgcttcctggttctggaaaagctggacttgtctgtcaggaccttgggtcagtgcagcaggaccttgtggcttgaatttcagcctgtcctcagtgccaggtgggggagggagggtgtgtccctgcaggaagcgcaccctcctaacagcaccgctctccctgtagccccgtattcctgcccgccagcatctgctcctctctagctaaggtacagtctgccaaagtcaaagaaactgcctcttccagaggttgcagtgggccgagatcgcgtcactgcactctagcctggcgacagagcaagattccgtctcagaaaaaaaaaaaagaaaaaaactacctctccttgagccagcggggtctcagggcccttctcaatgggggcctgctggcctcaccttccagagcatgaatctcctggggacttagtcccaccggccaagatcaggcctcccacccaactgccaggcctgcctcctggagcgccagccacttctggagagaccacagtggggtgtctcattgaggtcagcctgctgagaagccccgctgcagggccagctgccatccccagaggcccccactccactgcacagtgggcctggggatgggagtggggagggcggagcagcagctgtcaggctccaggaagcaggctggaggcctggcctgaggatacagcaccaccaggagccctggtgtccagactgtctccagtctggagagggaccacatggggagcccggggcctcagcctggctcacacctgctatcagcttcaccccgagcagagctccacgtctagatgttctgctaaggtccacctgtcatggggtcccttcccagtgtcccgagggttcatctgacacgtcagagccaggcagggccctgcctcaggccccctaccgcctccccacacagctgtgccctggagggaagggctctgccccgctgcgtccttccccacaggccctgagccctctcattgcccgcccgacagccctgtgtgtccgtgctggaggttgcgggtaatgcctgcgtcctctcccctgggcccccctgtctccctggggggaccagcagtctccaagaagacttggcatgtggaaggcacctttggcctttgtgtgtggcgggccggcgagcaggccctgtgcagggtgttgtcagcagatgtagggattgccctgggcctggtgagggttggggaagcactctcgggtctgacagtgtcccttcaccctccctcccctcctccctgagtgaggtagggcaccaggcagctccttgagggctcaggcactgttggaaggggagtgggctggggagcggggcgtctgcagcttctgtgtttgtgtcgagtgctgctcgctgttgagaatgtgaacgggtcagagctctgtgttgatgtgcagtgagcactgatggagcacacagaacctggacgcagaaccaggcttccaaagggacagagaaacagtcaattaacactgggaaagggaagatgggcaaaagggaacaagtgggcaggcgttcgggagcctgggctgaggccgccatgctgtgcttccttttgcaggttgaggcctctggtgtctacgcagccagcaaagaaggtggccacgggagaggtgtgttgtcccacgcagccagggcagggagaccttgggaggcagcccacttcttcctgggcccagatgcttggtctgtgaccacagggagagcaggcctgacagaggcgcctgcccctgctgccccatacttgcctggcatggccagagaatcgaggcccgagggtgggagctcccggttgctggagcaggagcgggcaggaagtggggaccgttgtgtgcctgctgctcagcgctcgggccaaggctgagcagccttgctgtgggcctggtgcctgcagggagcctgtatgtaggaagcaggcactgccaggtcacagggcccagccctccagggctcaggggtctttcacctggactgtcacttgttggggactggtctggcccaggaaacgagggtgaaggtgctggcaggtggcgggggctggggcaggggccggagcagagcctctgtctgtgttctgggggtcagggcaggccaagcccccgggggctgaggccacagtgtcctcggccgaggcctatggtctggaaaggtgttctgcatgctccccgagcactggggtggggcccagtaggatacaggagcaggggctggcagaggcctgagggtgggatcttgatgctgacacagctcatggcacagcccccaggaggccagaaggggccagtgggcctgggagccctggccaaccccgggagccactggtgtggcgggagtggctgagcatcctgggccagccctggtgggtctgaggggtctgttgagatacacagggctcccagctctgtgtgtgtcagagccccacttcgttccaggctttgctcccaagctctcccaccctcggagctgagcctgccaggccccaggcggtgctggtggagagcgggcccgtgtcataccacgccgacgaggaggctgacgaggaggagcctgacgaggaggacggggagccctgcgtcagtgccctgcagatgatgggcagcaacggtgggtggggcccgacaacagggaggggttcaagggaaataaaggcatcagctactgcccctcatgatccctgaacttgggcctgttagcttcaaactaaatttctgtttctccctggaaagaaatttgaactaagacattttgtaaattggtcatgtcgattgtgaggttggaggcagccagggtcagagaggctagggacggtgaggtacccaccacgagggccgcccagccagcagcacgaggttcccggatctgcacaccaccacggacctgcacacccagggagggaggctgagggagcccacactgctctcaggtgccctcgacgaggagcaaggccctgctctgggtgcatgccagtcccgggaggtggagaggagcccaagatggctcctggcggggcgcggggggctggggctggggctggagcctgagtcttctaggggggcaccaggaacagggcgggttggggggtctgggctcctgggtcccacagagaccctgggcttcatgactgtgctcttctgcagactatggctgtgatggcgatgaggacgacggctactgaagtgtggcctccaggcaggtgatgtcctggcagggggcctcgcgggtctcctcagcatcagacgggcttccaggaccgcagcaggcaggccccagcgccgagactcctggtgacaggtggcacctgtcccacagccctcgtcccatgtggaacttaccattgggattgtgtttctattcagcaagggaaaccggaccaagcgtctgcatgtgtgtgatcagatgtgggccgggtgtgtgcagggctgggtcccgctgcctgccgtcgactcatccaaggaccctccaaggctggcagtgtggtgttgctactattaaggaaacaggcttggggcagccccactgctggtccaagtgtgtggagggctgagtgtgctggccctgtgactcaggaccagctctggagtctccagcccaccctccgcaccgtcccctcctgagcagcactcggcgccagcagcctctgccagagtggaagccagagccctgcaggtgtccggcgcagccgtgggagctgaggatctggcacttgagaggcagcagctccttgaaggtcctctgcctccagctgtggccctgcatccagatacctgcctcgtccgaggcagacacccccacccctgcctcctccagacccccctccccgctgcctgcaccgcctggagcagcatgggggtcagacccctgctccagggccacttgagttgtgggcccaggagccctgcggctgccggcaggtgaactgagtgcccgacagctgagaccggcgcccacccgtcctgagcatagctctgtaggcagtgcgggcatagcctgcatagtgtcctggcgctgggagttccccgtggacagagccagagggcagtggcgctccctgtcagagctggatcaggccccccatcgaggagggagggcagacggaggcccgagagcctccccaggcctcttcgtgggaaggccccagtaccactcgtaggaggtctcagctctggcatggctgccccggatgtggccgagggggcttcaccctgtgtccttaggagggggtggccttgaggcagagccgtgcctcactgacccccaggggcctcatcctccccatggaatgggctgtatgtcctgccccaacttggcccgcagcaggccagacccccctacccccgcccagagctcagtagccagcctgggtcctgccagggcttctcgagggcttgggggaagaatagatttagtaaagcaggaagatctgttgttacttaacagaaattgcctgaggcttgtctgattctgtgttgcgatctgtggccagccgtcatgtcggtctgctggctgcacggcctggctgtggatattagcccctgagacccaggggctgccctgagtgaggggtgtggggtctttaggtccccccaactactgcagcagctgttgagtgggtgtgcatcagcctgggctggacatgggtgtgccacaggggaccgggtggacaagtccccgcttgggcccccagcgcagtgtgggcaccgggaggtgagtgctgtgaagaaagtgaaacggcaggaccagcccacaggggcttcactgaggctggggtaacaggaagcagcaactgggccagggtgggcgggcctgggggccacagctggcacccaggggccccgagggaggtgcaggtgggccgtgggaccgcaggatggggggcttggagaaggtgctcttagaggaaccctgaggaccagctggaggggctcccggcctagcagatggccactggggccgggccagagacgacagccaggtggcatggagtgggggtcttgttggagatcgaagagggtggatttggggggcgaaatgggtgaaacctgccaccagatcttatttggggaggagaccagacgtgcagctgaggggcgcaggcgaggcaggccgtgcagcgatccagccctcggcctgggtgctggggtgcagggcggggggcagcgtctgactctggtggtgctgtttgccaggctgtggggccccaggcacaggtgggctgcagctccgcaggagggaaggaatcctcatcccgggagacctgctttggggccagttgggtgttggagggggtttcaggacagacagctctggctgggcacttccactcgggaggccaggaaagaaggtttccaggctgcctgtgcatgagcggcttggcccacaggtggttgaggatattggctgaacggcccgcctgaggctggagggagagggaggggtggagaggtgggtgggaggtgagggccaggggaaagggaggcccgggaggcagtggctgtccaccctttggggatggaagcgggggaggttatcacagaagggggagggtggggtggggctcgggggctggggcgcgggagaggatggctggggtttggggctgaggagcacaagcggggccaggcggtgaccagtgtgctagagtcaagccccacaatggctggaggggaggtgggacatctctgggctggtggcggaaagactcttccccagagagggtgcggtgtggaacacagcatccgggtcctggagccgtggggacctgtgctgcacagacacttgggtggccgaggtgcggaggtgctgcggcccgggagtagacagccgtagtggccaggtgcctttgggtgctggcctgaaccgcgggtttgggcattcaggtctgtattgctcagtcccgtaggtggcttaggggccacatctcccagcctggacgctgacaggcctgaagcagtgcttggccagctgtgacgctgcagctgcacggggcctgccagcatgtccagcagcaccttgggcaggttctgcctgggcccttcccagtgccaggaccagaccatgctgcagcctcggggaagggggagcccagcctctcagccccgcatcactattcttagcttgctagctgtccccttgaatgctgccttccgggctgggcctgccaggcatgcacaccccagccctgagcagccaccgccgcctcctgctgcctgctcagagcagggccatccgaggctgttacgagctggcttaggaacctggtgtttggtggccgccaccaccccgtggataccacgttacagtcctgacaggactggagaacagccagttgggggctcagtggtcctgggggctccaggactttgtcagagcatgtgtccacctttgggggtgcccgggagaagtggtctgcacagctccatagagcgagggggtggggca

SEQ ID NO: 11960 - DNA, 56714 bp, Human
ctactaaaaatagaaaaattatccgagtgtggtggtgggtgcctgtaatcccagctacttgggaggctgaggcaggagaatcacttgtacctgggaggcggagttgcagtgagccgaaatcgcgccactgcgctccagcctgtgggccagagcgagactccgcctcagaataataataatgataataataataacgccaccaacaatactaagagctaacatttactgagtgcttactatgcaccagatattgttctaagtatacatttattatctcatttaaccatccataatactgtggtatagacacttttatatccattttataaataagtaaactgagttatggagagattaaacgacttgccagtaagattcaaagcctgtgtacaagctcacgcttgattctggagccagtgttcttaacacagtatcttgagaatgttaaactaaaaagtttttaatttacagtattctttccacaattaaaaaagaaattatgagtaattatttttagttctttcttctcttcaggcatttcccatggttcttttcaagacataatacatatcatttagtgttgtagatctgaaaaaacaaaagtagcgtgaagatcaaaaattttctaaagagacggagtctcgctacgttccctaggctggaacacccaggcttctccagcctcacacctctgagtagctggaaccaccctgtccgctaaggtcaatgtttaatcgtatctttgtaggtctactgaccagttaaaaagaggtgctgtatacattggttgttgtcttgtcagagtttgatgcttctatatagaccattgtttttacatgctaatacaattgaaagccactacagatatttatatttacaacccaaagctaggttttaacaagaaactcataaggcaaaggtgagaagtaaaataatttagcgccaagtggagatatatgtgcaatgctactttgttgggctcaaaacatatttttcttttagaagactgacaggcttgaagtttatgcctccaaagacaaaagtgattacgttttgtttagtagcttgcaaagttgccaaaggccattttttctactctttccctgaaattggtttatatgcttattaaagtcatttatacctatttgcaaatgcttaacatagtttcagattttaagatttccctgcaactttatttcccttgaagtttacagcaacaggagttcatttttatttttaattgcatttattcagtaagtaaactccgccacagaaaaacttagtagacaaggtgagttcccctgtgctccgtggcaaagagtgcggtgggtgacattgacccatggttaggtaatctggtaaggaaagaccccgttgtaacacatctgagcaacgagaccaaaggaagggcttgctgccacgaggcgaagtctgcttttttgaacagagagcccagcagagttgggcggcaatcgtgcccagcactgaggccgaggagaaagagagcaggagcattacattactgcaccaagagtaggaaaatatgatgcatgtttgggaccaggcaaccgaaatcccttctcagcagcgcctcccaaagccgggcaccgccttccttcggagaaggcgcagagtccccagactcgggctgagccgcacccccatctcctttctctttcctccgccgctaaacacagacgagcacgtgagcgtcgcagcccgtcccagctgtgcctcagctgaccgcctcctgattggctgagagcggcgtgggctggggtggggacttgccgcctgcgtcgctcgccattggatctcgaggaacccgcctccacctcaggtgaggcgggcttgcgggagcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagtaagcccattccctcggcccgccgccttctcccccggcgaccccgcccgcctgcccgccctgggctcctgggccggcctcggcgttaatgggattggggggggcagcctttttgtttctgctgctgctcccctcccctctcttcccccaacctcgccggccgggctcccccgctgtccacgtcgccatcttgtcgtggggggtgggagacgcctcgaaagtgctttcaggggccggggtctgagccctgcttgccctccccgccggccgtgggggcctcgcgccgcccacctacccgcctcaaaaacccagcctgctctgtggccccatccggaggggactttacccagcctgaaaaccccgggaagagaaatgagctgcagctcggtagccgcggtttgcacccggagcttccgctccttcccgcccccatcctctccagttccattgaaaactcggccctggggcggaccctgcacgctggtcctggctttccagtggacttggggccttgagttcccgactgagggactcgcgtggtcggatgcgatcttgtcctgtagttgtccagccgtcgcgggtgtctttgcctttgtgcattagggatttgccgcgatggccttaagatgcgaactttttagtttgcacgtgcaggttttgtttcgttttaatcgccttgaaaaacttgcctagactgagagtcagagtaatgggaatttagggaaatggcaacattttaaagagaacttcagaattggatacttgagttcatatcacctgtcacgagaacgcagatattataaatgaatatatgcctcattcattcttcaaataatgaaaatgtaggggctggttaaatttaggcagttttaatgatactgaaaaaagtatatgatgagtgaatgaaatgcggcactaaaatgttgcaaaaattttcgaactctgtctcattttcctgaaattgaagtatattaaaggaaaaccgtcaacatatatctaaagtaagtaatcactcggttagaacttaatgcaagttttataaatcaccttgaagtttgagtctaaggggtacattagagattaagaattgtgagttggaccagtggtgttaagagcggactcccccatcccccaacacacacacaattttgcccactttggcattttaacttttaaggaaatcacttaaggaattgaagatttagagtaagagttttggttagtagactggctttgctgttaaatccttccactcttctggcagagagattaatttccctaatcagtatcagcagaagataaacttgtttatattcctgctgttttgtagatcccttctcctggtccttcttcaatagaatattaaattcttagtttgtatacagcagagaaggtcacttataaaattcaaaaagtgagcaaacaggtctagattaattccaagagttaccaggaattaattgcagtttattttgcggaggtgattacagtgcttttgatgaaatgataaagctgctatattgtaaacctaaggcagattacctctgtgtagtgccagttttctatccttattatatattgaatcatacttaatacaatgcattaaattatgtaccactttttttatatacagtatcgaactcattgttttgccattcatccgttcagaatatcagaagcagttttgaaatgaattaataaattagctactgttcatcagccccaattctaaataagctcttagattttcctcagcccatctgttactttcaaaattttctcatttgaaaacttggcaaccttggattggatggattcatatttcttagtatagaagttcttgatataactgaaaaattaagttaaacacttaataagtggtggttactcagcacttttagatgctgtttataatagatgaccttttctaactaatttacagttttttgaaagataactgagaggttgagggacggagattttcttcaagcaattttttttttcattttaaatgagctcccaatgtcggagtttggaaaacaaatttgtctttttaaaagaaggtctaggaaactcaaaacctgaagaattggaagaaatcagaatagaaaatgggtatggttatgatactgtagatttaacgcaggacatttcatgttgttcctagttataggggctgaacttatttaatagcacgtgcattttgatttttagatttttaagggaatgtcaagagagtaatgattctgtttcaggcttcaggccagactccttcagagttttccaaaacaaataattactgaatcattaaagtaaaatttctgagaatagatattccttaatttccttcattaactttggccattaaaagtcaagaagctctctcatttattagcaaacttttctccttatgattctattttgattgtccttttgtttgaggaagcagcatatggtggttaagagcataggatctagaggcagatacctctgagttaagggtcccagcccttcacttgtgagcttgagcaagttactgaatgcctctgagcctctttcctccttttgaaatgatgataagaatagcagccatctgagcagttattgtaaaggttaaatgagataatgcttgtgaagcacttagcccattgcaggagtcttgatgacactgtgtacttgaaaatagatgttacctgttaaaattcttgtttaaacttccacaactcttaaaactcttttttgctagtccttccagctgtttcctttagtttcttttctgtgtcttcatgcatcttttctatctcctgaaagtgaaaagactaacattggatccagagcttgaaaagcgtttttttcctgttacaatgggcaaaagagtacatccttgggttatattggcacctagtatcagttatttttcttgagcatctgatctgctctctactctagtggaggcctcctgcttcacaattgctcacccctgtgttttctccccaaatagaatactgagtttactctggactctagagtcaaacatacacagtattctagtcttactgttcatttaagcaagatatgtgcaagacactgcattcttagtactggcagtaagttaaaacatttttcgtcttgatgccaaagtttagacaattttataaaaattaacctttgtaaaagataatgagttgataaaatattctcagtaaagcagctacgtggtagaaaaactgtcctttgcttatgagtttctccagagttaagaccattgggttccatctgaaggcaagacttcaagcttgtcttactggtctgttttgtggctcaatttgtatgaagtctatgcactcttccacacgtgtgtatttactgaactatcgagttattttagactgagaaagtattggagttcattcctacggtccactgcagagcaccttgtgcagtttggagaatgtcaacttttctacctgttaacttccattgtctttacttttaacgccattgtctgtgactctaatggtgtcacggctcagggtttagattttgtggttacattctattcttgtatgtcaagagtggtgtatagaaagctgagggggattatttagtctcttgactgatttttttttttttctgaagaactcagtttattatgtttggtggtgaaataaaaattgatgtgcatggatgttaaagatttgggttaaattgtgtgttcatagatgccttctcttagtatataattttttaaatttagatacttaaaatactgtatccctttatctaagattaacataagtctgtttcttaaccaggataaaaaaatctaaatttaaatgtgatgttggatgagtttccaatcaagaaattgattttttaaactttgtgactagttatccagtgggtggattttacccagtgtgtgtatgtgttttctgcttaactctggaaggttagaaagagaatttgaaactaagacaagccaagcttcttgttgctcagtatttttggtaaaaatatggtcagattgtttaaattaactataggctttggaattttaaaaataattatatctcttggtctcttgacacatcaagaattaactgttttgtatatgcgttgagtattaatgttcatgttttctgcagtagaaatttataaacccttatttatttgccagacatgatccctttagagaaatctagtatctaaaacctgaatttttaaaacaaaatttaaaatttttgtttcataaaaacaaaaatgtgattacctcatggcttttttcttatagcttttgattgttttttaaaatcgtagttcaaaaacattaacctaaaatttaccatcttaaccatttctaagtactgttcagtagtgttaagtatattcacattgtgccactaacttccagaactttttcatcttgcaaagctgaaatcttacccattaaacaactcccaatttccccctctcctcagcctctggcaaccaccattttactttctgtttctgcaaatttaactactctagatgcctcatataaatagaattatagggttttaatatttttgtgatgggcttatttcactttgtgtaatgtcctcaaggttcatccatgttgtagcatgtgtcagaatttccttcctttttgagtctgagcaatattccattatatgttccatattttgtttctccattcatccagcaacggacacttgggttgcttccacatcttggttattgtgctgctctgaacatgagtctgcaaatctctctttgaagctttcactttttttggatacatatccagaagagggatgctggatcatatggtaaccctttttaattttcaaggaaccaccatattgttttctatagcagttgcaccagtttacattcccaccaacagtgcacaagggttcctatttctccacatccttctaaacacttgttttctttctttccttccttctcttctctttctctcttagccatctaatgtggcaaagtggtagccatctaatatgttgaagtgattgtttttaagggcttgtttgtggataattaaccagctgaaagctaactacagtttgccagtggaagctttaactgaaaggagagtaagtacctctaaaaggagaattcaatttttctagtgacttagatttgttatgccagtactttttcacagaaacactttttgggtaaaatagtgtacacctgttctattgttgataaagcccaatttaattaggaaatttgttctctaagatttaaaacaataattgaaataatgtatttttattaaaaactgttcccaagatgttagcttttagctgttctggtgatctcaactgttatttatgagtgtttctttattttaaaatttcaccttaaccggttacagttttaaccataaagattatttcaacatatgattttgaaaatttattatcttgtaaatgggaaaatgtagtgatggaacatagtttactgtatgtagttcttcacttgtttgaaaagtcacaatatatttaggcaaattaatttaaaagtgtctagtatttaatattgcaattttcactcattaaggacaggtcccccgtgtttcccccttttttttttccaagtagtttgggaggatttgtttttccagctgaaaaatactatggttaaaaataaggtttaaaggcgaaagttgaagtctttgagggttgggatacgtttctgttcttaagagtcttgtaaattcagatgctaagcaaatttctttaaaatgatttctaccctccccctttccattataaaactggatatgtttcagtggaccaaatcccaagtaggctgaatttgaaatttgtgggctgggcgcggtggctcatgcttgtaatcccagtactttgggatgccgaggtgggtggatcacctgaggtcaggagttcgagaccagcctggccaacatggtgaaaccccatctctactaaaaataccaaaattagccaggcgtggtggcgggtgcctgtaatcccagctacttaggaggctgaggcaggagaattgcttgaacctgggaggcggaggttgcggtgagccaagatcgccccattgcactccagcctgggtgacagagcaagactgtgtttcaaaaaaattaaaaaagaaatctgtggtgtgaatactggtacgtggtgtacacagtgagctcttaataagtatttgaattaacaaatgagacaatgattgaataattggatgaacaaagagaatgcaggtttttaaaaggtttctttagaaatattgtcggcccggcacggtggctcctgcctgtaatcccaccattttgggaggccggggcaggtgaatcacctgaggtcaggagttcaagacaagcctgaccaacttggagaaaccccgtctctactaaaaatacaaaaaaaaaaaaaaaaaaaatagcaggatgtggtggcacatgcctgtaatcccagctactcggaggctgaggcaggagaatcgcttgaacctgggaagcagaggttgcagtgagccaagatcgcgccactgcactccagcctgatgacagtgtgagatgctgtctccaaaaaaaaaaaaaaaaaattaaaaagaatgttttaattctttagttccctgtctgagattcactggtaagaagaaagttaaagaatctcctttgactttttttgatatagatatttaaattctattactttatagtaaggttggggtttattttctttgctttataatagaagagcattgattattctctttgctttataatagaataccatttaaataggagttccctgagtgtgtttacaatcatttgatctggctaaactattttaatgttaatgaaattttaaaattttggaggaaaaaatttaaaaactacacaggtgcacaaagaaataaaaatcacctgctttttcactatgtagagaccattgtctactatttctcaattctgtgttacatctgtatgttaataactgtaggattagggactgagtactgtttttaacctgcttttaaaaaatttacatctacattttttcccatctaaatagtgaggaagagtatcagaattttgtaggcttgtggtgatggttaaattagataatattaatgttgggtacttaacataatatatggctcttaatactctccagatttcagatatagtctgttttaccattactgcctttttatcaaacctattctcaaaaaagtgagaaaagtgctgagattacaggcgtgagccaccatgcccggcctcatggttctttcttaataataaattagaagaagtagaattacagggtcaaaaagtatccattttaaagctttcaatgtaattgcctgtttatcttctagaaagtttgacctagttgtattttagagtgtcattttcttgaactttatcatcattaaagttttaaatttggaacactggcaatttgataagtatattaggattcttcttattgcaagtagcaaaatacaactcaatctagtttaagaggggaaaatgtagtcattggctaacacaatctaattttggtttaagagacaaatctagagtctcaaatgatctcagagtgtaataatccctgacttttgtcttgatattacttggcttgtatacctttgctctatttgcatgctggccttactctgccactgacaggctgtctgtatggtgtggaagaggacggctagcatccccatacctgcatccatacagtttgtaatataaaaaaaaaaaaagtaaaaaaaactccctctctcttctagtgtctatatatcagtttcctagaagaaaacgttttgccctacttggccatgtgaatggagttccctgattacatgagtcaaatatgtcttattgtagcatatttgatggtcttcttgtagaatattatcttactatacacagaactcttgaccagtgctaccattgtaattaatgggccatgagtttttgttgcaagtcatttgaattcatattctatagttttctaccaagtgtagtcattctgcaagctgttcttgtcatgacttttgggaagttgagtatttcttctatgggttagggttttcatctcaagaaaaagatgatccttttctctactaaatatgtgttaagatcacacatttttctagatcgtttagctctactgtgtgatcttacacaaattgctttattgggatgataagaataattgccttataggattgttatgagaatgaaatgatacatcaactcatatgaaacactcagaacagctcttggcacaaagtaagggcttaattaagtagaaactatccatatattcataatattatagtattggttaagttgttttcaacattgtttagaatcgctcaagccttctttgtgataatctgacgaaggctattcaccaccagtgagtaaataatagtggcagaatagttactgatgcttttcctttacttggttttttttccataaacatctggcctttgcagactaaatactggtttatgtatagacatgttattctaaaataattttccatagtggtaatactaaaggaagaaaaatgttctcaaagctatttatttgggatgttaaaggagggggaaattaagaaagcctacatttccatgtcctttgtgtccagaatctcattaaatgtcttttaacttgttagcagaggaaagttggatattgcctgcctttgtagctaacatagttaaaatatttaaatggttatagtgtcaaaccagtagtcaaagccttcactgtgaatggatgaagggatattttcttgaataatttaagttgacttatttcagtggttcaaaacatttcttcaacgcttaaccatgactcaggcacctaactattatactatgtcctgtaacagattgttgtgcattcatttattcaacaggtatttgtgcagctaatttattgagtacagcattgaatcgttgatggcttaggccacagttgaacattccattttttatgttcattcattcattcatagcatattccatttttaaattttcagttcattgcactttaaagtttgaggttcttgcgaagtacagacttttgggtttaagttttgttatttaatgtcaaccaccacaggcgcattggccagtctgcttttagaattttcagacatacatacacaaaacattctcacaagacaatctacttattttcttttttattcctgtgtttcttaacacaggattaatgttcagatctcttttggagcaaaataatcctctgaatttttgagatgtacccagtgacctcagtctgagtatgtatactgcattaaaaaatgtaaccttgttccttttagtggtcatttggtaacagtttgatcataaacaaatgcagcctcaaacacagaaggcttgaggcaagtatacagaactatggagagatcatttagatgatgtagaatatgccttttctttttttacaatgccaccaaaatgaaaacacggttttaaaaattctcatagagtgtaacttcaacactgctttaactctattaaacaaagcactgccatgttgtaattcctatttattactctctggagttgtataaattaccaaatccgccttttgtttgatatccttttcaaatatctgagggtagctatcatgtttcttccttctattcttaaaaaatagtcccaaatttcttgaatcttttaatttaaaaattatatattgagcatctgatttgtggaaaggcataggccatattaaaaatggggcttcatattaaaatggggaaaagggtggagattctcaggtggaatctgagatctgccacacactaatagtgttacctaaccctttttaaagacaaagaaacaggatcagaaggtcactttggaaaatttatttggtaatattggataggatggattagtatagttggaaaacagagactcttgctttaggagagctgctcctttgtcatttccagaatcttaatcatggtcaaggtttagagctaaatatttaatagaagaagtctttagggtatgctttctattgtacacccttatttcaatacatgtgttttttcctgttatgtaagtactttattattatttatgcatcttctattaaagttaagcaaataattatttcaaggacacattcttctacatacacacaaagtttagggtcactgaccttcttaggttctagtcttagatctgttaccatctaagagcatataaataagggaaacagaaagaaaaggatttacaagctgagaaggaagcaatgcagagaaagaagagtgatagagtaggtaatttggggaaagtcagtgatacacagctcttaaccatgaacagtgattcttcactcttgaatgtttgtgacattcatgaaggtattaaaagctgacttttaaaaaattgtttcagagaactggaaaaaaattcagttgccacattcttccttaggtcatctttgaactctactcatgcacttacgtgtttaaggcaaagttttactaaacgcacacttgttcttgctggcttattgacttttactgctagcttcttattcttagcaattatacctcacattacatagtattgtgaaactcactatattcagtgttttgcctgacaaacatggtatgttataggatgtgtattcagttatagctaaaaataaattattctcgtttttcaaaatttgctggcctacctgttaagcttttgctttaagacctgctaatgtttctcaaacttctgtggttaaatcacctgagtgtctagttgctctatggattcccagggacccattcgccagagattctgatttggtaattttgggatggaactcagggatctgtaaattttacaagcactcagaaatgaaacatagactttaaacagctaagagtgctcatcaggattatgttgatattattttttaaacagatgtgccaagcctttaatttgaatttccagggttgggatttggccttctatatttgggggaaaaaagttctattgatgattgtggatatataccacaggtcaaccattgaatagtctagtcagtgtagttagtgtattttataattactaagttctaagtatgtggtgtattaatgtcttaggaggtggatatatttcctgtatttgtaaagcatttgggtaggttttttaaagagaaaagtatgtaacaaactagttttgagcgttgctcttttacttctttgggcatttttgaagaacacgttaagtatcttcttagagcagaggggctcagagtggtccccagattatcatcattggtaacacctagttggtgcattactaacttgttagaaatgcacattctcaggcgccattcagacttcataaatcagaaactctggaagtaaggctcagcattctgtgtttttttttctttattatactttaagttttagggtacatgtgcacaacgtgcaggttagttacatatgtatacatgtgccatgttggtgtgctgcacccagtaactcgtcatttaacattaggtatatctcctaatgctatccctccccgctccccccaccccacaacaggccccggcgtgtgatgttccccttcctgtgtccatgtgttctcattgttcagttcctacctatgagtgagaacacgcggtgtttggttttttgtccttgcgatagtttgctgagaatgatggtttccagcttcatccatgtccctacaaaggacatgaactcatccttttttatggctgaatagtattccatggtgtatatgtgccacattttcttaatccagtctatcattgttggacatttgggttggttccaagtctttgctattgtgaatagtgccacaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccactaacagtgtaaaagtgttcctgtttctccacatcctctccagcacctgttgtttcctgactttttaatgatcgccattctaactggtgtgagatggtatctcattgtggttttgatttgcatttctctgatggccagtgatgatgagcattttttcatgtgtcttttggcagcataaatgtcgtcttttgagaagtgtctgttcatatcgtttgcccactttttgatggggttgtttttttcttgtaaatttgtttgagttcattgtagattctggatactagccctttgtcagatgagtagattgcaaaaattttctcccattctgtaggttgcctgttcactctgatggtagtttcttttgctgtgcagaagctctttagtttaattagatcctatttgtcaattttggcttctgttgccatggcttttggtgttttaaacatgaagtccttgcccatgcctatgtcctgaatggtattgcctaggttttattctacggtttttatggttttaggtctaacatttaagtctttaatccatcttgaattaattttagcataaggtgtaaggaagggatccagtttcagctttctgcatatggctagccagttttcccagcaccatttattaaatagggaatcctttccccatttcttgtttttgtcaggtttgtcaaagatcagatggttgtagataagcggcattatttctgagggctctgttctgttccattggtctatatctctgttttggtaccagtaccatgctgttttggttactgcatccttgtagtatagtttgaagtcaggtagtgtgatgcctccagctttgttcttttggcttaggattgacttggcaagcattctgtgttttgagaattcttccaggggactgtgatgaaaactgacgtttgagaaccttcatcttagagtaaaaactttacatacacatttttgttgttttatttatctagcacaatacttcttttttttgaaatggagttttgctcttgttgcccaggctggagtgcaatggtgtaatctcagctcaccacaacctccatctcccaggttcagttgattctcctgcctcagcctcccgagtagctggggttacaggcacgtggcaacatgcctagctaattttgtatttttagtagagacggggtttctccatgttggtcaggctggtctcgaactcccgacctcaggtgatccgcccacctcagcctcccaaagtgctgggattacaggcgtgagccactgcacctggcacaataccttatatataatcagggctcaaagatttgttgagaggctcaacaccaattctggaccaggaaagattttatttatatcactagtcaggaataatctaaaaacaaaaagcacattcttcttacaagtaatatttcaatacacattaatgtaaacacatggaaaagtattagctacttaataaattaacatgtaaatgaaaaatttacacattatggctatttcagatgtgatatagatttcattttcagaaggaaccctccaatgtaaaacagtgattcttttccccgtttattttactgtattagaaaatcacatttaaagtaagcattttggtgaggtttggaaggtgaataaatccatcttttctttaattatggatatttaagagagatgttgttgtgccgtttagataataatgatctaaaccaagaaatttagttgctttcaaaaataaaataagtgtatgcattctgaacatttttctttagaaacaaaccatttcatctgtttttttgaatttcaaattaattatacagaattttcaaaatttgaaaattaggttagcatgagaaactgaagatactgaattatattgcctgttcagtctatacttttctttaggatatacagtaggaaagaaatatgatagttcaagttagattactacttctttcagagttttttgacaaatgcaggtacagtgatagtgtcagttcatggtgaatttttgttaaaataaattacaaaaaatttgtgatcctggtatcttgaaactagttaatatttgtaaactttgctaacactgtatatcactgtattctggttttatctgtgcatctatgagttatatgtgtgtatagctacatatgtttatatttatacacatacattacacacaggagtggaatcatactcaattttttttgtatagcctgctctgttcatataatactatattgtagcatctagtgtaagcaaagattaatttttgtagactttgcttttatcctgaaattttgtggtagctggtttaatggaaagacaatttctgtgacgtgttttgtcagttagggattgaccctggtaaaatattgctggataacaacaagcaatgtaaaaatacatttgttccataagataacctccgtgaaggtagagacttggtctgttttgtttattgcaccgtgtcctgttctgggaagagtgttagactcatagaagatgatcaagaaatattttttgaatacatcaataacattctctaacatgtgggtatcctaaaggtttatttttaaagtttattgattagaattcagaagatattttcccagataaaataatagattgctagctgtcttgaaaatgtaatttatatttaatttgaaatgtcaggtttttgctattttttccattaagtagagatagggtttttaaaaattacatgtgatgttttaagtattctggttttgcaacaattactagatagaaaatgtaacaacagatcctattaataatacttccaataatacatataaaatacttgtctaaaagtaaccctccttaaaaaaacaaagctggccaggcgcggtggctcacgcctgtaatcccagcactttgggaggctgaggcaggcggatcaagaggtcaggagttcaagaccagcctggccaacatagtgaaaccccatctctagtaaaaatacaaaaaattagccgggtgtggtggcaggcgcctgtaaccccagctactcaggaaaatcgcttgaacctgggaggcggaggttgcagtgagcggagatcgcaccactgtacttcagccttgggcaacagtgcgagactctgtctcaaaaaaaaaaaaaaaaaaaggcaataggattaggtatcaacttaatgaaaacttcgtgacagcactttcttgaaaaagactgtggaaaccaaagttagtaaactcctgtttctgcctgggttcggaaaacataaagatgataaagatgtttaagtattcctttttttttttttttttttttttgagacagtgtcttgctctgtctggagtgcagtggcacaatcacagctcactgcagccttgaactcctgggctcaaataatcctcctgcctcagcctcctgagtatctggaactacaggagtgcaccattacactcggctagtaatttgattggttaagaacattaactataactcacacattttcctgaccacatttgcttaggacaaaacagtaaaagacatgagtgtagatgaaagcgataagggaactaatcttaaacactgaacctcttttcagcaaattggctttctagtttctcagctctctctttacacctctaaatctctttcctggcaagatcatttatttgccttggtttatggtgatactcttcattgttatactggtgggtgattgttttaattgatagctgtttttttctacttcaggaagatgacactgctggctctgctggctctgatgtttaccttgtggctaatgcctgtgtttgcctgtgttcacatttattccacgattcatttgttaacatttactaagctgcttttctgtgccaggaacttggctagataaataaatggttgtttttgtacacagaattagctgtcataatcagttactgtagcatttattcttgcaaaaatatatatttatacttcaactagtgatcgaatctcaacttattaattcatacattcagccagcacataattgaatacttcttatgtgtcagaaactgttctaggtgcttgggatgttcattgaacaaaatagacaaaagtctccgcctctatggaacttactttccagtgaaggtgtggattggtgggatagaaaataaaataatcaagtaagatatgtacttaggctttcataaaaatacagcagggcaagaggaccaagatggaggcagtgatcagggaatctcaatgagggtgagactgcgacaaagacttgaaaaaggtggagaagcaagccttgtgggtatttagggtagcagtagtccaggcaaggggaacaactagtgcaaaggctctaggaggcaatgtgtttgaagtgttttaagaacagtaaggaggctagtatggttagaacagaatgagcaaagggggcaaagtggtagaaggtgagatcaaagaggtaatgaggccattgtggaggcccatatggactattggaagggctttggcttttactctaaatgaggcaaaaaccattttaagcagagaggagtgatatgacttgatttcttgttaaaaggattattctagttgctgttacagaaaaagattacaggggtgcaaagaaacagggagacaaaagaatataagattttcactgtaacttatatctagtatgcttgcttatacttgaaaatgcatatccagataattgtagtaaattcaaatattatgtttatttaatagtactaacattgatatgctggttaattatgattaggagcactaataaagcacaaatcagggattcccaaaaagaatgttgaaagggcagtcagcttttcctgtgccagaaatcaaagtcatagcagatttggggcaaatatgtcaaagtcaaacttacgcacatcactactgagaagacaaagatgaatgtgtgacagtttcctgcccccaagaatctttaagcattgtgaaggaagattaatatagccaaataactagagtgatcagttctaccagagaggaccagttttggaagccagaggaaaaaaaaaaaaaacagaaacaaaatgatgtttgaattaaatctttaaaagtttctcttataaatttaccaagccacatattgggaatggtaccccaggcagaaggagtagagtaagcaagccagaaaggaaatactatggtgcttttgagtaactgcagtgtggctgaagaatgtggaaaatgatgaggataaagaggtggacagggaactaggtaagggagggcttccttttaaataattagaccttgtcctgtgtacatttaatgggattttaatcaggccataatgccaaatttctttacttcggaaggatctttatggtgatggtttcagaaagaaattaaagcagagtaacagtggttagcaataatgatcagctagtggttcccaaacttacgtatcatatgcatcttggaagtttttaaaaactcagattttgggatcctgacttagatctactgaatcagaatttacagattcaaattcccagtgaggcctaggaatttgaaatgttgaatgtccttcacgatgcagctagacaagcatttgggaataaagcattaggtgactatttcagtagactaaggagtgggaggccatttaagctcaaaggctattctacttctcactatatttctagtacctagcacagtgcatggtacttgatagatgcatcctttctcccatacctcgccctacacatctcttcatgtgtatccttattaatatcctctattataaactggtaaacatgtttccctgagttctgtgagctgctccagcaaagatgggtttgtgagaatcccaacttttgaagcctgtcagtcagaagttcctgaggccagacttgcaactcctgttgagggggcagtcttggggactgagccctcaacctgacactgtctccaggtagatagtgttagaattgaattgaaggacacccagttggtgtccgctgcagaactgattgctcacctggtggtggagagaacccctcctctcccgatagggttgcagaagttgtcttctgtgttgttgattgctgtggtgtgggagcagaggggggaaaaaagctgttggagagttttttccaaaacaataggagattatttagatttataaaaatagaatcaaagtagattaactgagcacattgtgaaatatagagtagagctgtgtgtaaggagtatatcttaatgtcaagctgacaccaaattgaatgtttgctggaacgttcaaaaatctaagcttcccaaatctgtgaaaacactcaggttagtaaacagtcttatgcaaacagcaagacaatgctcaaagccatttaaggaaaaagaacagtaactgaattctcttatggaaatgtgagatgttgttttagtaagtactgatggtgttatactttttgtttattcgtttgctggtatttcagttcctaaaattccttcaaatatgctgcaaaatacaaaccaagaacttggtggattttccatttgttttcctgtgggaaatgatggaattaaaaaccttgaggattagaccttgagagttaccttccagtgtttatgccaccattatacaaaattctggaggacaaaacccttcccacttaaaaaccagttagtttcagaaaatcacctcatgttaggagactgcatcattatagtatgtgtgttagctttaggtatagatctaaaatatttttaatattttaaaaacttaagcctttcttcattaatttggcctaatacaagttagaataactttaaaaatgagtacaaacaacaaggaagggccaggcgcagtggctcaacgcctgtaatccgaacactttgggaggccaaggtgggcagatcacctgaggtcaggagttccagaccagcctggccaacataatgaaaccccatctctactaagaatacaaaaattagctgggcgtggtggcacacgcctgtaatcccagctactcgggaggctgaggcaggagaattgcttgaacccaggaggcagaggttgcagtgagccgagatcgcgccattgcactccagtctgggcaacaagggtgaaatgccgtctcaggaaaaaaaaaaacagtttctgtgactgctagacaaatgttgagcaagtaaaacaccaacaatgttgaacttagatattgaaatagctgctctgtacaaataaagtctactgggagtatagactgaattaccatcttttgactctttcgccataatgattggcattaccggaagggattaccttgctttgaagagctgctggacagtagagcagagagcatctattaccattgtaggtgcctttcagttaggattttggatttataagcaaactccaagaaagagcctggttctgagtttctctgaatagcttaggtcaagtcctaaattctgaagccaactcctataattccttctttatgtctttggcatgtgaagtaggcaaatttcgaactttataataatagcctagacttacaaatacttgccttggtaatcaggatgagtttttgagagacaacatagtctagtgttaatcgcgtggacaccagactgcttgagtgaaatacaggttctaccatttattaacggagtaatgttgggtaagctatttagccagggtccttatctgtaacatggtgataataataaagattaaataataggtgaaaaatgtttagaataccactgtgttattagtaagcaccatgcataggtgtttggatttaaaaatactggcaaaggccaggttgggtggctcacacctataatcctcgcactttgggaggccaaggcagaaggatcgctttagcccaggagttcaggaccagtcgaggcaacatagattccgtctctgcaaaaaatttaacagaattagttgggcatggtagcgtgtgcctgtagctacttgggaggctgaggtagggagggggaggattgcttgagcccacgatttcgaggctgcagtgagcttatgatcatgccactgtactccagcttgggtgacagagcaagactctgtctctaaaataaaatgaaaataaaactgcaggcaaaaatgccaactgaagagtgaacatgaacttttctttgcatttttcttgggcctgagactttaagaagtgcagggcagttaaaatgatgagatataattctcacctatcagctcagcagaaattaataagattaaaaagatgcgtaatatataatattgcagagtgcatgggggaattgatatacacattcatgaacaaaaatgggcacagaaccatttggaaagctattgtgtattttaaaaaatttcagtagcacattttttatatcatgaaatttcacttcagaatgtcagtcctgtagaaatactgacgcaagtgcaaaaacaacaaaaaccaacttgtaccttcaaggccagaaagagttatttcaccaaataacataattgaggtacattaactttattagaagtaaatctgataatctgctcacattttaaatagttatggtttaacttcagttcttgaagtcacatatttttacaattaggaatgctaacaggctttttgtgcaatacgaaaagatgactttaaatgcctacaattattttgtgtccttttatttttttttaatttttactgacctactacaaagcactaaatattttatgttcttaatctgaagaacaatagacattctctataaaacaactcttgcttattcatgaactttgtacacaagaagcttaataagacgggctcaaaattatttttctaaatatatttcctatacaaaataatttcaagatataattgttacttttgtgtctaatactgtatgttaaataataaaatggtaagcatgtaaaaactacaataccacaaagattgagctattttgccagtagtatactccaactttagttctagaacagtcgtagaaatgggtaaacaaactgttttaactgtactcttaactgaaatatagtaccttatgcagtagcagaacatatcagcagaagaacttcacttgacctgtacttaaaaacaaaacagatgcaatttataaaatttagagaaatatagtgaccttatttgcatgtggaaaatgtacttctttctgatctacatatcttctgttgtgcaatgtaagcagtaaaacaaatagtacaggattcatctctgtgggacctagaccccctggtctaacaaataattcttggtcagtactgtaattctgtggtataaaactgataaaattagccttcctgtgactagacaagaagccgggcagtttaaatgctgaaactcacaagaacttcagaagctttagctttaagctttaagcttacttagaaatgttataagacctccagtagtcacatatgaagaatatcatgaagatttttccattaaatctttattatagatcccttgattggtttctgtctagactcattgtgtgataaaggacataataatttttatcaccttcatctaatataggtttgtcaactctatattagttgttttcttgaaggctggttttcttccaaaattcagtcttattttcagtctacactagcttttaaatatactgtcctttagatgctttatctaacctcaaatttctaatggatttgtcttagacacttattgccactccttagatagtcattgctatctttgaagttctggacgatacgtgtattacagaggaactggagacattccatcaccatagttagcttgattggataccctttaaaagcatatactcgcgcctgtaatcccagcactttgggaggccgaggcgggtggatcacttgaggtctggagtttgagacaagcctggccaacatggtgaaacctgtctgtactaaaaatacaaaaattagcctggcatggtaccacatgcctgtaatcccagctactcaggaggctgaggcaggagaattgcttgaacctgggaagtggaggttgcagtgaaccaagatcttgccattgcactccagcctgggtgacaagagcagaactccattaaaaaaaaaaaaagcatatatagcacatattataaggttttcaattttttcaccaagtgtttcatttgggtagtcatttattggtagtttacatcagttgagtggttcagaaaaaatacagtaagttgcttataaaattctgaacactttggccaggcacaatggctcaagcctgtaatttgagccctttgtgaggctgaggcaggagaattgcttgagcttaggcgttcaagaccagcctaggtaacaaagaacgcctggaatgattgtggcatttgaactaatattcaggtttaacaagagataattgaccatcactctattttagaggctttatttgaaccagatagaaatctatttcccacagctatcactgcctgtcacctacaacttaagggggttggggaggaagtgagagattttctgttagggccaatagggacctgctagatacccccccatcctgggaatggtgtatggaactccagtgtatgctggagttattatcatcatacttgtttttttattttactcttctgcttatacagatcaagtcatacgttttatttttaagtttaaattgaaaacatttacagagaacaatgcagtgaaatgaaaaaattacagactgctggcatttgcattttcatgtagcctcagtgactaatttttttttattgtacagcattgagaaaatcctagttcatataactagttatagttcatatagattcatataactagttttaagtgataatagtttcttcctttttttcctccaccatctaaccagatgaagataatagtttttaatagctcaccgtaaatttcaaggtactcaagttaaattgatctagatgcttgagttgaaatttttctatcaaagttcaataacatgcttacattccttattaaagtataaaagtcctataaacacacaaacttgagtaagtgctaaaactagtatcagtattgtcacaatacaacatgttatattgtaacaagagcatttgctgagaactgtgcttgttactccagaatgttgcttctatggttgtacctttcaactttgcagatcatttggaaggaggagagatttggggtggagacaattcggtacttcattcacaggatgtaaggaggattaagtaaaataatgctggctaaaagtccttatttagcatactgcccaatgctcactaaatcataatagctgtttttaacatttggtgaagaatctatttaacaggagtgagttgaggggcataggagatcatgtgagtgtttaaagtagaagcagcattccccattaagaagagaaatactgtggaagagcaaagactttaaaacacctgggttcaaatcctatttgctacataatggctacttttaacctattgaacgccagttccctcatttgtaaaatagggacaatatttaacctatttacaggttgtgagagaactaggcacctagtacagggtaatgttggcacatggtaacctttaataaactgttgctattcaacaagctattagatgtcactaggcagttaagcaaaggaagacagcttttgcttggtgtgacaatgaaaatctttctgatttccttcttggaagagttccctgaagatatgtcattgtattgacacctttatttttgctaacctatccctctaaattctggatattgtgtgtgccacagctttttttcttccatattcctgcatttatttggcacctgttgtgccagtaatagataaggggctgctaagggaggaggcaacctgcactggcttatagctgctaatgtcagttcctatagcttatcgtcagtgttattcatgtggtaaaagggtgagaaagtactggagtctaaagaaacaagtagaaatcagtttgtagctattaccgttctacctgctaacaactcctgttttcaagttattatgtacaactttaggtagtttctctagccttaatcgtggtttctctgtattgagactacttttgaattctatgaagtacagccttagatgtacaggctactttaaatttttgcctaaaataaaaacattctctccaattacatatgctggggaggaaacacctgcttccgacaggtttaaagcttggttttggactttttgtgagagttccttatgtgtgcagtaatccaaaatttgtatagttgccctttataaaagtacattaatctagtagacaaatctccatgtaacttaattacatggcatcttctaatccttctgtgataagcagaaatgtaaagttttattcaagttaaggcaaactaacttgtatacactttccatctcgtgtttttcttgttgttgttaagtaggataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgagttattttacaagggtataaataggcctgaaaattagaagttagaagtaaatagaaattatttttagaaggtggtcgcaatgttttgattttgtatacctctttatattgtgatatgtacacgtttaaaaatttttctgtaattctcactatttttatcaagcttcatttttttctcatcagttattctttgaaataatcattctttatgcacataatttgttttgctttattctcttaaacatactctcaattcttttctaatataacatcctttttattacctgcttttaaagctttagtcaggaataagatactggcttttcccctcccccctttttctcctgttccatctacctttcttcctttaaaaaacatgactcaggccgggcgcggtggctcacgcctgtaatcccagaactttgggaggctgaggcgggtggatcatgaggtcaggagttcaagaccagcctggccaagatggtgaaaccccatatataccaaaaatataaaaaattagatgggcatgctggtaggtgcctgtaatctcagctactagggaggctgaggcaggagaattgcttaaactcagagggcggagcttgcagtaagccgagatcaagccactgcactccagcctgggcggcagagtgagactccgtctcaaaaataataaaataaataaataaataaaaaacattactcttctttcttcttctatggtttgctttgctgcattactttaatcatgaaaagcagctggcacatctaattatagtttttctagcttctggcctgcacttttctgtgttgaaatggctgtatatattaaataaagtgtctgcgagaaaactttgtaaaaacatctaaatattatatcatttaagtacaactttttaactaattattttcctcttcttgtgccctttttaggtgatttggatattgaagatgacatgaaagcacagatgaattgcttttatttgaaagccttggatggttttgttatggttctcacagatgatggtgacatgatttacatttctgataatgtgaacaaatacatgggattaactcaggtaaaatgcacacatattaagagctcttctatatgtttttatgattttatgatctagccctaatttttaaaaatgtgtttacagtttgaactaactggacacagtgtgtttgattttactcatccatgtgaccatgaggaaatgagagaaatgcttacacacagaaatggtaagaaaagtctgttgtttgatttaatgtgacaggtggttttacataataagatactattgctaattattaaactttgctattgtacttacccaaggcaaaatgttatttcatgtttaataaaatgtctattctttgttaaaactattattttagtttttaggaatttcattttgaaagcccacctaattgcataaataattgtgtgggtgtgagaaataaaatggaaaagtaaaatcatgaccaagagagttacaaataactttttttttttttttttaagatggggtctcgctcttttgcccatgctggagtgcagtggcacaatcagctgactgcagccttgaccgctgggactcaagcgatcctcccacctcagtctcccaagttagctgggaccacagacgcgtgctaccatgcccagctaaatttttaaaaattatttgtagagacaaagtctcactatgctgctcaggctggtcttgaactactgggcttaagccatcctctcacctcggcctctcaaagtgttgggattacaggcatgagccaccacgcccaggctaccttttttttccttttctttttaaattgtgataggggttcttgctgtattgcccaggctggtcttaaactcctggactcaagtgatcctcctggctcagcctcccaaagtgctaggattataggcatgcgccaccacacctggtggagttaaaaattaaaatacaccattaaggcaaggagaaattataatacaaatggcagataataggactttagacagtcattaaagttgaggtgccagtttgagtctaaggcccaataaaaaaagttcaccagaattttaagacaaacaactgcttatttgacttctttggatgttctcaataattcgagaccgtgtagttagattataaagtattacattgtggatgcccacatattaacaaaaatagagagtaagacctctaattcttaggaattaactgttaaaaataatcaagtgttccaagattttttggaaactacctcttgaattaaaaaattaaagtctttctacatttttatcttgttaaacagtgtatactgatcataattatttaaaaaatcatgtgttctaagatttttggaaagtacctcttgaattacaaaaacaagaaagtctttccacatttgtgccttcttaagcagtgtatactgatcataattgaacttttcttcatgatggaaagttaccacaaggaaaatttcttatgttctgctgttctttgttgctctccaatttaagtgcatacgtttgtttgcttctatattataaaacctcaaatttactttttgtataatttttgaggttttctttttcatctcatttattataataatagctaacctccattgagagaatgctgtgtgccaggacactgttcttcctattttatatgcttttaactcctttattcctcacaaccctgtgaagttaactgttagacaatttctattttactaggaaactgaggtacagagttactaagtaactttcccaacattatttggttagtaaatggcagagcttgggctgaacttcagtagactggcttcagagtccacgctcattagtcctttggagcgcttttcatattcttgaattctcacattctgtcttttttcactctgtcagcaggacctgactcctgtttttaaatttcatattgtgtttttactgttaatttggaaaacaaatgcatactttttagaattctgtataaaggaggagtaaatatgctgtgagcaaggacctaagtgggttgtcaatgagtttaatatatgagttctaatgtgcagagttgaggtttatattgactgctcagtgcttccctggggctagactataaatggatggatattaggaagtcttgttctgatttggtaatgatgttaatgcattattctaaatcagatagtcttaatatagtttaaatgtatgtttcgaaccaaatgttcttttttaaagcacacaaacattttgaaatcattactaatgtggttaatgaattattgatgttccattgggaaactaaaatgcagatttttctcttttagaaatcagggactattgcaaagcatcacattttagtgatacactgagagccagtggtgtgtttatacaaatagtcctattttccatataaattctagaaaaatgctttagaatttataaattatacaaaatatgacttatttttagagagtttaaaatttaggtttttttaatggtttgtttttgtttgtttgttttttgttttttttttcctcattaggaaaacactagtacttttcagttaccttgatttttaaattaatctgcaggtccccattcaaaggccttgggttcctttcaaaggtcagtataattcaagcttagtttatgaaggactgaacatacccaaaggattttgcatgtggatctttactgccactaccacaaccatcaacacctacacacacacgacacacacacattctctctctctctctctctctctctctctctctctctctctccccctccctcccgcactccttcccttccccctcctttgctctcatggcatcttttaaaaatatactcttaaatccttccagggagggcaaattcacttcttaatctaagtaaacccaaatggcatgcatcagcaccaggactgcccatctttcctagttccattattcatagagtataggctggaattcatcttgttcctcaagagtccagcatttctagttaaccatgcctacatttaaacttactctcatttcttttctactttacagtgttttttcaatatactagcattacagtttccagatttgatttctctcctgtcttatttccatcagttttcaagtctattaagattctacctcttcatttgtcttttgccaccattcttttccctcatactctactggctcagccctctcattacagtcacctaattctaacatatatattgctgctaagttaattttccttaagttactgattgtgcttttttaaagccccttgttgaatatttaggcaggactccatgtggacatccacagccctccgtggtacagccctaaccttcccttctagctttgccttactactcttctacgtgtactctacattgtggacaaactactatatgctgtttttcaaacatgtcctatttttcctacctctgtgcttttcattctcttacttctccttggaatacccttctaacccatctctacttactgacattctaatgtctctttttctaagcaagacttcttgatttcccttgactagaaattatcttctaagctctccctatccttctttaaagcatttttataagtctcaagtaccaactctacattgtgtttttgttgaccttactatatctactacatttttaacttcttcaggaaaggtggcgtatcttactcatctttgtattgcctacaatatctagtccaggttctgaataataaatatttttatatgtgttctgaagcacactgaccaatgaagataagaaatcaagaggctagttccttattttttttaattttttttttgagacagtgtctcactttgtcacccaggctggagtgcagtggcacaatctcagttcactacaacctctgcctcccgggttcaagtgattctcacgcctcaacctcccaagtagctgggattataggcatgtgccaccacacctagctgatatttatatttttagtagagatggggttttgccatgatggccagcatggtctcaaacttctgtcctcaagtgatcttcctgcctcagcctcccaaagtgctgggattacaggcatgaggcataagccactgcgcccagcaagatgctcttttctcagtcacctaaatataatctcatttttagttatagaaggtttgaaattggagtgaatagactttacttaattctgactttatttctgtagctttttttttttgagatggattctcgctctatatcccaggttggagtgcagtggcacagtctcagctcactgcaacctctgcctcccacgttcgagtgattcccctgcctcagtctcccaagtagctgggattacaggcacccactatcacacccagctaatttttgtatttttagtagagacagggtttcaccatgttggccaggccggtttcgaactcctgacctcaagtgatcctcttgcctcagcctcccaaagtgctgggattacaggcatgagccaccgtgccctgcctatttctgtaacttttgataagtcatttgatctgttgttgttgttttctcatagtaacaaagtagaagtaattttctgcctgctttactagataaattaaggggaaaaaaataagatacgtaaaaatgttatttgttattaaaaagaaagttgttattttaaaggttctataaagacatagagtgcttattagaaattgagctaacacattcaggaaaggataggaagagtttgctgaagttctttctttagggattcttgtgtaccgatagcacagttaaagagcaaactcataccatttttatatttctgtgtatttgactaagcttactggcttcaatgattaactgttatcccaaatatggattatctttcagccaactcagggaatcacagctactgagtagtgtgtgtcagatctcttgggtgtgctggagtgagtaaaaggggaatgaattactgtgttcatgctgagacttaattgaacgggtattcagttgatctaggtgatgggcactttgttacttttattgtaacaaatttgtatatttagttgctttaaaactttatttcatgctttcattaggccttgtgaaaaagggtaaagaacaaaacacacagcgaagcttttttctcagaatgaagtgtaccctaactagccgaggaagaactatgaacataaagtctgcaacatggaaggtaagtgaaaattatttgtgattgattatacactttatttatacatagacattgtagtattaagataactttagaattgtgagggaaggtttacagttccatggtgtttggttatgtaacatttatatcttcaactcatttgcatgtgatctccaaaatgcagaaccgtgtagtaatttgccaatttgaggcacaaacttaaattacgtgaattgtggcactggtgttccaggcttaatcagttggctttgccagccacacaatatttgaatcctgatagggcttaattttctattaatcatggttttatatctttgttcaatgttgaaacatagtcatcagtgcaagaaataactatcaaacagccatgatgatgagatgaatgaaaaagcagcctagactttatacgaggggaattttttaaagagtaatgtataggccctgggcaggaagtaggtcataggtggtatcataggaaaaatgttcattgattttcaaaaacgtgattaatccactagtgacagtaaattttatcaaagcttactggccatgtcagactcaactacttatctctgctttttttttccctagcattgtaaatattttttttaactgctttgttcttcatacacaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaaggtaaattagatctaaaatgtgaatttgaaatttttaattagtctacagcattactgaatattcaccatagcaaagattcagcgctggccatgcatggtggctcacacctgtaatcccagcactttggaaggctgaggcaagcggggggtggatcatctgaggtcaggagattgagaccagcctggccaatgtggtgaaaccccatctctactaaaaaatacaaaaattagtgggacgtggtggcaggcactactcaggaggctgaggcaggagaatcgcttgaacctgggaggtggatgttgtggtgagctgagctcacaccaccacactgcaagcctggatgacagagcaagactcccatttcaaaaaaaaaaaaaaattactcaatgttaaactatactttccactaaattgaacagaatgatacatcctataatattagattaactttgtaaattaattcagccacatttattgaacatttactctgtactatgaacacttactttactaggtgctatccagaagttaagatgagtctttttttccccaataggggctctacttacttagagaatttcaaagatatgcagtgtgtattttgagcaaagatagattaccttaggttggggactagaaagccaagtgtttgtacatctcttcatcctacatattttccctgagaagcttcaaccttgcccatggtttctattactatttcccacatttcttcctgtaactaattctatttaattgccaacttaatatttctatctggatattcttctgtattgtaaactaagtattactgtaacaactgtactactactgcccccaaacaacatcatcatcaaaaactgcctttcttcctataatgcttattgtggtttaatacaccaccatacacacatgactccagcaaaactttggaagtcatctgtaacttttcttttacattcattggctacatacagttggtgtctaaatcttacagatttactatctacatatatctcttgatccatttcctcctttccatccttgcactcctgccattgaattcattagctcattattactcttgacttgagttgttggcatagctgcctttttgccaacagatttgtacccttataatctttcatctaagttgccagaaagtgggtgtcctaatgtgaaaatcagatcatgtcattctgttgttgaaaatgcctcaaatgcttccctccatctttgcacacaaaaatattttgtttataaaaatactagatgagggaagtaaatttttcatttatcaaaagaagatgtgtattttagaagactgaaaaaaaatagacctacacaatacaatctaaacttagcatggcaaacaaagatatttatgctctggccctaactctgtctttggaatcagatgttagattcactcatggcttgcagctctgatacttacaatgtggccttggccttggtacttaactgttgtaaaattcacattccttatctataaaataagaatcatggctgggtggggtggctcatgcctataatcctagcactgtgggaggcagaggtgggtggatcacctgaggtcaggagtttgaaaccagcctggccaacatggtaaaaccccatctctactaaaaatacaaaaattagctgggtatgggggcacatgtccgtaatcccagctacttgggaggctgaggtaggagaattgcttgaatccaggaggcggaggttgcagtgaaccaagcttgcaccactgcactccggcctgggagacggagtgagactccatctcaaaaaacaaaaacaaaacaaaaaaaagacctcagaaggatgttgtcaggattaaaggagtccattgagtgcctagtacagatagtgaatgcttcactactggtgtcaactttaagaaaatgaatatagaaaagctaagaattattttaaggtgtttactactagcatgtaaatgtatgatgggacagagatttccatcctattttgaggaattattttttatttttttgaaaacttaaggtaacaaagtagagaggaggccagggagaaaggaaggtagtggagcaaaaatgagaaagggagtgacattcccctctagttatagcagaaaattagcaaaatgatcatgacaggaggtaacagtaaagacagccagctcatatatcaaccaagacagttttgagtttgaccagcagactgttattttctggtttagagctctttccaggaacttcttgcatctataacccctgagaaccaagctatggaaaaaattttgctcaattttaagaaaatctaacatatcaagctcctcaactccaaaatattccacaaatagctgctatttactatactgagtaataatcatttaaaattattcaacactttatttgagcatctactatgttcatggcactaaagtagaaatgaagatgaacagttcctgcctcaaaataaatgagtagtatactgctttagatcatgggtttcctagtccattaaaaacactttttggtcatattttctggacaccccgacccttttggtacagaatataacctatgtaattctctaaagttaaattaacctcacttttcttgctctaatatgtgtaaaactgaccttctaggaaagcatatacagtttatatttttgacttcttggtatcttttagtgatagacatacctcagattgagaagcactgattgacattagattaaatcagagcttcctatgacaatataaacaataccttcattaatctgatccccctacctacttcttcagcatcatctcatatctgtctccactaatcatattatagaatctttgttacctgcaccatgttaagcatttttaaaaatcttttgtttataccatacctttttcctgaaagcagttttgcctttcctttgtctctagtcataagtctcctataagaggctgttcctcattctaccattcctttgcatggataggattccatggaatagattctcatcactgcatttatcacattatttcctaagtagtacagtacatctactggaagattagccacgtgttgagttttgtctttgcattttcatgcctagaataatgccgggcacacataggcatattaagatttgaatagtgaaaaagtttttaattccatggggattttatttaaacagaaaaatataagaccaattaaaattatttttaaagcataatttcaagaaatatgactgattttgtttaaaaacatgttttcctttataatgctgccacctggtgttgctgtgtttagagatgtccctttgtaaagaattgagggtttgagttgagtttggtttggtttttggcaaatcagcttttcctttgtatatttattttgtaataaactatggaagatcttgcctttaagtgtgagaacacaagcaatgttacttttatacctttatagaatatcttgcctatgtccttcctgtagttaggtagggttttttttttgacacacagcatgttatataaggtttgcttgcacctcggtaggaaagtcctctgaaatctaaaggctgagaatctaaaagcttaactcatgttttgctcctagaaagacttgagaagagagtatttctgttcagcatggtactaagaagacagctttctcttcctcatgtcatggttgccatttcatactgcttacagagaataagatctagtctctgtcttaaataaaggtctactctctgccagcgagctagatagggtaattggattgttttccaatctattttcatttgaaatattgttttatctgaaattactcccataatttcatgtaatgccaaaaactaaactaagtacaagagcatcttcaaaaaccaacataattcctttagttcccatttagtgtagatgctctttggttgatgatattagaattgtgtaatggctattgatctctcaaagtgaggtgttgcctaggggcttaaaagttactacataaagaatttggctttatgaagaaatgttacagattttatctatattttaaaataagtgtaagtgactacctttataacttttaccatgtagtttagtagtatttcttatctgtttattaataccctgccttgttaccaaaagtatgtataatgagatgtaataagaataggtaacaagtaggctgggcacgttggctcatgcctgtaatcccagtactttgggaggccaaggcgggtgaattacctgaggtcaggagttcaagacgagcctgaccaacatggagaaaccccatccctactaaaaatacaaaattagctgggcatggtggcacatgcctgtaatcccagctacttgggaggctgaggcaggggaatcgcttgaacctaggaggtggaggttgcggtgagccaagatcacacctcattgtgctctccagcctgagcaacacgagggaaactcttgtctcaaaaaaaaagaccaggtaacaagtttgggtgaacaggattaaagagttaaataacaggaggaacctagaggacttaaagaaatgtgtggtgttgcatttaataactgtagttgccaaaggtgaggtgtaaatttattctaagcaaaggaggatgctcatttttgaaaattcacttgtccataagattaatgcctatcagttaacttgggaggagaaaaatttttctttatcagtgtctcccttttttttcttaaatcttgtattttttactaacagaattaccgaattgatgggatatgagccagaagaacttttaggccgctcaatttatgaatattatcatgctttggactctgatcatctgaccaaaactcatcatgatagtaagtacaatggaagaactcagagatattctaattacttaactgttgcaacctctgtacagtttggctacccatctaattctctggttaaaagttctagactaaatgtgttaacaggcctattcagtagagatcttgaccattttgtgttttgtatgtgttgcaacaaatatcagtaaaaatagaatcatttaatcatagaaaaaacttcctggcattttaaatacaaagacttttgaaaatccaaatattatagagtattgaatagcataattttcagaattcacataaatactcagaacagtggttggtatgtaaaaggcactcagaaagtatttgtacaatcaatgaatgtgaaggtggtgaacatcacctttggtaataagtaccattttaaaaaatgcttataagtgcatagttaggtatttatatttatgggttcatgaaatattttgatataggcatgcagtgcataaggataaatggagtacctatcacctcaagcattatcttgtgtgacaaacaatccagttatactcttttggttatttttattttattttattttatttttttcttttgagacaggatctcactctcgcccaggctggagtgcagtggagcaatctcagctcactgcaacccccgcctaccgggttcaagagattctcctgcctcatcctcccaagtagctgggattataagcatgtacaaccatgcctggctaatttttgtatttttagtatagacagggttttgccatgttggccaggctggtctcgaactcctgacctcaggttatccacctgccttggcacccggcctcttttagtttctttaaaatgtacaattaaattattttttactatagtcacccaaaacaagtacctttgacataagatttgattctgaattttactcaaatgaatgttaagatccccaagataagttaaactttcgactatctcacctgtttaatctgtacctatgcatgacttcccactgtgcttgaggatacctgaatatcactgagtttgtgtgactgatcagccttgaactcaagagtaaatccaagtctgcagtcaggacaccccaatcctcaaaataataccatcattagcatttatttagtactttctcccaaatcagtatttaatttaaattgccaaaagacttacaatgtggtatcaatttatatttaaatatgctacatatagctttttaaagcatctttggttctctggaaaccatagtcagaatttaaggaagttattgcggcaccattttcttgaaaaaggctattgattattctctaatctgacaccaacctaagtcattaaaggaattttagttactgaagattgtatattcatgaactcttcacttagctcactggcagcaaaggagttttatttagggggtttgaaaaaggaaatgggtacattttcagctattctgggacgcactgtcagaatgtaagcagttacaactgattccactaaataaacatttgttttccaaaacaatgatgaacattcagcatctgttcatttaattgaaaattcaaagttaaaatattttctctgcatgattctttttcttttcccccctagtgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgaggtaagtaagtttgagaaataaacatttttggggaacaaatagtaattctttttggatactctgttcatttataggaagataagataataaatattaactaaattttaattcttttacatcgctaccaaattattattttctatactctgacctaggtttccagtccagctattccacagtgatgctgctaaacactgtcagtagttgtctatccccataccttcactcctatttttaaaaagaccatgaaaaaaataccagatccattgattggtttggtctaattatacagatatcggcatatactatctcaagacagctgtgttctttttgtaggaagaatcctggcctagatttgtatcatagctctaccactcattagctccctgaccttggggaagtctcttcatttttctgaatttcatctatgtagataatccttcagaaggttataatgaaaattaaatgaaattctatgagattagggaggggggagagatagcattaggagatatacttaatgtgaatgatgagttaatggatgtagcacaccaacatggcacatgtatacatatgtaacaaacctgcacgttgtgcacatgcaccctagaacttaaagtataatttaaaaaagaaaagaaattctatgagattaataagctatatgatgtaatacatggctcttgtatattcatgaactcttcacttagctctttggcttgtgaatattatgtacatcaaaatttaatttttcatttgatctattttactagactcctgccccatctagtctacctgtccacattattaccacattctagtccatcttgcccattactaccaggctaagctttctagtgtggatatgtcatcatcttattttccttagaattttagcgatctttttatcatttccaagataaacacttgcctaggtgtacagcatccttgtttaccatcatactcacgcattagagatttagccttccctttaaaatctagggtcactcctcttaggaagactttgggcagtttttatttttgctacttctgacaccatcctttaatgttttaatattagtgccacagagttcttttgtgactttaccattatgtaagaatcttccacttggaatgtctttctcttcctcacaccccagtctgcctagcaaatgccacttgatcccaagtatcagcttgttagcttctcagtgaagcaagccttctctattttagcagttatcacagtgtattttaattgtttacatatctactttcacaatgggttataaatttcttaaggtcaagggttggctattttaatctttgcattatcagttcatttcagatagtgaacatttaatacgttaattaaaggaataatttacatttaagccaaacgtgaagataaactattgctcatcatccctcttcagccgtatcctgtaggtggtatcaccttatattcttaccaccaaagaaaatatggcccctctcttagaaagatcttaatcatttatctgtgtatctttaggactatccttagatcatgcctcacatattgatgccaaagagttcttttgtgccaatttcataatgtgtgtcagcacaacaattctgaagatttgttggtgtctttcatgtacttgactacaaattgccttgccattactactcttctcaaaggatatctgaaattctttttttcttttttttttttgagatggagtctcactgtcacccaggctggagtgcagtggcgtgatcttggctcactccatttcccgagctcaagcgattctcatgcctcagcctcccaagtagctgggactacaggtgtgcaccaccacaccgggctaattttttgtatttttagtagagacagggttttgccatgttggccaggctcttgaactcccaggctcaagcgatccacccacctcagcctcccaaagtcctgggattacaggcatgagccaccacgcccagcctggatatctgaaattcttaactgaaattagtcaaattatcttgtactggggattttttttttaatttcaacttttatttttgattcaggggatacatgcataggtttgttacatgggtatatcatgtgatgctgaggtttggggtacaattgatcctgtcacccaggtagtgagcataatacccaacagttgttcaacccttgcccctctcccctagtagtcctcagtgtctattgatgccatctttatgtccacaagtaacccagtgtttagctcccacttacaagtgagaacatgcagcatttggttttctgttcctgggttatctcacttaggataatggtctctggatgcatccatgttgctgcaaaggacattatttcattcttttttatggttgcatactgtggattttattgggtctttattttgtattagcattttaaaaccctaaatgtgacacagtatgcatgagtgatcatgcatctcaagaaatcttgaaatgttcctgtccataaagcagaattttttaagagaccatttcacagtctcccttcccctcactgtatcaagtgctcatttgtgaattaccaatttctcttgttttgacagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacggtgagtagttatttttgttaatcccctaaattgtgtctgttgctacaagccccatttcaactaaacattactttacggtttttgttggtaatcatttggacattacaagctaatatatgtttatagttttcttaaatgtatttgcttaaatatttttgcccccgtaatttcttaccattcttgcttttttatactgttggaaattgtgcttcaaagtgtccttaaggtatttcttcttcccacataaatttttcctggctactctatttctgtatcctgctgtcagattttctccacagtttagcagagttatatggaagtaggcattgttgcattaaaggataaaaaagtagtcatactataacatcaagcattgaagatgaaaactgcaattttaaagtagagaacattttaatgtataaaaaggttggtattgccttttgtcttttatgccatagagattaagaggcggtatcaatagtggattgtaaaggtaactcagacttatggttatactatactattgtatgtaaactttctgatgaaggaaaatttggtgacattttgttgtttgatgaattagacaaaccttttgtgaaaaagaacataaattttttatatgtgaaaatccttgtggccgggcgcagtggctcacgcctgtaatcccagcactttgggaggccgaggcgggtggatcacttgaggttaggagttcgagaccagcctggccaccatggtgaaaccccgtctctaccaaaaatacaaaagttagctgggcgtggtggtgtgcgcctgtaatcccagctacttgggaggctgaggcaggggaattgcttgaacctgggaggcagaggttgcagtgagccaagattgcgccattgcactccagcctgggcaacagagcaagactctgtcttgggtaaaaaaaaaaaaaaatccttctatactttagattgactcatattttttccccacagacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgaggtaggtgtcatgatataatcagaaagggacaactttcagattttaacattcaagaatgtatttataagtttgattcaaacactcatttgaaccacaaattacatttgtgtgtgtgtttgaattttagcactttaaaattattgcaagagctactgcctaacctagacctgagcacatgttttaggctcaaagatagtcaggaacatgggaagaaactagcttaatataaaccaaaaggtgaaacgtacattgtttctctattatttatatcagtaggacaaaaacatcttgaatttggacatttaaagagaatagtactaagtgtgctcaaggtagctacagcctatacctgttaccccttttagtttgttttattgtgttttgttttgttttgagaaagagtctcactatcacccaggctggagtgcagtggtgcaatcacagcctcaacctcccaggctcaaatgattctcccacctcagcctcccaagtagctgggactacaggcctgcatcaccatgcctggctaattttttaacctttttttgtgtgtgtgtgtggagttggggttctcactatgttgctcaggctggttttaaactcctgggctcaagcgatcctcctgccttggcctcccaaagtactaggattacaggcgtgagctaccatgcctggcccattacccctttgagttggagaactgtctggtagcaatagacttacgagggtttaaatgggaaaggaccttataaattctttgcccaatttagtctaatttccatcactattttgaaattttgggtaagtataatatgaaaataacaagtgttacataaaataaatacttagtaactggtcttttttattctggatctgtcttgatattaattgtcctatgaacacaaaaataatctttaaaggctaggctggccaagacttagagatatcacacagggctctatttctaaatctagaatgattccattttagggcttcctacatctaaaaatatgctcaggagtagggcaacttagatctgaacattataacttgataaatgaggcataaataagctttaataagtggtaaataattctacattaggtatttgttgaataaaactgacaagctaagagtaggggatttgacatctcacagccttgtgttgaatgaatatatatcctatgctctggttgcttaatttacccagaaaaaaaaatgtttgattcatcttggtttttatctaacaaaagtaaatctaacaaaaacgttagaatgaggaaagcaaaatttcttgtttagaatacacagctatagttttttgttaaacttcttgcccagaactcttaaaatagtaataatgtacattcgttcaggtatatgcaggtaaaataacttaggtttctactcccacccccgacagtaacagtgagatttttaggtagctcagtcaccaaaggagtgtgccttctcagttcaaaggtaaattccagtgaatgtagcatctagttaattggtcaattaggtaccattgtgggatgtgaattaccaaataggttttattctttagaataaggtgtttcttttcatctcaattttgtaaatgatgttatattacatagtcagaaatatatatattggcaaaattagttaccagtataagcttcaaaatgtcactattttcacaaatttttttttttttttttttttttttttgagatggagtctcactctgtcgccaggctggagtgcagtggcacgatcttggctcactgcaacctctgcctcccaggttcaagtgattctcctgcctcagcctcctgaggagctgggattacaggcgtatgccaccatgcctagctaatttttgtatttttagtagagacgaggtttcaccatgttggccaggatggtctcgatctcttgacctcattatccctccaccttggcttcccaaagtgctgggattacaggcgtgagccactgagcccggcctagttaaataaaatttgataaacacgatggacttggttgtgtgttttctggtttttctgagatctagtttgaaaattctgacaactagcaaagtatatggaagcttcttcaggaaatagtaaacatatttctttttacagcctaatagtcccagtgaatattgtttttatgtggatagtgatatggtcaatgaattcaagttggaattggtagaaaaactttttgctgaagacacagaagcaaagaacccattttctactcaggtatatgaacttatttgttttatattaaatttcattaatttttagtctgaagtgactttgagtttcacttgttttttatttataaggtgtggccattgtaaaaactcatgtatttgctgttttaaaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaaggtatttatatgtaacattcaagttatagttcttttattatttttgagataaatgtatgtgatagtacatgatttttaaacttatagcaaactttctgacatatatgccctaacgcaaattcttgagaactcaaaaaactttctaaattaacctcatatattttttctttttctttctttttttttttttttgagacagagtctcgctttgtcgcccaggctggagtgcaatggcatggcaccatctcagctcacggcaacctctgcctcctgggtgcaagagattctcctgcctcagcctcccgagtagctgggattacaggcatgcaccaccacgcccggctgatttttttggtatttttcatagagacagggtttctccacgttggtcaggctggtctcaaactcccgacttcaggtgatccgcctgcctcagcctccgaaagagctgggattacaggtgtgagccaccatgcccgctcctattttttctaaaataattataaattctaaaattacctatctaaatggaggagggtcttctgacacctttaaaataaaatccagctgagtactgtaaatgtgtttacagaacttgtttaaagttcttacagttgtttaaatcagactagttaactaccctcactacttagatgcttccatttcttagagctcttttttaagcttatctgaagaaaagcccttccaatttaagggttatttccaattgcacattccaaattgagccttccatcttcagcattcaatatagatatttacaggcccctcttttaaaattttattatagttaacttgtattaaagttgcttttatttttcattacgtatttgtagaacattagctatatatatattgcaggctacataggttttcaaactgtacaacaggaatctaagcatgaattgttacttctatggagctagttcaaacaaacatatggacatgacccaatttttaagttatactttctgtatataatttgtaaggggatttcacatattttaagtttgaggctatagctagaagaaattaagttttatctaataagtgtgtggaaaagggaaatgattccttctctactatgtctagactaagccagatatcaatagcaataggaaagaaccactgtcgtagccagaacacatagcttttttccctgcctaacatttccaccttgacctagagtgctgggagaggtcttttccctaagcttggaaaagacattggggctttagatgaactcagaagtactttacattactttatttactgtgtcacttactcacttttgactctgagctccacgagggcaatcacagtgtcttgggcattttagtgatactaatacttagctcatgacctaatgtgtagtacttcctcaataaatggttgttgaggcagggcgcagtggctcatgactgtaatctcagcactttgggaggctgaagcgggtggatcacctgaggccaagagtttcagaccagcctggccaacatggtgaaacccggtctactaaaaatgcaaaaattagctgggcgtggtggcacgtgcctgtaatcccagctactttgggaggttgaggcaggagaattgcttgaaccctggaggtggaggctgcagtgagccgagatcgtgccattgcactccagcctgggcgagaagagtgaaactcggtttcaaaaaaaaaaaaaaaaaaaaaagttgttggactgacagatgcatgaatacagtagtaaaaatgacaatcacttataagttacagtttactatcagctacagaggatgggatatccagttttctgaacaactgttctcttgtacttgtcaaagccaaagtgtaacaacacatcaagtcactttagcaatttatttttgagacggagttttgctcttgttgcccaggctggagtgcaatggcgtgatctcggatcttggctcaccgcaactgccgcctcgctggttcaagcaaatctcgtgcctcagcctcccgagtagctgggattacaggcatgcaccaccacacccagctaattttgtatttttagtagagacagtgtttctccaggttgatcaggctggtctcaaactcccgacctcaggtgatccacctgcctcagcctcccaaagtgctgggatgacagttgtgagccactgtgcccagctagcaactgtttttaaacattagttccaatgtagtgtacactgaaaacttttatgaaaggaatttcaaaaattaagataaaccattaaaaacgtaattactaagtactactactactacaatgatatttacataatagactgagttacatttcataaagacaatatatctgtataagaatttttaaacttccctgtctatataatagaagttttagagaaattttttaaaaaccaaagaaaactgcaaaataagatcacttacctatttggcattctcaactgtctggaacagcaaggagccattatgattatgcatttggtttgtggggtgtcttgaaaagtcaaaataatgtaacaaagctgatgtactttactcattagaacaattcttcacaatttaatattaattttagatacacatagttcatgtttgataaccagatcaatactgagtgaaaaatagcatagtgggaagagcaggggaggggaggtagggatctggagacctagagtgtacttccatattgcaactagtgagcagtaggactttgagaaagttacccaataggcctcagggttctaatttataaaatgggtatgatatgcctgccttatctgtcttgggaacttaagtaaggttaaaatgaactaatgaacttgaaatgttttataaactgaaaatgctatacgaatgtgagattgatcttgtatttcaatagtcccaacaatatcactgcattgttatattaggtggaataaaaggacaatatttaactgttttgactctacaatagtgtcaatttagttgtgttcagctctattttataaaatagggatacgcatactgtagaaaatttcctgttaaattaagctttgacggccaggtgctcacgcctgtaatcccagcactttgggaggccaaggtgggcagatcacttgcgctcaggagtttgagaccagcctgagcaacatagtgaaatcctgtctctacaaaaatatgtatatataaattagtcataatcccagctacttgagaggctgaggtgggaggatcacttgattccagaggcagggcttggttgcagtaagcagagatcacgtctctgcactccagcctggctgacagagtaagaccgtgtttcaccaaaaaaaaaaaaaaaaaaattaagcttttacttttaagatgataaactttagtgatcaggaaagttatcttatgtatattatattccttaatattggagaactaaagaattatgtattttctttaaaagcgctcactggatattttttttaaaaacgctatattttcatttagaatttttttcttttcagaactacagttcctgaggaagaactaaatccaaagatactagctttgcagaatgctcagagaaagcgaaaaatggaacatgatggttcactttttcaagcagtaggaattgtaagtatgagtagtaggttttgcttttctagctaatgtgctatttcgtgtgtgtgtgtgtgtgtgtgtgtgtgtgtttccacgtttcttccaaatagtaaagttatattttcagaagttatacattgggtttttttactctgtatgcactggtttttaaaaatacaaatgtttaatacatacattcttggtataaaaattccaaacaattccagtgtattttgagttaaaaagtgaagttctccccttactccaccctgaatatcaccaccaatctcattctcttccctttaagttactttgccttattaaaagaactgctattggccaggcacagtgcctcacgcctgtaatcccagcactttgggaggccaagatgaggatcacttgaggtcaggagttcgagaccagcctggccaacttggtgaaaccctgtctctactaaaaatacaaaaattagccaggcgtgttggtgcacaactataatcccagccactctggaggctgaggcaggagaatagcttgaacccgggaggtggaggttgcgatgagctgagatcaggccactgcactccagcctgggtaagagagtgagagtccatctcatatttaaaaaagaactgctatgttttggggtaagtcaatggtggtataatacattctgatattttcaaactaaattaactggaaagtatttatagacagaatggtcataatggatgacaaataacttaagaaagaattcaaaataatttagggtagtatttaagaaactgcctataatgttattaaatttacaccaatttcaaggtttttggttgtttaaaaaaaaaattcaacaaactaaacttgaaataactttactgtttatagggaacattattacagcagccagacgatcatgcagctactacatcactttcttggaaacgtgtaaaaggatgcaaatctagtgaacagaatggaatggagcaaaagacaattattttaataccctctggttagtttattctttttgaccttgaacatcacaaagacaaaatacatgaaacatttttatttaggagctttaatctaagtgagaatgactttggttccttagcaagattaaaaagtaaagttgtggctgggcgcggtggttcacacctgtaatcccagcactttgggaggccgaggcagccagatcatctgaggtcaggagttggagaccagcctggccaccatggtgaaaccccgtctctactaaaaatacaaaaattagctgggcgtggtggcgggcgcctgtaatcccagctacttgggaggctgaggcatgagaattgcttgaacccggaaggcagaggttgcagtgagccaagatggcaccactgcactccagcctgggcgacaagggtgagactctgcctcaaaaaaaaaaaaaaaaaaaagtacagttgtatttcatgtgatggtcttaatacagagattaacatttcaaggtggagcttttcatttttagtaattttctttgatttctctatgtccatgtgctgtcaatattgatagaagctgaaatttgtgaacttttatgactacttttcttttttttttttttttttgagacagggtctcgctctgttgcccaggcctggagtgcagtggcatgatcatagctcactgcagtctcaaactcctgtgctcaagctcaagcaatcatcctacctcagcctcctgagtagctcgcactacagacatgcctcaccacacccggttgctttttgtagagatggggtctcactatgttgcctaggctggtttcaaactcctggcctcaagtgatcctcctgcctcagcctgtgctaggattacaggcatcagctttgatgcccaccatatttatgcctttttccaaattgttatttctttgtgcctttattgtatcctgtaaacatttctgacacagcaacagtatcactggattatacttactttttaacatagttgtggttttgccaggtaaactaaaaacccttccagaagtttgctttattttctatgatacctaacacattgtgggtgtttaataaatattcattgactagatgaatgtatacttaggtatctcttttgtttttcagatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaccaggcccctttgatcagcttttatgttcaaatattaataatatttgcttcaacacctccaactcataaaattgtttaccaacaatttaagcacttatgaaaattacatggtactggttatttctacatttatcttagtgccatcaccttaatgtatgttgagtccctaaatgtcatgttaaataataacaaccataatatcccattgaaaagagtatgttgttagaaaagaaacatcatttttaagtttctgagcctattaaaatgctcaaacacaaaatattagtatttttaaaatatgaatgggatgagtgaagcagttctcagcattatagtcacaatgttacaaaggctagagcttctctgaagatttctaatctgttcccattaacagattaataaacttagacttcaaatgaataatttgcccaagctttaaaagtaatagatggcagaccaaaaatgtaagcttaagtttcctgactctaaagtcaaacttagaacaaatttggtttgtttttgttttaatgatactgcgttttaaaacaaagtagctttatcctttttctcctgtatttttcttttacaaaatagctgtatttcttttatactgataatctcatttttaaaaatcagacagtgtagaaagatattttttaaaacagaaaaatcactatgaatccctgcacctacaggtacagaaaattatttttatgaacaaattatgtaggaagtgccagagccttaggtcctgtaccctgaggtatatatactgaacaaaaggaactgagccacagatctcttaggtagctctttttatcttacaatggaggacagtgattacaattatatgaaaattttggaacaaaagttaatactaagattcagtgcaaaatttggggggggggggggcacaggtatacttaagcacaaacactgtgacccaaagtgcttcaacatttagttacagatagtagtatactagaagtggtattttagaataaagtggttgcttagtattcacaggtcacaaaacaaaaaattattcttgtatagcaaattagcttcagttgaaaactatttgtaaaagcagattatgtaatgaccaggagttcaggaaaatgacttctgaaagcattgagaagggaaagccacgttaaaggacagtacagctggaaggaagcaagtacttacccactgctcagtcactaagacaacaagctccttggagtgctttaagctacggaatagcagaactggcccttcccaattttatgcaccgtcacaaatttcttcataatggttttgtccaaggcttataacccaaccctggcaactataatccttactttatgaaacagctgtatttcttttatactcataacccagaaaaatgagaatgtatgttctgagtataaaagaaatgtagctattccataaaaatacaggagaaaaagaataaagctattttaatttttttaatgcagtatcattaaaaaacaaaccaagtttgttctaagtttgactttagagtcaggagacttaagcttacatttctggtctgccatctattacttttagagcttgggtaaatcttcatttgagatctaaatgctatatatagttcattcatagcagtaccagataagggaggagtatatctatacagtatatagtcttgaagaagtgatctaaggctcggagcttttgaggtggccatgagtgactccaaagtccatggagctaaccaccctgcagtgctagccaatccagttgaacatacccttttctccattgttaactgtttgtttaaatagcaaacagaaggcggcaatggaggtgtggaaaactgaggatccgatgtcacttgaaagtaatgagatcacataacattgagggaatgtcctaagaggagtggcagggcataaatagaaatgaataaaagtgttttcaagtgccatttagtgggttctgaatttgaactagagattgagatatc

SEQ ID NO: 11961 - DNA, 9133 bp, Human
agctgaggccttttctgcacggctctaacccaagttgcgaatgtgagctggaaggcatgctgccaccttatctgtccgcctgcctcgaccacattcacaacctacggctggaatttgagccatcgaggaagccgagccgccgggcggccatcgagctgctgatggttctggcgggccgtgccccggggctgcgaggcctgcgcctggagtgccgcggagaaaaaccgctcttcgacgcgggccgcgacgtcctggaggctgtgcacgctgtatgcggggcggccagccagctacgccacctcgacctgcggcgcttgtccttcacactggacgacgcgctggtgctgcaggcggcgcgcagctgtcccgagctccacagcctttttctggacaacagtaccctagtgggcagcgtgggtcccggctcagtgctcgagctactggaggcctgcccgcgcctgcgcgctctcggcctgcacctagccagtttgtcgcacgccatcctcgaagcactggcggcgccagaccgagcgcctttcgcgctcttggctctgcggtgcgcgtgccccgaagatgcacgcgcgtccccgctgcccaacgaagcctgggtcgcgttgcgccgccgccaccctgggctggcagtggagctggagctggagcccgcgctgcccgctgagagcgtgacgcgcgtcctgcagccagccgtccccgtggctgcgctgcgcctcaacctctcaggcgacaccgtaggcccagtgcgcttcgcagcacaccactacgccgcaaccctgtgcgcgctcgaggtgcgcgcagccgcttcggccgagctgaacgccgcgctggaggagctggcggcgcgctgcgcggccctgcgcgaggtgcattgtttctgcgtggtgagccactcggtgctggacgccttccgcgcgcactgcccgcgcctgcgcacctataccctcaagctcacgcgcgagccgcatccctggaggcctacgctcgtggcgtgattgggcgacttctctcccccgtccccgtggacgtaagcgctctgagagggaacgggggggggtgtccaggcgcgccccgagtgctagtgccttcttttgggattgttgccccccgggtctttaccgagttgggaactgtgatggcatcgggaccagtcctgggcgccctgagaccactcgctgctctcaccctctgcagacgccccacccgctcggtcctggacacactgcccccctctcttgcctccacccctctgcggactctgcagctccgcggccccggcgcagggagagggagggcacgggcgcgggccgggcctcaagggtgagtgtgaaataaacaaatcctgcagtgtttctgcgtcctattaaaggcggggtcggatctgaaagggaaggacagggaacgcgcggggtaccggaggagccatcccggcagaggttgggtttcctcaagagcctctggacgacacagctgcggggggtcagggtcggggcactcacacccttggaatgactacgtcccggggttcggcgggagggggcgtgcttccctgcccccccttcctatctgcttgccctgcctggggcttcactgtgcctctggccattaccttctaggacttgcccagcccacaccaggtcgcgcaccggcgatttctcctgtagaacaaagaaggaaatagagggaccgagaggggtgggactcgaacccaagtctcccactcatctcaccccaccccaccccactccaccccaccccacccctccactccactccactccacacatcccatccagccagccttttctgcctgctggtgcctcggccgctgtccgagccccgccccgcgggcttgcacgtggcccccgcctgacccggcgccccggggcggagtagggcggagcgggcggcaaacgcagcactttccgcggctttgacgagcccgcagcggccgggcccgagcgcagagccgggccgagactgcaccatgcaggaagcgccagctgcgctgcccacggagccaggccccagccccgtgcctgccttcctcggcaagctatgggcgctggtgggggacccaggcacagaccacctgatccgctggagcccggtgagggccggggcccctcgattccccctgtggtcccggggtccctccacgtcagtgaacacccatgcccgcccaaccccctcctgagactgggccgtggatccccggatttggccattcagagaagttcaccttggagggggtgtgcgagaggggggtttcctctgcggccgaagaagggttaggagcctgccttctgaagacctagagtccgagggaccttcgaggccatttagttcccaccctaccccatccgacagatgggaaaacagaggccgggagatgggaagggctggtctagctcagggtcacattgcggggctgggaaccccgtcagcctctcctttctgagaactgagtatggagtcagggtctggctgggggtagggactcactgtggtcgctccaggctaggcctcggagcccgttctggcctggcctcgacccatatccccgtaagcggcaggcctggacccaagagtgagcatgagtgtgtgcgcgcgctggagcgcaggactggccgtgagcgggcaccgctcaccctcctggtctccgcccgcacggtgggcgggcggcgttcttggtagagcgggaccagtttcctcgtaagcgaccagagccgtttcgccaaggaagtgctgccccagtatttcaagcatagcaacatggcgagcttcgtgcgccaactcaacatgtgtgagtccctacggccgggcggggagcggggatgggggactcggtgccggggatggggcgacccacgcccccacgccccactccccagacggttttcggaaggtggtgagcatcgagcagggcggcctgcttaggccggagcgcgaccacgtcgagttccagcacccgagcttcgtgcgcggccgcgagcagctactggagcgcgtgcggcgcaaggtgggggcggcctgcgggaatgagcaaagaggaggaggggtgctgggactgcctgccttgctcctgcgacccagtcccgacggtgcctcccgcctgcaggtgcccgcgctgcgcggcgacgacggccgctggcgcccggaggacctgggtcgactactgggcgaggtgcaggctttgcggggagtgcaggagagcaccgaggcgcggctgcgggagctcaggcagtgcgggggcgggcggggaaagaggggacaggggtggggggttcgggatgagaccataactggccggccagcagttctgggcagccccttcctctctcctgccttggcgcctccatctagacttatgggcgatctctgggatggccagtcagcggggtggtctcctgggtccccagcctcgccattctgtggggggtggtgactgggcgaactctcagatgcctcagcaccctcccaccccttcctcaggcagaacgagatcttgtggcgggaggtggtgacacttcggcagagccacggtcagcagcaccgggtcattggcaaggtgttcctctccccaagcctcgcttctccctcccactcctcgacaccccattccaccgcccagtcccccggcgcccctgttaagccttcctccctcacctggaagtgcgggggtgggggggctgtgtccaaagtatgaattaaacctttgctttctcttcagctgatccagtgtctctttgggccacttcaggcggggccgagcaatgcaggaggcaagagaaagctgtgagtgagaaagccaagaaggcccacacccacttccaagaccccccagaagtccccttgcaaggaccccttctcctctggaaactccttcaccgggaatcctcattcctccccctgcgctacaggcttcctcaccccatctaggatccacttccccccaactctgccacctggtatccccactcccagatcctcccattccaggaccttattcccaaattcctaccccagcagccccttccccctccggcaaggcttcccaacagctgagaccctggggctcaaaccaggttccctccctcccctctctacccacaaagggcccccatctctagggggagccccttccacctccagcatgtgactgacaccctagcaacaggcctcagctctgctgacttggctgctggggcctgagggagggagggaagtgcaggccgaggtgcatgggggctgaccctgccccacccctgcctgtgccctgatcgaccacacaggtccctgatgctggatgaggggagctcatgcccaacacctgccaagttcaacacctgccctctacctggtgcccttctgcaggacccctacttcatccagtcggtaggtttgtcttcttcccccttcccaagggcatggctgggcttatggagagcctgttccttctccccatcccctaaaaggaagagaagatggaagccagccttccccccaaccagacccaggccctccagcatggactgagcctcctccctcaaaccttctcccttagacctggcccaggtgggtgttggtggggttctggctctccctgtgcctacaggccaagggctgggcctagccttctacttacagcctctcccagagacaaatttgggccttagccctcacagggccaggggccccatcatctctgacatcccagaagactctccatcccctgaggggaccaggctttctccctccagtgatggcaggaggtaagggggacagggctgcccctgaggggcctgtgggggagggcctggcagcccagatggctgtaggggtagagggagaagtcagtgccagggtctggttgaagcttttctctggtgcagggagaagggcctggcactgctcaaagaagagccggccagtccagggggggatggcgaggccgggctggccctggccccaaacgagtgtgacttctgcgtgacagcccccccgccactgcctgtggctgtggtgcaggccatcctggaagggaaagggagcttcagccccgaggggcccaggaatgcccaacagcctgaaccaggggatcccagggagatacctgacaggtgagcagagccccagctggcccatgagccctgtgatagaacagcccttaccagcccacaaagcttcctagccatttgactccatgatactcacctgatttcttggccccagcatcagagttctgtggaaagcagagcctcccagtcagggcactcagcatctgcggaagggcttaggaacctacatatgaaatgagttccctggggtgactgcaaagtacacaatagtttaagaagcattggtggctatgaggtggctcatgcatgtaatcccagcactttgggaggctgaggcgggcagatcacttgaggtcaggagttcaacaccagcctggccaacatggtgaaaccccccgcctctgctaaaaatacaaaaattagctgggtgtggtggcgtttgcctgtagtcccagctactcaggaggctgaggcaggacagtcgcttgaacttgggaggtggaggctgcagttagccaagacagtgccatagtgacatagtgggtgacatagtgaaactgtctccaaaaaaaagaaaagaaagaaagaaggaaagagagagagagagagaaagaaaaaagaaaggaagaaagaaagaaataaagaaagaagagaaagaagcatggatattgatacttgcatagggaggggaagggtcccaaagccccagctccaccacccaaacttcaggtcccaggtaggaagcagaggcactttctctgtgccatttatggcaggagtggggaggttgggggtggagagaggatggggatcctctcctatcattttctaaagattgggggattaaaatcttgatgcatctgggttccttgggaacttaatgcggggtggacactgcaggccaaaagcagttctgtctgcacagggggcctctgggcctggaaagcggggacaggagcccagagagtctgctgcctccgatgctgcttcagccccctcaagaaagtgtggaacctgcagggcctctagatgtgagtaccccttctgctgaaacaggggcatgagacctggtggggtctagctctctgtggagcctggggagggcaccactgacccagagctctcctcaggtgctgggccccagtctccaagggcgagaatggaccctgatggacttggacatggagctgtccttggtaagaagtgggtcggggagggcagaggccaggggtggctgagtcaagccctctggtccatagctgttctctgtgagccaaagccgtgtctctagaagaattgtcacagtgatttcccagctgtccccctcagctgctaggtcccctccccagctgctccctgcggttctcacgcagatgcagcccttggttccagagcggggtgagcctgagctggcggtcaaggggttaaattctccaagcccaggtaatggttgtgatgactcctacctgggaggacgccgtgattgggctgagctaccttgattgagtgagggggcaatctgcaatttgcagggaaatcctgagttcaggctgcactgcagagcgttccttgagccacccatgccctcaccattgggcgagagtggggaggttaagaatggatgttttatcctaactgagcagaaggcaggcgggcagggctctccttccctgaagaaaggagggggaacatttcccctggtgagcgcagtcccacttctcctagggaaggaccccacgctcggggccccactcctgctggatgtccaggcggccttgggaggcccagccctgggcctgcctggggctttaaccatttatagcactcctgagagccggactgcctcctacttgggcccggaagccagtccctccccctaagaccccgcgcctctgaaggggcttggaaccagtccgccgctgcacatccttcttggcttcctggcgccccctatcgggggtgagcgaagcccccactactaaatggcctctctccactaccccgactatccctgcacataaactccgttttttttttttctgtttctggtctcttttctctatcgaccagggagcacaggagttatgggtggggggtgattttgcatttgtagaagcgtccagatactaggtttttaatagaggaaccccaggagggtggaggtgcttggggatccggtgcctagctcccttgcttaggcccgggtccagggctggcgcggggccgctgcaatctctgggaagcgggggcttctgggtcgcgctcagctctgcaatgcatgcgttctgtgatcctggtgagttggtatccttctctgaacttcctctgtgacaggcagagaagaggggtcgatgacaagatagatggaaagcacctggaaattggcaggccctgagtgggcgctggacgtgtggggccgcgggccgaactgccccctcctggcctcatctcctggtgcgccccgggtggggagggaaagctgactacatgcacgtccccagccagcgcgcggcctccgcggtgtggctcctagtgcccggggaagaaccctcaccctccctattcccagcagccctggccgccccgcccccgccgcagctgctgcacccacccccaccctgcccggccctttctgcaccgtcatctcctgccccgccgaggcttgacccgtgagtggggacgcccaaaacgggccagaccgggagccccactcccggctgtgggagggaagggaaaccgagattgggcagaatcagcgccccaccacccgctgcggcgctcgggggtcgggggggcggggtgggtaggactgtgggccccgccctgccgcaggactctcaagctctgggactgggtggagggaggtaaggggcggggggggaaaatccgtgcagtcgcacatgcgcaaaggctcttcactgtcccaagaccctggcttcctggccaaagagcccgcgcagcgaggtggggttgggggctgggacccagctccgtgccccgccacctggctctctgggaagaatcggacctgtcaccctcgaaggactggccgctaaataacttcggtattgagagctgtgtgagcctcaaagggagggcccagaccagctggagtctctacccccagacaggataaagggcaggacttggggtcataggaggaggcggctaacatgaaaacaacttaggttggagagaaggaggggccaatccaatctgcaccctccctgtgtctgtcccgagtaggtgctgtccccctctcccttcctttgcccaccgattggagggacactctggaaaactcagttgaagaaagcggagagtctgcgtgtacacagtgcaatgatgtcagttaatgcactagtgagggcatgtgttgttcacggtacacagaagaaggaaccaccagcccttgggacacttaggcattggtgtagacaagggaacatttgagtcctggacgatggataggtccacggagcggagggaggagaaaaggattccagtcttagcgatcagcatcagcaaaggctccgaggtgccagaggcatagtgagttctccgatccctggctggtggagggaagctgggaagggcctggctgtccagggtggtgggaggaggctagagtagccagaccagatattttgggttgtctctgatgggcagtggggtgtgggggggaggtagataggtatttaggatggaattctgctagacaggaaaatatagttcagttcctcatagttcaggctggagcaagtaagattccagttttaccactgaatctctgagcctgtctcctcatctgtaaaatgggaacagcaatcctagcccagagggttgtcaaagtcactgtgctatcgggcctggcagaatgggagtgagaggggctcagagggactgttacaggacatgaggtgacgatggtggggtggcaaggcaggagctgatggagactcactgagaagtggagaagcaagattcatcacatacgggacataaagggagatggaggggcagggggtagtcctggtctc

SEQ ID NO: 11962 - DNA, 16505 bp, Human
atggataacagttcggaggttcctcaaaagactaaaaatagaactaccatatgatccagtaatcccactgccaggaatacatcaaaaagaaaggaaatcagtacatcaaagagatatctgcactcccatgtttattgcagcactattcacaatagccaagatttggaagcaacctaagtgtccatcagcagaagaatggatacagaaaatgtggtacatttacacaacggagtgctctttagccataaaaagaatgagatcctgtcatttgcaacaacatggatagaagtggaggtcattataagtgaattaagccaggcacagaaagacaaattttacatattctcacttgtttgtggaagctaaaaatattaagacaattgaacttatggagatagagattagaatgatgattactagaggctgggaagagtagtagcgggggaagtggggatggttaatgggtacaaaaatatacttagatagaattaataagatctagtgtttgttagaacaagaggatgactatagtcaacaatagtttattgcacatttcaaaataactaaaagagtataattggattgtttgtaatacaaagaataaatgcttgaagtcatttaccctgatgtgattattactcattgtatgctcgcatcaaatatctcatgtaccccataaatatatatatctactatgtgtccacaaaaaatttttaaaaataataagaattggcttaaaaaatgctgtttcctgggccccaccctagactgatggtcagatacctaatgttgacaaaaaaagtcaaactctgtaaaacatttgaagagatttattctaagccaaatatgaatgacctatggcctgtgacacagccctcaggagatcctgagaacatgtgccaggccacaacttggttttatacattttagggagacataaggcatcaatcaatacatgtaaggtgtacattggctaggtccagaaaggtgggacaattggaaacagggaagcggggcagcttccaagtcataggcagattcaaagattttctgattgacaatttgttgaaagagttattatcaatagaaaggaatgtttggagacatccaatagaaattcaatagacaatcattagaaaggaatgtctgggtcgtggagaccaaggttttattatgcagatgaagcctccaagtagcaggcttcagagagaataggttgtaaatgtttcttaatacacttaaaaagagcatgttctggctgggtgcagtggctcatgcctgtaatcccagcactttgggaggccaaggtggttggatcacctgctatcaggagttcaagaccagcctgaccaacatggcgaaacctcgtctctactaaaaatacaaatattagccgggcatggtggtgggtgcctgtaatcccagctactcgggaggctgaggcaagagaatcacttgaacccaggaggcagaggttgcagtgagacgcaatcatgccactgcattccagcctgggcaacagagtaagactctgtctcaaaaaaaaacaaaaacaaaaacaaaaaaagagtgtgttctattagtaattccaaaaggaaaaaggatgtaatgaggcatatccagcttccccttcacatcagttttcaggttaactttggaatgcccttggccaaaagcaggggtccagtcacatggttggtgagtatggccttagaatttaattttttggtttacattaggaatgcttccacattctctcaaacaaattttagtcacagttttgaataacgtactctggctcagccattgcaggtctcaagccgttaggtttcattttcctcctcccaacgattttaaattagtttcactttccagtttcctcttccttcccctaaaagcaattactcaaaaacggagaaaacatcagctgatgcgtgccctactctcccacccctttatatagttccttcagtatttacttgaggcagacaggaagacttctgaagaacaaatcagcctggtcaccagcttttcggaacagcagagacacagagggcagtcatgaggtcagtgaaataagaatgcataatcatgcttgtttttgagtgcaaattgtaagttgagtttcttactgtgcaggcacattcctgaattgtcctgatgtttatagattcaatatgtctttatcagtctgagcatttgtaagatgtttgaggggtttttccctgtggctttttttggtgtacacacaggcttcttaagtttctggaatggttccctacggaactacatggggggaggcagggtggggaatgcatcagctcatgtttcctccctgtgtgcagctatttcctgcaatgagaggaaggcttggcaggagcggtgtatttcactcagccacaaacttggctgattcaagggtagacctaagggaattactcttttgggtttttctgttattgtcattttgtttgaaaagattaagtcacaggctttttttcttgtaattttaaaaggaggaatttattttcaacagatattgtgaaagatacaatcagtactgcaaacccactcatgaagaaggcaattttgccctgaaacgttgcattactttaaggtgggaagtggaagaaacaattcttacaaatgggcatttttgtcatttcttatataaaaacaaacccaaagcttagcatttatttttattgatgtagtgaatgctggtcagcagcaaaaaaagaatttctcctcaaaagtgtaatgacctaatctattatctaaaactagtctaatctctaatggtgggaagcagatcagtggttgcctggagatggtggggattgagtaggaaggctcccaaaagaatctttttagaatcataggaatagtctatagggaggtagtgatggtggctacatatgcataaacatttaccaaaactcatcagactatacactgaaaatgggtgcatcttattgtatataaagcataatctcagtaaacttgatttttaaatttatatattgtcctcctggagttcttcaggggatagcatgttagggagaactaagagaaaaggatgcctttcccaccaagcatctctaggaaaggagtgaggaggtgattgccagggagggaagaccccatcgaccattcaggggggcagaaaaggaaaactggattccctaccttactctgccccaaggacttgaagatgctctgcaatgtcatgtttggggatgagatgggtaagaggaattcactgccaaatacctcagtatatagaatacccttttatatagaataagttcctggtcaagagtgatgttaattgtgtctgtgtgagtgggattgaccagagagcaaggcgtcttagtagccagcttgcaggaaaggttttacagggtcctgtctttaggtgtgtctatagccactgacctgaggaggtctgaggggggctctctgaactatgctggactcaggttcacatcaaggtgctcctatttccagaggctataggaacaggaagagattgggctgctcctccccagttgtgctaaaaatttccaaatgggaaaatcacctggagaactcactggcacgtgccagctgatgggcatcctcctctgccccatccactgaggaactctgttgctccctttacacactcacaaattcacttaaaattataacacaaatatattagtaccagcaatcatggtggtaacatttctttgtgatctgtagttagtggtttcatgcaagtccgtgtgaagagaccaccaaacaggctttgtgtgagcaacaaggctgtttatttcacctgggtgcaggtgggctgagtccgaaaagaaagtcagggaagggagataggggtggggccattttataagatttgggtaggtaaaggaaaattactgtcaaaggggggttgttctctggtgggcaggtgtgggggtcacaaggtgctcagtaggggagcttttgagccaggatgagccaggagaaggaatttcacaagataatgtcatcggttaaggcaggaacaggccattttcacttcttttgtggtggaatgtcatcagttaaggcaggaactggccatctggatgtgtacatgcaggtcacaggatatgatggcttagcttgggctcagaggcctgacaagtgggcactgtgttaaacacgttttacgcatgacctcatatcacccttccaacagccctaggaagtaagagctattatttctattattagcctcattttctagatgaccaaaatggggcttagaagggcaaattacttgcccaagacatcagatagagagcaggtgtcagagcagagtcattaatggaggcaccaaactctactgctgatcatctgactctatgcccaatggccaaaaggtgaaagatcttaatgctttcaactatgctcactttagagagggggccagggatgggcttcctatctggagagtaagggccagcctttgatggttacccatgccttagagtggccaaagccacaagaactgaacccagatcttggagaagggtgaaagtggttctccccagggcataattttctatcatttggatgaagggaaaaggaaattcatcctagggcattttaaggataagggaatgaggctcagtgatatgactcaagaaatatcccagaactaagcaaagaggtcactgaaatccaggtgtcctgtggttttcttcccttcactcaagatgcctgataatgctgcttaattcaccacattagctccataaataaaggggaaaactgctttttaaaatacctctatgacagcacttctcaaaatgtggtacaggaactcctgcactgaatttccaaggcacttgtgaaaacacaggtttctaagctcacatcagattcactgcaccagaatctctgggagtaggactgcatagtcagtactgtcaatatacaataatcagaaggctcaggatccagttaaaagagtttattcaacaaaaagttgagggcagcagtcccaggagtagagctgcacccaagaatggtgaacagtacttccagtgtagagaaaaatgaggactgtttacataggcaaagacagaggtgttcaacagaatgacaacttctcttgttgttgttgtttttgttgttgctgttgttgtttttgagacagagtctcactctgtcacccaggctggagtgcagtggcccgatcatggctcactgcagcctcagactcctgggctcaagggattctcccacccagcctcccaagtagctgggactataggagcacgccactatgcctggttaatttttttgtattttagtagcaatggggttttgccatgttggtcaggttggtcttgaactcctgaccttaagtgatgcacccaccttggcctcccaaagtgctgagattacaggcgtgagcctccgtgcctggccaacattttccatacagaggctaacatacagatatacaatttgattggctactattgattacagtccaagggaattgcttaatattcttttgtaaagaggtaacatggctggccgcagtggctcacacccataagcccaacactttgggaggccgaggagggcagatgcttgagctcaggagttggagaccagcctgggcaacatagtgagaccccgtctgtactaaaaatacaaaaatcagccaggcgtggtggcacgtgcctatagtctcattgactggagaggctgagatgggaggatcgcttgagcctgggaggcagaggttgcagtaagctgagatcgtgctactgcactccagcctggatgacagagtgagatcctgtctcaaaaaaaaaaaaaaaaaaaaaaagtaacaatcaaaagggtctctatttccataacatgaggtctacgttttaataaagactaggttgtctgaggccgggcacggtggtgcaaggctataatcccagcactttgggaggccaaggcgggcagatcatgaggtcaggagttcgagaacagcctgaccaacatggtgaaaccccgcctctactaaaaatacaaaaattatccaggcatggtggtgcacgcctgtaatcccagctactcaggaggctgaggcaggagaatcacttgaacccgagaggcagaaattgcagtgagactagggagtctggttaacatgtaacccctcaccacacaggtcaaagagcaacagtcatgcacctgagaaaaaaaacagtcacgttacgtgagtcagttttcagggcttaactttgcctcttgacataacacatttggaagcttctaaaattttattttctttttacagtgcctttttacaactttcaaaccacagttttccaaatctgtctggaacatgttcctggcgtgagtgagctcagttctcacagattctgtttcagtttcccctcaagagggatcttgatagggttccatcagtttcactttcctttcccctttcataaaagcacagacctaacagcaccctgggtggaaacctcttcagcatttgcttggaatcagtaagctaaaaacaaaatcaaccgggaccccagcttttcagaactgcagggaaacagccatcatgaggtaaatagtccctgcttctctgataggaaacagaatttcttatgtacaacttcctgacttatgctatttcagtgtttgcttagagatgaaatatgcatttatctaattcaagcataaatctgccttaccaattcatgcatttttatttctgtagctctttgtgatgtatagagttaggcagccaaaggacacagggaaatgggagctgggagctgggaagggacggggcatattgagagatcctagagagcccatgctcagatgctttcaggtaaaatcgggccagtgaaagctggggcctggagggaagttactggaggttctggttcgtcttttgtttcttatatttagaaagcctaagtcagaggtttgtggttttgttgtgactgtggttatttttaaaccatgcttgcttctcagcaaatgtgtcaataattaattcagcactgcaaaattccaatttatgttgaggtcacttttaccttgaaatgcactttttcataattgggggatatgtctacttgagttgtcctctagcaggtctagtgacctgctaagcctcccacgtgatcaatgaacagggagaaggtgttgcttgcagtctctcaaactgtgttctgcgagtggcctgaatcatatcaacctgagtcttctaatagaatgcaaatttctaggtcctgcattctgaaatcctgattgagtaaaacagaaataaggtccagaaacaaacatatatttaaagaggaccacaagtacttcataggcatactgaatggcttacagaagaaatgtccatctccaaatcctctcttccttaaatgcatacaaggcttcctgcattgtatgtgtgtaaatgtgaaggaggaaaccccaagaggcaggaggggggaggggtgggaagaatgttgaaataaagcaaagcttgtttctgggcacagtggctaagcctgtaatcccagcactttgggaggctgaggcaagaggattgcttgagcccaggggctccagaccagaattggcaacaaagtgagacctacaaaaaaacaaaaataaaataaaaataaagcaaagtttgactgtttaaagggtaatttaagtatgagaaactggtgattggaaatcactgccaaaaagggaagtcttcccagagccttgctgctcacagtgtggtctgaagctgagatcccccgggaggttgtaagaaaggtaacatcccagcttatctgaatccagatctgcattttaaaaagatctccagatgtttgtgtccatatgtacattaaaggttgagaagtccggctctggagagttccttcacttgctttctgaagtgatggactccttggattgggcctgttctgaccaaccaactgagcacaggtctgccagttccttcacgtagtcagttggagcataaccagcacatgctggggacaagctgcacatgtgcagacaagagtggggaaatccccactcttaccacttcaagaaagccactttctgaaaatttcaagattctactctagtaatagctttgactgggaaggagatgtggtatctaccctggagtctgtgggcaagacaggtggtcatgatctgggttaggtgagagactgtaactatgttgattctggggatttcctaaggactagcagcactagctttaactgctttagtaagcgaaatcttatgtctgcaatccgaggtcatgggaaatctctttctggacctgagggaatcctatctccctaaggtcttctactagatgcagatccaggtaggactggcattctactccccaagtttcacctgaacctagctattctgttttttcttctttttcttttattctttttttttttttttttttttttttttttttttttgagacggagttttgctctttcgcccaggctggagtgtagtggcccgatcttggctcactgcaacctccgccttccggtttcaagcaattctgcctcggcttcccgagtagctgggattacaggcgcctgccaccacgcccggctaatttttgtgtttttagtacaggcggggtttcatcatgttggccaggctagtctcgaactcttgacctcatgatccacccgcctcagcctcccaaaatgctgggattacaggtgtgagccaccacgcccggccacctagctgttctttatcaagtgactgtagtcatcatcccacctgcctgcttgtatttatttaaatatctgcattaattactgttaactaacttatttatacatataagaagtattcagagtaactttcaaaaacacatatgagataaattattaagtgaggaaaccttggcaattggagtatttgttttaagagggcaatagtattataatgaaaacctcctgacctgtggctctggggttcatgtttcttcttatcgaggtctcaggccttccagtccaatatattttgctccaaattttacttcaaggagagatcaagtatcaaatacctcatcaaattggagactttagggagtaaggcttaggaaaaatcaagagaatcaagggacccaattttcagtgggttttataatcataaagccacatgagtagttgactatcttcctgaataaattgttccatgttatcattaaatgtctcagcctggccagctctcgcattggtaaagcattggtggggatggaatatccctgagagatccatattcagagctctttcacaagtccagaaatgttcagtgtgcttttctgcttgtccaacactttcttgagcaattgatatcttctgaagctgacacatgacagggtggaagtatgtttcatctcagagggagaatcttgagctataagtgcttaaaatttagtttggtaagatccctggtgcattgatatgtcaaagccttctgccctccaaaaaaaaaaaaaaaagagagagagatagtgtcatcagacttgcaaggtggtttccggtttcgttgaggcaaatacatccaacaatacatccaacatcacctgtcatcctgcaggtccactggatactctctattaattactagagtgttcagctatttttttcaggcacccatatgtacctacaaatctgcagatacattctattgatctgagactcacactttctccttttaaccttcctaattcacacatcagcaaagttaactcatgtttccatgactttattatgatttagtggcataacagatataagcagagttgttcaattatcatcgttataacttacttttggtattcattttttaaataattgctaacttgacttttgacttgtagtccttcatacagggtagttagaatacccaggtaaagccaaattgaaaacccctagggccaggtgtggtggttcacacctgtaatcccaacactttggtatgtcgaggcagaaggattgcttgagaccaggagtttgagaccactctgggcaatatagtgagaccctgtctctgcaaaaaaaggaaggaagggaggaaagaaggaaaatagggagggaggaagggagggagggagggaaggaaggaaggaagggaggaaagaaggaaaatagggagggaggaagagagggagggagggaaagaaggaaggaagaaaggaaggaccctataatagacagggaagatattgacactggaaccctagacagggaccaagaaaaggaaaaggactgtccccaaatcaaagcacacacataaagaggctagccggatgtagatggcaacttccctcctcactcccattgcccttgagttgattctgcatctctcactataaagcatttcatgtgcaatcatattgggccaaaaatggtttagatcagcattactggagagacagacaggaagtataatagatcagtacacttgcagtagcggtgtgagggccagtgctcgtccatggtaaattgcaaataaagtcaatggctccttgtagaacaaaatgcattcaatttaaagaattttgtttattctgagattactttttcagtggcaaggaaaattctttcttttctatcttttaaaataaaatattggtcagaatagatggttggtatcttttcagatacattagcagccctatttggttcataactttttttctgaaattgtgcttgtctgtgaaatccaaaaataaggacacttggtttaatgatttctggaggttctttccaatcttatggtgccgtgactccactggtaagaaggaagaagcacaaactcaagagtgagggacatacagcccaagccccaggcaaatgtagataatgggaacacacttagagaactcttgcaatttatccagctaaataaggcaagtgatctcctttagtatcttccaactacaaaacaaaaatgagtccattttgtttgtttgttgcaacaaattcattctgtctgggaatctggcctgtgtggtggggagactacttcagtcagactcaagctgagcctccgtgggtctgtttgtaagtggtggaaaagatgaagggaaaaatacctaaatcacataacatgttggcagacatatctgggcttttatttctttacatgtctcctaacaaaactgaaagcacctggcgggcagagaaggttgggataatctctatttttcttagtatccataatatctaataaagtgacaaaaagaggtaccccaataaagagtcatgggatagctaaacaaaccttacccagaatgtacaaggaatgagaactgacttggtattttttaatttttattcttacttttattttttttgaggcagggtcccactctatcaccctggctggagtgtaatggtgtgatctcagctcactacaacttttgcctcctgggctcaagtgatcctcctgtctcagcctcccgaatggcgaggactacaggcatgtactaccatccctggctaatttttgtatttttagtagaggcaggctttcgccatgttgcccaggctggtcttgaatcctgggctcaggtgatccacccgccttggcctcccaaagtgctaggactacaggcatgagtcaccattcctggctgacttggtaattgagcagcgtgagagagatctcatttcctgtcactgaagctgcctcctcttacccatcttacctcacctcctgcatatctgcttacacggtgtaagggatgtgctttgtgggtgtctgcacagactgtagctaaagaaaagtgaatgtaggaagcaacttacaatttttccaaccttgtgatggtacaaaagtgataattccattcttgtttttcacttaaaatacagtattcaataagttacatgagatactcaacactttagtataaaataggctttgtgttaggtgactttgccccactgtaggctaatgtaagggttctgagcacatttaagctaggctaagctatggtaggttagatgtattaaatgcatctttttatttacaatgttttcaatttatgatgggtttatcaggatataaccccatcataagtcaaggaacatctatatataaagagatttattatgaggaattggctcacctgattatggagactggcaagtcccataatctgttgtctgcaagctggagaccaaggaaagttgatggtgtagtcccagtccaagtctaaaagtctgagaaccaggtaagccaatggtgaaagttctagtccaagtctagtctaagggcagaaaaagaccaatgtcctagctcaagcagtcggtcagagggagaattctcccttcctctgcctttttgttctattaaggccctcaacagaatggataacgcccacccatactggggagagcaatctgctctactcagtccaccaattcacatgttcatgtcttccagaaacaacctcacatacatacccagaaataatgttggaccaaatatctgggcatcctgtggcccagttcaattgacatataaaattaatgatcacagggtgcagtgcttggcagtgtacatcacagtgaccatgtttattttctccacagtgaggtcaccaagaattccctggagaaaatccttccacagctgaaatgccatttcacctggaacttattcaaggaagacagtgtctcaagggatctagaagatagagtgtgtaaccagattgaatttttaaacactgagttcaaagctacaatgtacaacttgttggcctacataaaacacctagatggtaacaacgaggcagccctggaatgcttacggcaagctgaagagttaatccagcaagaacatgctgaccaagcagaaatcagaagtctagtcacttggggaaactacgcctgggtctactatcacttgggcagactctcagatgctcagatttatgtagataaggtgaaacaaacctgcaagaaattttcaaatccatacagtattgagtattctgaacttgactgtgaggaagggtggacacaactgaagtgtggaagaaatgaaagggcgaaggtgtgttttgagaaggctctggaagaaaagcccaacaacccagaattctcctctggactggcaattgcgatgtaccatctggataatcacccagagaaacagttctctactgatgttttgaagcaggccattgagctgagtcctgataaccaatacgtcaaggttctcttgggcctgaaactgcagaagatgaataaagaagctgaaggagagcagtttgttgaagaagccttggaaaagtctccttgccaaacagatgtcctccgcagtgcagccaaattttacagaagaaaaggtgacctagacaaagctattgaactgtttcaacgggtgttggaatccacaccaaacaatggctacctctatcaccagattgggtgctgctacaaggcaaaagtaagacaaatgcagaatacaggagaatctgaagctagtggaaataaagagatgattgaagcactaaagcaatatgctatggactattcgaataaagctcttgagaagggactgaatcctctgaatgcatactccgatctcgctgagttcctggagacggaatgttatcagacaccattcaataaggaagtccctgatgctgaaaagcaacaatcccatcagcgctactgcaaccttcagaaatataatgggaagtctgaagacactgctgtgcaacatggtttagagggtttgtccataagcaaaaaatcaactgacaaggaagagatcaaagaccaaccacagaatgtatctgaaaatctgcttccacaaaatgcaccaaattattggtatcttcaaggattaattcataagcagaatggagatctgctgcaagcagccaaatgttatgagaaggaactgggccgcctgctaagggatgccccttcaggcataggcagtattttcctgtcagcatctgagcttgaggatggtagtgaggaaatgggccagggcgcagtcagctccagtcccagagagctcctctctaactcagagcaactgaactgagacagaggaggaaaacagagcatcagaagcctgcagtggtggttgtgacgggtaggaggataggaagacagggggccccaacctgggattgctgagcagggaagctttgcatgttgctctaaggtacatttttaaagagttgttttttggccgggcgcagtggctcatgcctgtaatcccagcactttgggaggccgaggtgggcggatcacgaggtctggagtttgagaccatcctggctaacacagtgaaatcccgtctctactaaaaatacaaaaaattagccaggcgtggtggctggcacctgtagtcccagctacttgggaggctgaggcaggagaatggcgtgaacctggaaggaagaggttgcagtgagccaagattgcgcccctgcactccagcctgggcaacagagcaagactccatctcaaaaaaaaaaaaaaaaaaaaaaaagagttgttttctcatgttcattatagttcattacagttacatagtccgaaggtcttacaactaatcactggtagcaataaatgcttcaggcccacatgatgctgattagttctcagttttcattcagttcacaatataaccaccattcctgccctccctgccaagggtcataaatggtgactgcctaacaacaaaatttgcagtctcatctcattttcatccagacttctggaactcaaagattaacttttgactaaccctggaatatctcttatctcacttatagcttcaggcatgtatttatatgtattcttgatagcaataccataatcaatgtgtattcctgatagtaatgctacaataaatccaaacatttcaactctgttagaatagaggtaattgtgtggtttgtgtatgggactataacagtaatattaattcccaaaatttctcctactaggaacagtgggtaattgctaagccgtaccatactattctcgacatgttcatttgagcccctcccttagaatgaacaccctccccctgaaggcagcctatccttacattataggaactatgactgtctttccagcctaggagccccaactaagccccatgcccagttagcagctgctgctgtagacagggttgctgtaagcccaggaatatctgggcaaatgcctccctgacagagtgtgagggacatcagtgtgaggctggtcaaaagggcagagatccatccaggtctacagcagtccctttcaaactgccagcatctgacacggtgagctccattttgttcaggttaaagtcagacctggacagcaaaggtctcttaaacacatgggggaatagcctccatggactcttgagattaacttctgcagttcatttttaattcactcatgaatgtaatatctagtcacaaaggtgtaaacagaaaggtaaaagtatataaatgtataagatgatcatttgaacactttccttttaaattccttatcccctaggaattaatgtaatatttgaaataaattctgaaatgattccctagctgatttaacacctggaaacttgcttgtaggttcataagtggcagaaagactgtggccctaaaggagttcatctctcagaatttagaatatagaccctacaccaggaacccataaagagttgccctctggtattcacagacatagtatatgcaccttggaccatttccaaactcaaagatccagacctgctagggattttgggttttgccaaggcattataccgtattaagaggctaacatagtacatcatggtgactatagttaataatgatatgttgcatacgtgaaaattgctgagagagtagattttgtgttctcactacaaaaagaaaggtaagtagctgaggtaatgcatatgttaaataatttgatttagccgttccacaatgtatacatatattaaaacatgctatacaccataaatatatacaatttttacatgtcaactaaatttttactttgtattaaaaaaggctaatggggggtaactgcagctaatgaataaacatccaataggtccagcattcccatgtcaagtgtcctctgcctgtcatcctttatacaataattctaatgaaatgctagatggaatgggacataccactcaagaataccacagatgatcacccttaagatattataagatgggcagagagcacagacttccactcttaactcttgcctggctgatcacaaatcatatcccagcccaggtccagggacctacttgcttccttacaaacgaggagaccctggttctaagacttttgctgagagcagaaataacctcccccatcctcctgctccttaaacaaaagaacctttagggcaattgtctaaaaggaaacaacataccagaaatacaattcctgggttaaa

SEQ ID NO: 11963 - DNA, 29350 bp, Human
  misc_feature (1)...(29350): n = A,T,C or G
taaaagttattgagtctacaattctgtgagacatctcattctgtataggccctgtcactgagttgcagtgtgcctctagatacaaggagtcagtgtgagctgcttcctcccccacaacctgcctccgtatttggtttctgtgctctgtgcagtttactggctgcttcaggattaaacaaagtaaaagcaaccctgaaatgttgcccattaaatagcatctttgagtaggccgtgtggggaggtaataagtgccattagggcattattaggatgagtgtcaaagagttgtgaggaggaagaaacttctggctggaggcttcaggaaggtggcagcatgagctacatcttgaacggtggataaaatttcttaaggtgaagatgggaggaaaggcattacaagaacaggaaagaatatgaatgaggaaatggaggtaggagaagagagccgtgtattggaaatgaaaagcagtcctgtttggctgaagaacaagaactgtatgaggaagcagtgaaagatgaggctggaaagggagtcagggccaggctaaaagggttggcatttaaagttagtcatgggagccatggaatgtttttgagcaactattaaagcaggtggattagtaaaatagggaacacacaaataaatctggcagcattactgtgcatgaaacatggatgaaaagactgggagatcgcttaaaatgcccaggcatgaactgaggtcacatgtgatcacagaataggacaggaatttaagagtgctattttaaaactaattgctttgcgggtggggagggggtggtgcatcaaagggaaaaaagactatgaatttgagttttggaatttaacatatgggaggataataaatagtacagtgaacaaagggaagacaggaagaaggaaatatagtattcgtttcagagatgttgggttgaggcacaagtggaacattctggtggaaatttgctacaggcaattgaaaatagaatagagctcagctgagaggtggagtggcggatgactcacctacattgaggtgagtcagggactttgatctgtcataagcatagtatatgaacctaataacaggctctaaatactagacaaatgtcctaacaaggaagacagagatctaggagtgccttgagaaaaaaggcagcactgcgattattgatctgtataacttgtgtttgttttaccagctgtgaaattctcagaactggcaggtagtattgtcaagggacacattcttgtatagaaacccacaacgctgaatcgtcatatattcctagtctagaatctgagatatacacgaactccacaactaagtagacgaaagcatccctttttttggggggggggatggggggcacataaccctgaaccacggtccaattacaggtacagtactgatgatggcttaagtagttcatggaactagttaaaactaaaaccatggaaatgttacccaggagaggtaaggctgcgtgcctggcaggtgccgcagggaagtaggggaaaggttaaggagaacaccagcctccggagaaagagaagcaaaggtgattgcatagctgccagctggaagccgactctcgtcatagggcatactcgccccactgtgcatcgccggtgcctacctcacccagttccaaggcgggggcgcgccgaggcaggggtggggtcaccaggagaaaagcaagtgggcagaaaagcccgttgggaagagacggctgggaggaggccccggccccagccttactacgtttcccagaattcagtgaggccacgaagacaggctccctgggcgcggacggaagactggccgcatgggatttgtaggtaggatccgcgccccgcccgacggaggcgtccagtggggaggtgtgcagggattggttgggaagcgctcaagccccgcccacagagtgacgtcaggtggcggtattgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtaaggggtatccccgccgccggcatcccagttgccggccaggctggcgagtcttccatgcttcggcacggtgggagttgtagttctttctctgatgtacacatttgcatttccagggtgcgtggtttggctactgaactacaattcccagcgtgccctgggcgctgctcctcgcgcgatttagatctggcgtgcgaaccggactcttgggcaccggccgtgggggcagggaggaacgggtccttgggcctgagagtgtgtcgggacaggggctgaccgggagctgggcgggaaaggaaccattgtcagagttcctttctcggcggcgatctcgcccgatctctccccgaccacgggtggggaagaacggggagttgagcccgtgccgtcactggccgcctttgacaccctggctccaacatggagctcctgggatgccagacgtccggcgggtttggacgggctcttgcgtcacgcggcctgggccttgcgcggtgggcccggggtgacgcagaggcgctggggaagctttccgtctcgcaggtccacctggccaggcgaaggcgtcggaggcggggggaccactttctcccccctaggctgtgctccttcccctaactggcacctgcagaagccctgaacctctagcacctctgcgaccacccgaggcgacctcctgctcacggggggaagaaacgcgttctcctttgtgctgcattctatatgttctctgcagtgagccccagagaggcagggtggtgaggagcttaggttgcagttggctaaaagttgaggttattgtgccctcgctacgaagttgaaacttttcctgggtgggatgagtaggtgcttaactgaacttatggttttctacttattatatggttaagaaaaaggattccaattggaattggaaggcccttctaggagagaccccaataaactcaaatcgagtattaaataacctgggtaatattttatttagaaatttaaacaggagttaaatattggagtattctccgacgttatcacactggaactattagccatcaggtatttttggacacagttgcccctctgccacggctgccactcagaatgatatgcctttgttcacaagaaaagtaaatatggggttatgttgttaaaggttattggaaactggcatttaaaaaagctcaaaaactcgtgatcatgtattaaacatttaataattgaccatagggagggattcttaaaacagcaattttttacattttttaggtgcctctttattttgaatgctctccatgttgatgaaattcattctttatcaagatgtaaaatatgtaatttattgtggcctctggttgctctatgtgaattgaggatacttttttttttttgttaagggaaagagggagtctggctctgtcacccaggctggagtgcggtgtggtgtgatcatagctcactgcaacctcttaactcctgggctcaagcagctctccctcctcagcctcctgtagctaggactacaggcatgtgacaccattcctggctattttttacattttttgtggagacaaggtctatgttggccaggctggtcacgagtccctcgtccccagggatcttcctgcctaagcctcccacaatgctgggacggtgcctggtctgaggatatttcttaccactgtgtttcagcttttcctcatctgaatcaaacatttgaattctttctagaaggtatttattttattctattacccttttgttgatgaaatggaaaagtttgaaagctaaagtttgaaagttataatgatgttagtaatggccctagatcacgcacaaacctttaatcccgtctaaagtttctgggcaagcctccttccctctttgtgcttatagtacctatacaggcctctggtggctgtatgggggattgccttttaaattttgcttcagggctcatttgtgacctttcatcagctttattgctgctaccttttcactattttagtagaaaagatccatttcaccactgaattttagcatatgtaaacaagtggaaaataattctttgattaatttataacacaatacatgctttgaatatctttggaagtgtgtgctagaacttgttaactgtggttacctcagaagtggagctggggaaaggtatgggggtgagatttactttttaaaactttaacttggtcctatgtgaatgttttacttgtttaataaacaatgaataaataatagttgagtagaagagatggaaaattacacaaacttttgcttacttaacaagccacttacctaactagtatttttaaatgacatctaaaagaaatgggattcaaatgaggtctccactatgtaaccaaattgtcattattactttaatgagttttctatttaaactctttattttttttatgttagtggagagttttaggaagctaataaaattgacttcttttatacaggtatgtcatagcacttaatttaaagagaatatttttaagaaagaacaaaaccttgttagtaagccctctagaaataagtactttatgtgcctagagtgccatctctttcgtggtacttaggatcacagtgtgggtgggtgagtttgacctaaatatcaggcattcatacagggttctttttcttgatacatatatatgtgtattttttttctttccctcgaatcttagaaatcattaatactgatgagttaagggagcagagtaagagctgcataggaggaatactcttagaaataggctatgaaaaagaaaaactgtgaattgacttgtgaataaatgttaataaaattaatcagatgacactcatctgttgccattacttcagtcataaaaacgaggaagatagatccagaaatagagtgtgatgtcataggtctttgtttattcctgtcctaagcactccaagaaattttgagattttggcttcattgcttaatctttatgctttactactttggcaccacgcaagcaaatctgaaggccacttgcttgctgtgttaatttaaaaatctgctaaattctctgttttgattttaaaaaagacaactccgttaaaaaaaaaaatccagcccaacagtaacaggcttaaatttggagcattaaaaaaaaaccgttaaggtggtgacgtttgaacatacgaactttgattttactgaaagggaattaggttcagaggttaatcaggtgactcacggtcacttttggggcagaatttgggacttaatttaactcagtgctgaattgtagtttatgacttggcagtccttttattaatacaaaatccctaagtgactgtatatttattcctgaagttaatgaagtttaaagaaagattctagtttttaaaaagaagattttatttttttagtaacagcattggtacttttttttttttgagacagaattttactcttgtccacaggcaggcagtgcaatggtgctatctcggctcactgcagtctgtgccacctgggttcaagtgattctgtgcctcagcctcccaattagctgggattacaagcgcctgccaccagggccagctaatttttgtatttttagtagagactgggtttcgccatgttggccaggctggtctccaactcctgacctcaggtgatctgccggcctcagcctcccaaagtgctgggattataagtgtgagccaccgcacccggccagcattggtacttttaaactcttgcacattgtagaaactttcccttaaaggtagtttatctgataggcttttatactatatcaaataccaaaacttctattttaagccttttttgtcttctctcacttcaagttgtctttaaaactaccctgccttaactccttaattccccttaacataagacatgtgtaacctaaaaacccattcaccagttcatgtttgctaagtccagccattctcattggaaaatatatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctcagtggctcacacctgtaatctcagcactttgggaaggccgagtgggtggatcacgaggtcaggagttcgagaccagcctgaccaacatggtgaaaccctgtctctactaaaaatacacaaaaaatttgtcaggcgtggtggtgtgcgcctgtaatcccagctactcaggaggccgaggcaggagaattgctcgaacccaggaggtggaggttacagtgagccaagattgtgccactgcactgcagccagggcgacagggaggctctgtctcaaaaaaacaaaaaaaacaaaacaaaaaaaagaatgcctcttgttagaggactgatgcgtatagttgatgtatcattggtgctttgaaatacataattaggtgaacttagtttaagaatatttaagtatgttcacttgtgataaaatctctttttataaaatgagtctgtggttttattactggatttctctttaagtaaacttaaaaattccaaagttaaatatttaggtatatggcaataaaataatttacctctttcctcttttacctaataggtggccagcatcgaaatgttcagccttttagtgatgaagatgcatcaattgaaacaatgagccattgcagtggttatagcgatccttccagttttgctgaagatggtatgagttttaaatttaaatttgcaactttagataaaatgtttcaggtggaggaattcttgtagctaaagtatactattattccctgttttttttcttttaaattacgatggctgttttatattatttcttaggaccagaagtccttgatgaggaaggaactcaagaagacctagagtacaagttgaagggattaattgacctaaccctggataagaggtaggcaatactggaaactccattctgtgtgagtctatgcttgatcttagtcaaaagctaagagaaatgattattctgtgtgattctaatcagttaccttacatgtatataatttgtgcagctctcagataatagcaatatatttttcctaaaggttaatttgtttactttggatgtttcttattccgttggactttaatgtgggtagtaacatgccattagaatttagattgagtcagattagtcattattctagcataatagcacatacatagctgtatttgattataatagaaatgaatttgttgaattaaaagttaatcttcaactagaaatgataacgaaaccttgctttaagctgcttgtccactaatgttatgatatgaaaaaatgtcaaagctagattgtttcttttcactatagcttcagaactgaccttaatagaattaaaaagccctgaagatgcaattctagacttttatagttttaaaaaaagtgtaaatttacttaaatatgtaatataggaaaacaatacattaaaactatacttgtacattgaaacgataaaatattatgtaagcatttaaagttgtggctatcaaactaagaaaaatgccatgatataaagcagccttaagtgttttgtgtaataaggtgagtcatagatggaaattaaattatattattgacaaatggttagagcttgatgagaattagatttaaaaaatctatacataggtaaagtttagaaggaaataagattttaaaaagttatttattgtatactccaactggatcttctttctcttacattgggtgttaaatagtgcgaagacaaggcaagcagctcttgaaggtattaaaaatgcactggcttcaaaaatgctgtatgaatttattctggaaaggagaatgactttaactgatagcattgaacgctgcctgaaaaaaggtaatgcccttatttttgagtcacagacgtacaactaataaggagtgtgttatcttcttttcagtaacatttagtaatagcactggaacactggcccactcttaaaattttctaatagtcaaggagtgcaccatcttgttatggctcaaaatgagacttgttagaactttgtttttgtattacgtaaaccaaaaaaaaatagcttgaaactaagaaggattagggtagattgtcatcaaccttttttgtatcagaagaggtgatggtcattctcttgttataccagaaaagcttgaaagtgtgtgtcagacatctagctcattttcccttgcacttatataaaacattgattgtacctgtaaattacatcattttcaggatatcccttggaatacttgaattctagaactttgtaatagaaattctggaattcaaattgttacagtgatagaacttttaagaccaaagagaaatcttaaagataattttatcagaccttaaagtccagtgttagtaggcttactagatttaggaaccaccaaatttaaaaagacttgtgactcggcatggtggttcacatctgtaattgtggcactttgggagaccgaggtgggaggattgctggaagccaggagttggagaccacctgggcaacaaagcgatacttggtttctattataacaaacaaaacaaaacgagatttggtgtctgccaacttattcagccaagtaagaacattatgaaaataattatcctccactatcattattttattagcaaaatattatagcaccaaaaatgtagaaatgcacttttaaaaaattgaatgaactaataagctttatatccttatttttctcattttacctgagagtaaaaattttgttgtaagtgaaacctttgatcaaattcactcttccattgaatagaataaagaaaggcctaggaaaactgaggtgggtctaagctgatatatcttgttattggtatagttgatagcagacccaactttttaaagataacacaatggcgctattaaaggtgttttacattcaaactatatgctataatggttgttggactagatgacctttaaaaattccattttagtttgcgtattttttacatttttaatttatcaggtaataatttaagctcagtatttgccccacacttgtggtgtatacagttctcaagagttaatttatatgtacctttatataaatgtattttttgtaccactgcattccagcttgggcgacagagtgagaccctgtctcaaaaaaaaaaaaaaataaataaagttaataaatgtattttttacggttttaaagagttatttttaatcccgtatttatttttaaaaatgttggtagggaaaccctgaaggtttacctaatggactgtgtacatccgaaatgcttaggagattaattcaagggcaatttgagcactgtttatatgagtacattaaggagtttgaagatagaaattggcttgaaacacatttagttgaactgttaaaataatcccttaagatagatactaatctccattttacagatgaggaattctatttagagaataagagtaactaatcgatgatcatttggctaataagtgggatctaggatttgagtgaggtctgtttctatagtttgagctctttagcctaagtttgtaacttacatcaaagcctggagcatggggtttcaaaaatggtaaatgctattttgtcattgatcaaatttgggaaataactgtcttagtaagttagtctactgaaaagactatcgtgattgcatcttggctgcttttataggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaactgtaagtataagatatttacatttatagatctgtctattcatgacacccagacgtggtgcgcctatagtactgtaccagctactcaagaggctgaggcaagagagaggatcttgtaagtccaggagtttgaggcagcggtgagctataatcatgccactgaactgtagcctgggagacaaagctacacactgtattttaacaacaacaacaaaaaagataattctatatttatggatttgggtagacataggaaactgaaattctgatttgtgaaagtcttctaattttggggtttgagaaagctttcattctctaattgttggatgtttacctcttgcaacacttgactttagattttgggttttgggggttttattttttgtttttggtgcggtaataagtgatacaagtgatcatatggagatgttttactgtgtcacagaaaacagaagacactgaggtggtcttagtggatttggaaaaataacatgtgatcctaagctgtttttttaaacaagtgaatcagtttaagcttgaaacattttaatacttttaatattgattatccaaatccagcttccttgttagtattacttaaggtaagtaataatgttacttaaggtaagtaacattaatctttgtctaagtagcttggtaaaaatttatttcttcttcttatcatcaccacccaatgtaaattggctggaaccccaggcctccactgcagctctgcccacctctaggttctctcgatatggcagccagggtagctaggtgacagactcagccagagcacatcacttttgcatctagttccttggcttaccagccacctggaggctgagaatagtctagctgtttgccctggaggcaaagaaattggagtttggcaacttcatagtaatctctgtgccctccagtagttagtaattctgaaatatttaattagcttttgctacttaactttttcttttcttctttttgggtgaatatgtgcagcttttaaatcatgtggaactattggtataatttcatgctagaatgacagaaaacactctgctgggtagatttttggagcagtcacttaattttgattgtatgtaagtttttttgtcatttaaagacttttttttccatacttccaagttgctgtgaatttttaaaaaccttagcctccccatttagcagatggaatnnnnnnnnnnnnnnnnnnnnctattaggtaaaagaggaaagaggtaaattattttattgccatatacctaaatatttaactttggaatttttaagtttacttaaagagaaatccagtaataaaaccacagactcattttataaaaagagattttatcacaagtgaacatacttaaatattcttaaactaagttcacctaattacgtatttcaaaggaccaatgatacatcaactatacgcatcagtcctctaacaagaggcattcttttttttgttttgttttgttttttttgtttttttgagacagagcctccctgtcgccctggctggagtacagtagcacaatcatggctcactgcagcctccacctcctgggctcaggatatcctcctgcctcagcctcctgagtagctgggactataggcatgtaccaccatgtctggctcgcttttaatattttgtagagatgggtcttgctgtattgcccaggctggccttgagctcctgggctcaagtgatcctcctgctttggtctctcaaaagtgttgagattatgggtgtgagccaccgcacccagccagtcctagttctttaattggctgtttttcttagagtcatcaaaaggaacgatgtagccttgcttctgctgcttgcttagcagtagggattatggattgaaaatttcctttaatgcttaggctacttttagattttaacagtgtccaatttttactaggatgatataatgacaataaaatagtgataccaagcagattaatatcacagatatcctcatagtactggaacagaactggctaaaacctgggcctgataccaatggtgactttaaagacttaaagctttaataatgcttagaacaacatgagggaattttagtgacaaaatgtggagaaaggggaaatggagaataataaaatctcagattacaaattctatttttatatggattaatttgttaaaacaaatgttctgagaattgaaggcttctgtttatgttgcaagtagatggcttgtgtaagtgttgtgttctgagtatgttttattcgataagctttacctttgtaatcatatactatactcacttttgtttagcccttcccctccccaaacaaaaggcaattatatgattcccagcctcttttcagcataatccagaataagtgaaatctgagttaatgggattaattaattaattaggtgggaagtttgaagacaattatttacattttatgaaatttctgctcctgtgtgcttatttcttggaagctgatttcttttagaagttttcatagtagagtcttcataagaacaaaagaatatagttgtaacagcttaaaaaccaatggaattgtaatgtgttttaaaggctttttgatagagggtaggcttctttagctcatatgtctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttgtggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatttttttttttagtgtgcaacttgctttggtgtttgctgttttattgccacagatgacattactgtaagtaaaaaacctttgattctagttatctgcagttatttctaatttaagatggttatcttacttcatattcttatgcattaggaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgtatgtatttttagtttcatattttataaaagcaacatttagtggacataattggttgtattcacatagtaatgactaactattttttaggcatttccataagcttccaagcctcctctcttgtgatgatgtaaacatgagaatagctgctggtgaatctttggcacttctctttgaattggccagaggaatagagagtgtaagtatctaactggcagaggaaaaagcttgtgtcacaaggcccattgttccatcattaccttgcaattgagaattgggcaataactttggaacatggccagcttgagaacccagtgatttatttccctacttcttggcagtggtggtgtaatactttagagagcagaaaccagtaggggttggtacagcagtgtttgactgtggttcattatacttaatttttgctatctatagaactgaagtttagggatcctcatggagagagttttgtctaatataatctttatgaaactgcttggatttctcagatacccaatacatcaagctaatgaaggcatgtgatgcttcataattaatatcaaacaaatgaataaaatattaagtcagcataggtttgggatgagatgggttcagtaacttctctaagccaaagatggaaataaacactgctcattagactgggacatgtgctttgcagttacccattcacttgtccactcacagatgttagttaccatggcttggctctcgaagggatttgagtttgtgatagtttgatcagtcgacccaatttgctttgtacctgtttttggtttagcacttaccatcttatgttccaggaaatcctttatctcgggcaaactgggtcatttggtaaccctaatttgtcatctctattttaaggattgctaagagaaaggaatgcctcaaatcttaccattggaagggagaatgtattcttaagatatgtgattcagatactgtgctgatatttagaaatgaggagcaggtttgactgtcttcacactgaatctgtgaaggatccaataagaaaactcaaatatatgggaaatgggtaactaaatagtagatattattgccaaccttgaattacttactagatgctttttaatttaaggagaaagaatatattttcattctgaaacttttttgcatttaaagaagttatttaacagtgaacggttccaaacaggattaatacagttctgccatgtatagtcattcatattccattctaggcctgtattgaaggaagtttacagtcttaaaatttttatgtgtaaagtggctctctccaactcccctacactccttttgtttgagggatagtaggtaggaatggaaagtaagttaatgttgtcagtagctaataattctccttatgtgagaaattggactcaaatttagcaatcaatttaattttattgagctagttaatagcttcttaacctcaacgcatggaaaccagatgtcccaatttttaatcttacattcctctactggccagaaatggcagtttcttttcttttttttccttggaaatgcatttttaaaatgaagtcataatgcagtttaaattatacatgttgaatttgtttaagtttgtataaacatatatatagacacatacatacatgtatatacatatacatatatatacacatttatatacacacacacacacacacacacacacacacaccccacgtatcttttctccaacttaataaattacacaggataaccaggagaactcatccagacatatttcatttgacttgaatttttatccaaggacaaaaatgaactgggttacaaaacagaacctagtgtttttatttgctttttttttttttttttaaaataagctttttatatgtgggtgctggttgggggatagttatagggtgttcaaaaattaaatccagggcgttagtgaaatacatagacagatttaaaatagggttcatacagcaaatgagttttgaattattcaaggctttttgctaactgactttctgatgttactaactttgaaatctagtgatgtcatgaattctgcctgagagacttagaaaaaaaacttttgaagagctaacttttaggttggattttaatgaatgagttggttaaataataataataaactgtgttcaaagttgaaattagtaattattactcctttatgagagttctaggttaatggatgtttgccatataaccaattagataatagtagactctggagctgttctgcctaccttcagatctctttctctcttactagttggataatattgggcaacttctctatgcctcggtgtccttatcattaaaatggataaattattagtcacaacctcatagagtttttgagaacacatgataggtacagtgtaagtgttagctgttacttggaatgttggttgaattgagtattgcatttggcagtagtctactagtggccttttaggaactgtagagtaacttaatataagagacattatttggtgggcagaattaagatcttgggagccattgctggtgcaatcctcacttgggaaaatttaacaaaatatagttagaccttttccaggtctcacccattccattccccagctgagcggacaggggaagtgctacagcacagcgagaaaaaagataatcaaagaccaaatatactccttggagccaaatctgaaatcacctagattttatacttcagaagcagcaacttagcattcttcttgtttttttgcccttgtttgtataataactgactctgtgtaaaaatatctccataccttgacaaagatattctgccttgattagcaggaattgaaataaataagtctttttaaagacagggtctcactctgttgcccaggctggagtgcagtggcaagatcatacctcactgcagcctcagagttctggcctcaagcaatcctccctcctccttccaaagtgttgggattatagatacagagccactgtgtctggcctcaagttttattttaatattaggcttttgtatgatttttatttcttaatacttagctatccaagacccagcttattttgtttataatgagtgttccagtgacttctgtatagaaataatagcttggggaatggttagcttttgtgaccttaagcatctcaccctgtctgcctaaacttttctggaaattttctttggtttcatttcatcctaattccattcaacttttgaaaccatttaattggtaactgttattttgctatgaaataattatcttcagctgaccagtttgttgtatttatattgtgttagattctgttgtatttatattgtgttaggttcaaacaggctgttcataacagtaagatctataacttaatggatgtttatgtcctgtgttttatatatttctaatagttcatttccctataaaaaacctaggagatgtgggtggtaataactgttatataagaggagcctgagacagattgctaatgtagtgctgcctgaggttgtatagatctacatggtggatgcttgtgattcaaacctagatgttctgactgcaaaacctatgtcttaaatatggtattaaactgcctcgtatggttgtgatggctacacagattttttttaaaaaggtgagttctatatacctccaagtctagaatattgataaaatagttaatgcttcagaatttattggggaatttattgtctttttaatgcttacaaccattgtttgaaaggttgggtattttcttttttttcagatgataaaatagatttataatttataaaacttggtatggagagcagtagattgatgattctgatctaggacttttgaccctgttgtgtagtaatgactgctggttttttttattattataagagtatattaagatatttatttctctgggagctcatttcttatttgtcccagagtggtacagctctattatataattatcgtaaagtcctattaataggcttttggaagctgtttatggacttttttattacgtgttacattttattttcttccttcctttttttgtgtttttaatgcccaagtatatagagtcttttttctaaactacttagcatttaatttttcaagttttaataggatattgaacttggtgattcacaaactaaacttgattgggttttatccattgctaagattatattaccgtgaagtttttcaatctcagcacgcactgttgatattttgggctggattatattttgtcattgtaggggtgggggctgtcttgtgcattgaaagatactttgcagcatccttggcttctccccactaggtgccgatagcacccccttctcctagttgtgacaaccaaaaatgtctcagacatagtcagatgttcaatgggaggtaagatcatccccagttgataatcactggcagtgattctcacttcttagaacaaattaaaataatgtatagaattttcttaaattttgatttattcttctatacaaattaaaaaaccctttacatatacatatatacacacatatatatgtttaaaatactgtaaaagaacaagtagccaataaaatgagtaggagactgctagtccctgaaatgtacttgttttttataaataaaattattcccatcttgttatgatgcaatctgattctttggaatttaaacacagtttggtctattttaatacccactttgcatcttattaatgggtgttgtctctaacttagatataggaggttgaattggaacatttgaagaaaacatttgttggaatagttaagaatatgtaattggaaatatgacaagaagatatttatgtacttaaaagctagaatatctgtcacattaatttcaagcttattttccaccagtgtaataatccttttcattttagacattaaaagaaaccaagaaggcctagaagagctgttatattaatataataagttaaatgattcttaacctctaatgcaataaatgttaaacatgtatgaataaactagaactggagattgcccatctcctggcttcttagtaagaagtgtctgttctagttttgatcagctaaataagtttgactcattttttagtttttagtgtggttgtaaaatggagttaggaaataaaaacacctcaaataaagagacttcttaaatgcatagccacgttaactgtgacaaggaagcccataatctgcttaaggtcacagcaaatttcaatacattttgcagctgtcccccaaaagggattaaaacttgttcttaccttaaataatttaatcacctgaattatgtgctttattgcttatttgaaatatggcagtaaattagaaagtagatgctttaattgtagctttatgcctttgggataagaataattggaagtctgtgaatgtttggtttggggactggggagccaagggtagaagctatattggtatatctgtctctcactgaactttgaaatcccagtaatgtcttatatatggtgggaacacaagaaatatttgttggatgcatttacttggaagggaaatgttaattgttttgctgtagtacatcatcttgtagtcagcatttctgggttcgatttttgcatgaaaacatgtgtttatgtgtgcctagtccctaaataccatgaagatttacattgccttatgcaactggatattttccaaatgtagactgttctttgttagctctatatgaggtcagaaaagaaaaataataataaaggaaacaaaattgcttttcttgtccaggactttttttatgaagacatggagtccttgacgcagatgcttagggccttggcaacagatggaaataaacaccgggccaaagtggacaagagaaagcagcggtcagttttcagagatgtcctgagggcagtggaggtaggcttcttaaatgctgtaatagcttctcattttgaaattggattgtttcaggctgaacttgacaattgtaccattttgttgattgaatttcacctttgaaaataatttctcattttacgacctagcaggtttttaacaatataagtgaagactttttttttttcaaaacaaaagaaaattaatgctggtgtataaagatactttattttagttttttttcttttaaataaaaagacccatagtgatagaaatgtatttgaccttggtgtatttgtcatcatttaaaccatggtgcttagcatatacattcttagtgtacagtgttttttgtgaatttaataagttattgcctaccccttagactccaacccagcttgattgtcatttatttatttatttgagatggagtctcgctgtgttgcccagactggagtgcagtggcacgatcttggctcactgcaacctccgcctcccgggttcaagtaattctttgcctcagcctcctgagtagctgggattacaggtgcccaccaccatatccggctaattttttgtatttttagtagagacagggtttcaccatcttggccaggctggtcttgaactcctgaccttgtgatccacccgcatcggccttccaaagtgctgggattacaggcgtgagccaccgtgccagagatcttcatgatctttctaggaaagctggaggctaaaaaccgaaataacaaaacccagcattttaacaaggccacttaaaatcattatctgatgcttgaatttcttctgtaatcctcaaacctgtttcaatctatatggcaaataaattggtttagaatgcatggctaaaatgaactataggacaaaagatatctcactggagaaaactgaaaactttaataattgttttttggtaggccaggtaaatattttttggtaggccaggtaaattgtttttggtaggccaggtaaatatttcttggatttgaagggtgtgtttcttagattattgctatctgatacagcagttattttaagaatatcatcaaaatgtcattcaacttgatgtgtgtgtgaaaatttaaaatgagaatttaaactggagatggtgagaccccaccccagatccagttttaatatgttccagtgaattcttatatataccctactttcctaattttaatctatttttagaaaagtaaaatctaggatacaaattagatcctttgggatctaaatacttttggttaatgctgactcttatcacattatagtaggattttatatttactctggattttatagtctaaaaaacaaaaaaacccctaactcgagcaaatatcaatattaagaattaaaaattagtcttataattagtgtggcagtatctctaaagtaagccattttctttaagtaactataaactattcctatatttgatttttttttgagttactgtagtctccaaagatatgatgacatgtcctagattttctggatggacctgatttcaagttttctgccctcatgcatcccctttgagtagtagattgtaagggtctctactggccctcaaaccgggccagccatagcactcagtactgattattcagaggaagacacaagtgacgtttcagcttacaccagtattaacagccctttgttgtgtattcctcaggcactgttaaatggaaaccattcctatcccatagtgatctacccgcccaccttcttttcttcatctcaggatctcccttgtccctccagcctctgcttcaatgcacctgcctgagaaaggcctgtcctcagggctttgctgagagttgtttctcttttttttttttcactggaacctagctttttctggagcacccagcttctcggatgggtctttaaatgaaggttgctcaactgccacaaaggatatgtaaacatcttagttgtggtagtggctgccacaccatttctttttatttaaaacatttcttgaggctcatggattcctcaaatcagcaagcacttaatgttttaggtgttttgccatacagttttcttatctcattatacctcttaagcaatagaatagtctccttctaaaggagaaatgggaaccaaaggaatacagaatagttaagtagcagagctgaaatttgaacccactgttctgtgctctttgagcatggccaaatcctatatacagataggtcaagtgagaaagtaacgtttcacttaggtccgtcgattaggtccttggtgacctttataagagcagcttcagtggagtgatgagggaaaagccagactgaagtggattgaaaagtgagaagtgattaagtgaaggtggtatgccttgactattttaaaaaccttggctgtgatgggaaggggaagagagttgatagctggaatgtagtgccagattgcgggaaggtttgttgttttgttttgttctagatactagagacaatttatggagaaggaacctgtggagaaaggagcatctgaaaatgtagtctgttcttaatatccatgaggcattggttccaggatccccctcagataccaaaatttgagtattcaagtccctgatataaaatggcatagtatttgcatataacctatgcacgtatactttaaatcatctgtagattacttataatacctaatacaatgtaagtgctatgtaaatagttgttatactttattgtttagggaatagtggaaagaaagaatagtctatacatgttcagtatagttgcaatttttttctgaatattttcagtccatggttggttgaatccgtgatgcagaaccaaccagatatggaggattgactatatatgtaaaagattgagattaaccttgaattgtggagggacagaggtttgtctgttaccaacaggaaagaggataataggtaaggatgctgatgactttatagagggttggtgggaaacagttctttcttggtgccttaatgttttctgaattaaagaagattgaaataagataactctactgttatttatttatttatttttgagctgctgttacgcaccagacggtcactgtgtttgcctcacatgcatgtcctcttttacacctctaataaccctcatgcagtataggtaaagatggccccattttacgggcaagggaacagactcagcaaggttaagttacttgatgaaatcacaagcccgcaagttgcatgtctgtattaagtctagggttgacggtcttttctattacattatatactttgtctgctgagtgagaaggggctgaggtagatgtctggaaggcaggtggagtggttttgtcattcaagttccatctcctttctcctctccctgtggcagtcagctcctcccttcctggttactctgacatactcatgatttaccaaagaattaagtagccagttttcttcttaacaagttctgccactattccagctgactttttttttaatccatctgacttctgtttctgtgtcatttgggctgcactcccatggttacaccttcgaaatggtcttctgacagaattgtttcatcactaaaatcttagattctagtgttacttcttattttcttagaaacctagcctgagacctcttggagcccttctggttgctggacctttcctttttgcttggtcagttaaccctatttaccctcacttccttccctggatccctactgcccatcatttcaccccctgcttgtggtgccattttgttttcctgactgttctgcaactttcttccctctcccatcctaggccattaaaaacacctgactttttttaagtttgttgagagctgttgaaatttaaaggtattctcaacaatgtggtttttgccttaattgttactgaaactcagttgtgccttcaagtttatcaaaactagaccaattctacacccttacatacaggatagcaacagtttgtccacatctcaggtatggcagtatcagtttaagccatattgttcatttatctcagcatgtatatgactgtttagaaattgtgtttacataagatccctctgagccattttagtgcctgtggtaattttggttcttccattggttaggaacgggattttccaacagaaaccattaaatttggtcctgaacgcatgtatattgattgctgggtaaaaaaacacacctatgacacctttaaggaggttcttggatcagggatgcagtaccacttgcaggtaagtgtcatcctttctacatatttgcttttaaagtagggagcagtcttgaatatagctcacttaattggcttttgaaattaattaggtatccagagtgcttccacatgttagaaaacagtaaacttgtttttgaaagtagacttgaataaatctgaagctgttcctttttttttctttgtattgttaaagttgggtggacggttactgatgtctgtatgaaagcaaatagcttgacatagctgtcttggattcaaggcattgaaaacaatttgctttctattgagaaacagaaaataagtgatctaagtttatctgtgggttccacataacttctgttaatcagagtcactctgtctagtgaaaaagagctataatgtttaatactgagccataccacctttttctttcacataagtcaaatgaattccttcgaaatgtatttgaacttggacccccagtgatgcttgatgctgcaacgcttaaaacgatgaagatttctcgtttcgaaagggtaggttttgtttttatttttaataaaactaagtgcgccaaagctttgattctgtctagtgtcagcaacttagctgtgtctacctatatgtggagttttagtttttcatgatgcttcacatagaatagctgtactaaagatacagaaagcatttagagtgtggggggcgtgtgtgtgtgtgtgtgtgtgtgtgtgtgtgtgtgtgtatatatgtgtcagcctgggtgacacgagtgggaccttgtctcaaaagcaaaacagagaaaagaatattgctgcttgtttgcccattaggtgtatttctttcattttatgaaacatattttgacaacacgttaaaatttaatatgtacatatatattttacgtataattctatcttaatataggaacggtgttcattatttgtttctttttattctttggagtttttatgtttaagaataagtatttacatagtccttttgtatcagataatagcctgctaagtgaagtaccagactcgttttacaaatgaggaaacttaagagagttaaatagtaattaatatcatttttacttaacatttctttttttttttttgagatggaatcttgctctgtcactcagactggagtgcagtggtgcaatctcggctcactgcaacctctgcctcccaggttcaagtgattatcctgcctcagcctcctgaatagctgagattacaggtgtgcattaccacacctggctagtttttgtatttttagtagagacagggttttgccatgttggccaggctagtctcgaactcctgacctcaggtgatccacccactttggcctcccaaagtgctgggattacaggcatgagccaccatgaccagcctgcatttcaaaaatccttaatttatgtatttttttttgtgctgagatgaaattcatataacagactattttaaagtatacagttcagtggcacttattacattcatgatgttgtacaactctagttccaaaacattatcacctcaaaagaaaaccttctgttcattagcagtcacttcccttgtgctaccccccgccactggcaaccgctaatctgctgtctctggatttactttttctggagatttcatacaaatggagttatatagcatgcaaccttttgtgtctggcttttttcatttagcataatgctttggaggttcattcatgttgtagcatgaattcagagagctttattcttttttgtggcagaataatattccattgtatggatatatatcacattttgtttatccattttaacagttgatggacatttgggctgtttgcatcttttggccgttgtgaatagtgttgctctgaacattcacatacaaaattttttttgaaaggctctttgcaattttgggaggtattacctaggagtggaattgtgctgggtcagatgatagttttacatttaactttctcagaaaccaccaaactcttttccatagctgctgcaccagtttacattctcatcagcaatgtagaaagaaaggttccagtttctccacatcctcactaataattattttaattatagccattctggtgggtgtgaagtgtttaattacattttatagaacctggatattttatcagttttatatccacataattgtttcttgtacggcattttaagttttttttaagaaacattaatatttttacatacttctctcttttgaataatttttttgaagaaatcccctgcataatgtattgccaaattactttccaaagttactcttatattggagacgatatttaaattgtctccagcaatgaatgaaggcatgtagctgttacacaaagatttgacaccattgagttttataatttaaaaaatgtgtttatttaattgatattaaaatggcacttcatcacttttttccttgttctaattgacagccaagtaggactattttctgcattagtcatgatttgtcttttcttggatgaaacaatgttgatgtccatttttcactgttggtttttgaaatcgtctaactttcttggcgttttacaatttgattagtacttttcttaatatggaatagccattaactctttatttatttatttttttttgagacggagtctcgttctgttgcccaggctggagtgcagtggcgtgatctcggctcactgcaacctctgcctctcgggttcaaacgattctcctgcctcagcctcccgagtagctgggactacaggcatgtgccaccatgcctggctaattttttgtatttttagtagagacgggatttcaccgtgttagccaggatggtctcaatctcctgacctcgtgattcgcccacctcggcctcccagagtgctgggattacaggtgtgagccaccttgcatggcccctgttaactctttgtttttctccttcattctttgtgtgtgttttataaacatttaaatgtttatagggtcaaattagttcatttcttttctttgtgacttttaccctttttctgttttgtaagaatatcttaagtcttactgatgcacgtttttcctttttttcattttagcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgcttataatttaatgtacaatactattgaaactggtgagttctgattattaaatattctctgtaaatcagtaaacatgtataaagtatttgtaatgtttggtcataatttatttatgaagacagcaaaagactgatttcatgatggggaaaacaattagccaaagtttaatttcttacactgtggttgtcaagaatactgatttactataatgatatatacatgcaagatatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagcccctgtctctaccagaaatttaaaaaatgagtgtggtggtgtgtgcttctactctttatctacttgggtgctgaggcaagagggtaacttgagcccaggaggtcaaagctgcagtgagccgcgattgtgccactccagcctgggtgacgagtgagaccttgtctcaaaagcaaaacaaaaaagaatattgctgcttgtttgcccatgagatatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatcccaataactcttggaagtctggtgctccctctaggtgaaaatcatttgctggcttatggagtcactgttgctgagtcccatcccccagttacagtgcagtggaaaacaggtttagaatctagaacttgtttgtatgttgtcacttggttatgttccaagtaggttagaaccatggaaaagagattgcaaatggtagtttcttctagatattcaaatgcatatatgtatgtacatgtaattataaataaataatgaatttttattaaagtgttgtatgaacataggtttttgtttgtttttgagacagtctccctctgttgcgcaggctggggtgcagtagcgcaatcttggctcactgtaacctctgccttcagggtccaaatgattctcctgcctcagcctcctgagttgctgggattacaggtgtgttccaccacacctggctaatttatatttttagttgtgatggggtttcaccatgttggccaggctggtcttgaactcctgacctcaagtgatctgcccgccttggtctcccaaagtgttgggattacaggcatgagccaccgtgcccagcctgaacatagtttaatggtacttcaaggctaataaggaaagccccttgctccatcctttcctattcctcagtcccatcccaagagacattcagccttcagttttttctagctcggttctttcagccttcagtttttggttttaggtttctaaataatatgattatacagccatttattttttaggtgtttgtcaacttactattaagacaggtgaaaatttcttttattgt

SEQ ID NO: 11964 - DNA, 18228 bp, Human
aagaatgggtgggaattagcgggggcctgagagggaacctaggagatggatctttgctccaaatgccactccagggctcttctcaatttgggcaggattgggcaaggctgggggaatagggatcaataggattttacagagggtcaagccaggcccaacactagcccaagtagcaacactgggtgaattaaaaaagcatcccttccttaaaattcttttttttttttttttgagacagagtcttgctctgtcacctggactggagtgcagtggtatgatcttggatcactgtaacctcctcctcctggggttcaagcgattcttctgcctcagcctcccaagtagctgggattacaggcatgcgccaccacgcccggctaatttttgtatttttagtagagatggggtttcaccgtgttggccagactggtctcaaactcctgacctcaggtgatctgcccaccttggcctcccaaagtgctaggattacaggcatgagccactacgcctggccttcttttttctctttctttctttttttttttgagatggagtctcgctctgtcgcccaggttggagtgcagtggcgcaatctcagctcactgcaagctccacctcccgggatcatgccattctcctgcctcagcctccctagtagctgggactacaggcacccgccaccacgcccggctaactttttgtatttttagtagagagggggtttcaccgtgctagccaggatggtctcgatttcctgacctcgtgatctgcccgcctcggcctcccaaagtgctgggattacaggcgtgagccaccgcgcccggccttctttctttctttcttttttagacagagtttccttctttcacctaggctggtgtgcagtggtacaattctagctcactgcagcctccaactcctgggctcaagtgatcctcttgcctcaggctcccgagtacctgggaccacaggtgaacgccaccacacctggctaattttaaaatttttttgtagagacaaggtctcactacgttgcccagactggtcttgaactcctgggctcaagtgatcctcccgcctcagcctccaaaagtgctgacattacaggtgtgagtcactgctgcaggcccctcaaatccttcactgccatctgggaaatgatcacaacagctctacaaatacacaatgattacaaggaatggtgccccactggagttgttcaacgcaaaacttgcacattgcaagtggcaatctcccaggcctgcctccctccacgagtgggtctgaatgggcctgagaggcaaacatccaagaaggaggaagaggctcggcggcacctccctccccgggagttctgctgattccatcttggggaagcagggtggaccagggcccaaatgcgccctggggagattgcgggggcgggagaggttgcaaggggcaagtggcaagagcctgttaacgtcttagggcctccaggcctttctgtgcccctagctgtgcctgtacgctttaccccacctcaggaggcttggtctccagcggttgaggctggaagcaccggggtgcggtggaaagggctctgtccaggaagaccggatccgcagagccgggagtccgggctaggaagtccctttctcggtgggagactgaggccgccttggcggggcgggacgagactcctccgaggtcgggaaagggggccccgcagcagccccttggcttcccttctcccttgcctcccctccggggctccggttcagaggcactctgggcgcctgctacagcttccaaactgcgccgcttccttcttcggcagaaaaggactttcagatgcggcggcggcggcggcggcgactcaggacagcgccccctccccctaacggccgcctctccctctccccctcgcccgccccggctcccccacctctgggaaggcgctgggggtgtggccagggaccggtataaagtccgggggagccggtcccgggcagccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctggtaaggtacccctggcctcccaattccctcctgagtgcgctcccttcccagcggcttcttccccattccagccgccctggaaggcccttaaaaatcccctatgagttgaagagaaggcaggtacgtggcagggcccgactggcatgggacaggctcatcaaggaaactgctaccgagtccctagcagcctgttgccaccaccaagggagactgtcccatcgctccatctcaaacctccaagggttgtctgtttgataagggggtcccagtgggaggcctggctgctggtgcaggagtggcagattaaggtccagttaagtcagctgtctagggccagagaactggaggatggtggtggggtgtgtgttggggaggatgagggagtggggaaagctttctgttcctgatccaggccgagggtgaaatcccagtggtctggggagccagggcctgaactttttttttacatggtccagtggtggagtgggacatacaaattagagggactttggcgttgaggggcattagacttgcccttccccaaagcccagagccaggtcaccttgttgtttgagaggcagtgggaagacaggggtccctctgccaggcctggacacctctgcctgccctggtatacaggccccctgttcttttctccaggcaggtaggatttgaggtggtagaaaagtcttggctcctagccgagagctgcaggagcctcatgtgtgtgggatagggaatagagaaggggccagggcgccaggggagagaaacagagagagagagagagagagagagaaacacacacacacacacacacacacacacacacacacacacacacacagagacagagagagagagagagagagagagagagagagagagagagagagagagagagactctgagaaggcccttgccctaacctcattcttacactttctttttttgtttctcagtttctccttagactctcagtctcttttccttctttctcttgctcttttgttcttcctgatttgtctctcaacctctagtttcactagtcatgctctcgagttctgttttcctcagtgtcttctgcccatcgtgcgtttctttctccaccttattctgtgtttctgtttcagttgctctgcttctctccctctctttctgttgctgtttctctgtgtctctgtcactgttggtctttccctgttactttgggaatctctctgtctgtctttctgtatctatgcctctgtttctcattccatctccgaccctgttttgctctcctgtgcctctgtctgtctctgtctcttttcctggtgcttgaagcttccattgttgcagtccggatgctgggactccagccccaagcttcctgtcctgggacccaaaccctccacttcctcaatcctctgcagcttgtcagccgaggagagcaggatgcagggaaaacaggaaggaggtggactccaggggtctgggcctcgggcctctctgcccttcctgcccctgggtagggagagatgggtcagcagaaaacattctaggagaaatgccagcctggcacccagcatatctgggaaggggggtcctgggggagaaagtcgctaatcttggggcagagatgccagtggcaatggtagaggaggggtactgagactgggagggagcaagggccgagcccttgggttcgcggggtacaacagagtcacgttccctttgaatctccatcctccaccagccagagggtatctggcaccagataaggatggctggtagcctcctcctctctcagcactttgaatgcaagacagaagagccctcaaagggctgggtaggaatacctcatcctctggttgggtaggaatactccatcctgtagtggaggaaaataagatcccctaggggtttggggagggcatggcatgagaattttgtggttgtcctctggatataatgcaaactggcctccaggaatatctaggggctgggtgtggaggttcatgcttgtaatcccagcactttgggaggattgcttgaggccaggagttcgagaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgtaaaaaaaaaaaaaaaaaaagtaggccgggtgcagtggctcacacctgtaatctcagtattttgggaggctgaggagggtgaatcacctgaggtcaggagtttgagaccagcctggtcaacatggtgaaacctcgtctctactaaaaatacaaaaattagctgggcatggtggtgcgtgcctgtagtcccagctacttgggaggctgaggcaggagaatcacttgaacccgggaggtggaggttgcagtgaaccaagattgtgccactgcgctttagcctgggtgacagagcgagactctgtctaaagaaaacaaaacaaataaacaaaaaaaacaaaaaacggtgtcttggaatggggtggctttaggtcccctttggatgacacagccaaggtctgtaatgcccctccccctttcctccttgccttgtcctccagcctccagccatgcaatggatgcaggtatctggagagagacgagggaagcctggaggtacctactgagcaagctatgcccgtgccctcccacacctcctagtcatcatagaagtaatcccttgctgtgacctgggccacatggcaccatgtaaaaggcactctctagagttctgctgcagccctgcagggtctgtgggtgagataagacgaccaagcccctacccacccatctttttagccttacacagtcagtaggccactgtctgctttaggtcccaaggtttgggcccactggcccgcgaatagcttggtcgagggtacctgtctattttttctgccttttccttttggggctgagtgtcagcaggtggctgggggagggtggccacttggcatgcccccttctttggctgctatggtccagctgcctcctgtttgccccaggggcagatctcccctttccgtctccagccacccctgcctgccctcctgtcacagctttccatgtgctggccaggttgtggcttaacaccactgaggccaccagagatgaggcggggcgtgtgcatcaaaagtccacacctctgcatcctggtactgatcctagactcatggaatctgggggagtggacagcggaaagatcagcgtttggacggggagttcctaagctgggctctcagtccctttgggacagggttagggaacaggcaggctgggttaatttttagtcaatgcagcaaattctgcccccctacttcagtactgggaatccagttatgtcatgggaacaagggcattcccagaaattctgtgccttgtggggagggggagggaggagcatggccgcttcccatttttaatttagtactggcaaagctagcagtattggtgcctcgggtatcaggagtctttccacttaaagacagagtgctgcagagctaagtctctcctcctccccttccacccagtctacttcattttcctaatttttaaagtggggagggcaacaggacctgcctcacagggttggggcgtctggcatcgggtaagagctcaataaattgaagtgatgaggaagatggtgatgaagaagctgatgctgggacttagggaagcggtaggacgagggagcaaatttggggcaacattcagaggagttgagaggggtggggtggcctttggtgcattttgctgctgtcaacatgggaagaacaggccaagttgccttatctgttttttattctgaggctggcagcatgacacagctgttgggggtgataccccttgagccagacctcagagaaagggcctggtacccagcaccagcggtcttggcttctccagctagagtctaggggaagagggaaaagacctttctagcaggacaggtgggtgaccctctggatcacagctgaaacttctggtcgggatggctgggcccactcagttcatagcctaggtgtctctcgagggccaggggctggcgttggggagaaattgtgagggtaaaatcaggcaacaggaaagaggaaatcctctggctttcgccacaaactttgcagccggtggtgccaaagccgtgtggcctcttctctggcgccttcccttcctctgctgctggagcaaagaccgaggtttcccctatagtcagatgtcaactggcttagctccaagctgggcgctgtaggaggaccaagcctacttggaagtcccatctcccaaacaagctttttggaggtcagacttttcaggggaataggtctgactccactcctgctcagaggggaacccacaggcattggaatttctccagagggcactaccaggatgagtagcaccaggtggctggaactcttgtgtgagcagggaaatagcaagtatttagccagttttggagatgagaaggttaacgttatcaagagactcaatgctataacccttacccccacaaaaacctggtgcttaggggtggatcctggggtggctcttcagtctgccagttaagcagggttgggcaaggaaaagttacagattacatggaaagtcaacaaaccacggtgcagagaagctgttgaagtcagcgtgccctgccctggctctgtgtctctgaccagggcagggtcagagtgcccaagtgcatgtgggtaaggcacatgtggatgaatgtgtgtctggacacgtgattgtttgtgtacacttgcagttcttgagcctgagcctgtctgtgtgagtaggcaaatacggatttaccctgtgtccccatgagactaaggagggagctactctccctatctggtgggtgctactccgtgtagacatgaactggggataagtaggatggctagtggggaacctaacaagggagaagccaggcagtttgctggcttagcttttcgtaggtaaccctctgatgtgacatggggccataccaacccaagagcataagccatgcctctggactcaccctgtgccccatgcagccctaggcttcagtgagcatacctaatcctccttaatggtaaacatcccaaatatccattaataatcctctgagggttagttatttgtgaactttgactcgtaaaagctcagcactgtggctcacgcctgtaatcctagcactttgggaagtctaggcaggaggatcacttgaggccaggagtttgagaccagcctgggaaacacagtgacaccctgtctcttaaaaaaaaaagaaaaggccgggcgcaatggctcatgcctgtaatcccagcactttgagaggccgaggcaggtggatcacgaggtcaggagatcgagaccatcctggctaacacggtgaaacttcatctctactaaaaatacaaaaaaattagctgggcatggtagcgggcgcctgtagtcccagctacttgggaggctgaggcaggagaatggcgtgaacctgggaggtggagcttgcattgagccgagatcgcgccactgcattccagcctgggcgacagagcgagactccgtctcaaaaaaaaaaaaaaggagagagagagagaaaaagaaactcagcatggaaagcatagttgtggtcatgcttctattccatatctcttgagatttttgaggctgctaccaccctaattctccacacttccagggtgggagctcactacctcctgaaaactcttcctcactccttgaactcctgaaaaaccttcctcactccttgaaccaaagaatattctacccatttactgagaggaatgaatcattgtacaaaatagtgcttgcttttttaaaattttgagacagggtctcacttgttgcacaggctagagtgcagtggtgtgatcactgctcactgcagcctcgacctcctgggttcaggtgatcctcccacctcagcctcccaagtaggtgggactacacctgtgcatcaccacaccaggctaattttttgtagagatagggtttcactatgtttcctaggctggtcttgaactcctgggttcaagcgatccacctatttcggccttccaaagtgttgggattacaggcgtgagccaccccagctggcccctagtactttcttttatggtcattaaaagaaagcaaactcaggaaaaacaaaggctttccaggttggaagggtgccccctggtgttagtgtcctgggctgtggcaaacaagtccaggtgatctccagccctacttaagtaacagggtggggcctttgtccacatctcagctcagcctctgtccttctgacatttggttctaattctttaattcttgaattttttttttgtttttttgtttttgtttttgttttaagagacagggtcttgctctgttacccaggctggagtgcagtggcacaatcatagctcactgtagccttgatgtactggggtcaagcgatcctcctacctcagtcttctaagttaggaccacaggcaggtctgactaatttttttttttttggtagagacagggtcttgctatgttgcccaggctagtcttgaactcctggcctcaagtgatcctcccacctcggcctctcaaagcactgggattacaggcgtgagcacccagcctggttctaattctttgaggtcttccatttcctttttctctccactccccagttccagcttacacccctgaaacacggtgactccatcctcaagccttatggctttgtgcaaggtgggggtgtggagggaggtgatcactggggcagcttaggtttctttggctggaggaattccttgggagggtctcaaaggaagggcctggatcccagatctttctctggttcctaaccgagggctcaggatccatctccttatggtccccttggcacagtcctcgtcttctgaagtttatgtttcttcttttgctgcctaccttggccagggggtcttgctatagtgtcttctctttggttgactcttaggaacttgatgtaggactggagtcccctctggactgtccttcttgggattttaaatgtgcagaaggatggattatatctgtctactctatttatttcttcccttttattcctcttttctaagccagctctccaccgtaacaaaatcttcttccatccttggtgaattttattaataacctttggtgtggaaggttattgataaagactttctggttagattcctccttgcctggtttgcctttatccacatatttctccccacaccccccaaaccaggagaatgaaaagagaaccaacccccccagctttggctaggcagaaaaataccatttgacccagaggcagctctgggatcgctgccacgcatggaggaacctgctaactcctcaggaaaaaaaaaaccctgacgcaaaccagatgtaacctcctgtccggctgccaacatctggaatgctggcaggggctttgcactcaggccggcagcgagctgccaagcctgagcatttcagaggtggctctgatctgcagagaggtcttccaacctctttctccagctcagccctgtattctggttttgactgcttggagggaggagcagtggttacagttctgggactcaagcatggggtttttcttttttaaaaaaatgtattttattttattttatttttttagagacagggtcttgctctgtcacccaggctggagtgcagtggtgtgatcatagctcactgttaacctcgaattcctgggttcaagtgatgctcccgcctcagcctcctgagtagctaggactacaggcacatgccaccatacccggttaatttttaaattttttgtgaagatggggtcttgccatgttgcctaggctggtctcgaactcctggccttaagtaatcttccctcctcagcctcccaaagtgttgggattacaggcatgagccacaatgccccatttggatggagtttttcttgagctcagatagagccttcaggagatcccacagaggggttgaaggtccagcctcatcactcccgtctccagatccctggtgccctggttctgggcaacccctatggactttggatggagtctgaagtctaagaatgggaaacttcgaggtgggggactgaaggaatgtgtgaggctgttcttgtggtcctggggccacacaggttgtgttacacacacactcacacacacactcactcttcctcatgcaggcggatacactaactcccacttctctcccactcagccaatggggagagccttttgggctagagttctcattgctcatggaaactctgattcaggccatttggaagagggcgagcagagtccacagccctggggatcccctggctggctcagccagacaccgaaaaaatcaggagaggcaacagggagaacgatcagatggagaggggaatggtgggagctgaatggaaaggggacaggatccagcagggggtccccctgcctgcctcagacctccctgcagggcccaggggaccctcctgccatctgggcagctgcagctggtgactcatctgagcgctggcctgagtggggtgagggacaagtcaaggacttcaagaggaatattctcctgagagatccaggggagaggggaggaggtagggggctgctcttgtttcttcccgctccccaggccccctgctcttctccagcgccaagccgaagaatccccaggaaggagaacgtgggtgggaggctgggttggtgtgacgctctgacctcttccggtgctgacctctccttatcgctacctgaatacagacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtggtaaggacctccgatgcacaaatgtgcatgtgcatagacacacacacacacacatgccccctgccccccacatgcacgcacccacacacaccatcaccaccagatctggggcgtgttcattcagcacacattctagggtgactactgtgtgcaaggtgcaactagtgtgagtcatcaggacccagagaaagcactcattcccttccttgggattcctttcctgcccatcagttatatacatcggggcagcttaagtgattattaaatactgaaaaacttctataccaattggtaaaaagcagttacccaaagcgccctggggtttcttggccttttttggattccccaccccagaccttctcagtaaccaaagggtaatgctggccatagcagggggcctgggaccctgctccagggtctggctaatttcccttctgaaggtcttacaagttgtcagttggaagttttatctgtcccttctgcatagaaatcaccccctccctggctttctgcataggttcccacagcccctttccccacagtgtcccctcacttcccacccctcctttgaagaagctctttggctcgagaccctttcctccacgtctctaccctcccagtgtgtcctccagacccaggcctctctcttcacctcactgggtcctgcccagcccctggggctcaggcctcctttcggggccttcagttctcacttagctctgaccccaggcctgggcctcctgcctctcttccttctgctgagcaattttgtcttcccctcctccagccccagggctcctgccagagcgagctgcaccgggcgctggagcggctggccgcttcacagagccgcacccacgaggacctctacatcatccccatccccaactgcgaccgcaacggcaacttccaccccaagcaggtgggtctctgtctcccgctggcttggccctggactcagctctggggcatttccggcctctccgcaggatggtcctggatggagatctcaggaaggggaaactcctcaaccccaacccaaccccttggagcctccctaaacctacctcagcgtcagaacctcactcattttggagatgaggagactgtgatccagagaggagtaaaagcgccgggctagtccagagtcatagaacaagttaacagcagatcttgcctccctatccagggcaatttccctcacccctggatttcaccatctgtggtgcagacctagcaaccctgacaacctctggctcccaacactctctcgttcactctactctattcgtatgagtaattcctcctgtcactgagtgaggtttcttctgggaatggagggccaaagtcatgaggagtcagggaggaaactcagcctacccctccctgcaaggcgagtagcaaaaccacctggggtacagcaagagtgaaggtaaaaccagattggacggttggagacaggcactttgggtagaagcagaggaaggagtggggcaggagagaagacacaaaggcagcaacttccctattccttcctgcccttggaagctggggtcctctgacaagcctccaggaggctgggatggtcagcagggttggcctcttccagtctatctctggcccatcagaatgggtggcctgtctgggcagggctctggtgtgcctcctgctgggtgttgcctggggaaccctagcctggagctctttgtcgacgtagacagacccatttccctgctccatgagctatagacaaatccacaatttgagctgccactctgccagcagaagtctagatagaaggacaaaggttgccctgagtctgtgcatcccaggatggcatgaaaagggtatgagtgaagggacagagagggcaccccaaaaccaatgcccagcctatttctaacctttatcctaacacgaattttatccttgtcccaatttaaaaaactttttctcttaatttaaaaaaaacaattaatagctttattttttagagtagttttaggtttacagaaaacttgagcaagagtacagggtttcaatgtactgtcatccaccccagtttcctcattattaacatcttacatttgttgcaattgatgaacgaatattagtatattattattaattagtggtttatattagggttcactttttgtgttgcaaaattctatgcattttcttctcctgattttttttttaaaggcaggatctcagtctcccaggctggagtgcagtgatgcgatcacagctccctgcaacctccacatcctgggctcatgtgatcctcctacctcagtctcctgagtagctgggaccacaggcacacaactatgtcaggctaattttttttttttttgagacagagtttgtctcttgttgccgaggctggagtgcaatggtgggatctcggctcactgcaacctccatctcccgggttcaagcgattctcctgccttagctcccgagtagctgggattacagttgcctgccaccacacccggctaattttttgtatttttaggagagatggggttttgccatgttggccaggctggtctcgaactccggacctaaggtgatccacccacctcggcctcccaaagtgctgggattacaggcttgagccactagcttcttcctctgatttttatcccattgaaagttctgacacttgaactttatccccagaccagttctgatccttaagctatccttcactccaagattaattctcacactgaaatatacatttgcgccccctgaaccttctactatctaattttgacccaaaatttagcttaactttagttattctgaccttgacctctgtctttatcccaattgtgtttttacctgggctttaaccctcacccaactcatccagctcaacttttagtcatatttcctcattcaactgcaactcttaccctggtcctaccttaatcccagcttggatccacctcataactataatcccattcttaaagtcccaacccaatcagaatatgtacccaaaacatctccaacctgaacccagcctttcaaatccagctgtgcctttaaacccgagggctttcttaaggtcctgccttccagaactctctggacctttccttcttgaccatgttctccctgctccagtgagctcagaagacccatgctcaaaaaagagtcaccaccctcagaggccatcttgaagcagcgaccgtctgacttgggggctgggctgggctgggattggggtgggtcacttggggtctcttttcctgcgtcggaactgacccctcatgtccttctcttggcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtccagatgattgtgtttggttgatttattctcagttagacacagggatgcaccaggggtggagagacggggacagattttgggaggtgagtattgtgtggtccccagacctgtctgtatggtaagggactgcagaaggacggccaatccaccttcctcttccctgcaacggaagtttcctagggaactccttggcttcaaagtctgcgctgtctttacttagactcctggtgggcaaacaatggctcctgaaaggggggcatgaccaaggacagccctgtgggggcagagctgtctctgggatcagctggcatgtggggctggggcatttcctagggcatcgggcggactgggcttgcatctggatttgatttattaatttgttggggaggggcagggacactgccctgcatttgaggaaagggggtagatgcttcagcacattccacagctctgactgccgagatctctgactcgggcattgtgctgagattggattctgaggttgggaggggttgactttgctgtagactcagtgccagccacagcttcagagattgtgctcacatggtatgcctggactcttggccatcctccaaatgcccctcccctcccacacctctgtgccttgtgtgtgtgtgtgcacgcatgtgtgtggcagggggtggagggtccgggagcagaagctgatctctcggtgggggcctttttccaggaggttgcaggcagtctggagacgctgcattgagcctgccgcccgctgcgcgggctccctcctatctagctgtgtcctggattctcagccccctccccagctccagaggcgcttccaggcttctgatttcactgggccccaactttgttggcacctgtcccgtctgcatcttgaggctgggtctgcagttctgtctctctagctctgccccagcagcaaagtcctgcagccatctggtctccctgaggcaccacggcggctgccagcagcaggagataaagaacaaagtggtgttgagggttgcttcctcagccccagccactcttcacagagtcccctccttctggagcccaggccaaggcctgtggggatgggaggtggtgcacgctgaagattaagttttaggtttcaagtttagggaaagtatctctttccctaaggcatctttttcaacccccttgtctctagtccccttcccgatgctctaggcttgcacccttggcagtggtggtaggaggtcctttttctttcatgggcctcccaaaaaagccaaattggcttggaagtagctgtgtgcatggcctgggtgtaacttcgtgacatacgtgcatttgtggagtatgtgtgtgtgcatgcatgtgagtatgacgcagtgacacctgaaacgtgagtgtatgggctttttgggggtgtgcatgcctgtttgatgtgtgaagggaaggtgtgccatttgtgtggtgtgtatatgtggtgtgtgcatttgtgtggtgtgcatttgtgtggtgtgtatatgtggcgtgtgcatttgtgtggtgtgtatatgtggcgtgtgcatttgtgtggtgtgcatttgtgtggtgtgtatatgtggcatgtgaacacgtgtgcgatgtgaggagagagggagtgagacattcacggagcacgcctgtctctcctggctgtggatgactggactctcgctcattaggtgatcccacctcagggtttgtggggagatgtctgacactagagaatgaacatgtgctttggggagaggactttcacatcccacagaaacactgccctgtccaggcttcatgcccacaggatcctggagccaggtcctaagtaccaaaaagcaaataaaagcagcttcttgtttgcagctaggccctcccacccttgaaacggtgggaatacccaaatggtctctctagttgccacaggggtgtcagcacctctgggagatgtgggagggaggt

SEQ ID NO: 11965 - DNA, 42975 bp, Human
  misc_feature (1)...(42975): n = A,T,C or G
agtagctgcgattacaggtgcccaccaccacgcccggctaattttttgtatttttagtagacagggtttcaccatgttggccaggctcgtctcaaactcctgacctcaagtgatccaccctcctcagcctcccaaagtgctgggattataggcatgagccactgcacccagccgctatgcccactttctaatgaaaaccatgttggattagttttccagggctccctgctcaagcactgctgcctttgcatgtgtttaggattgttgaataggtcctatgttcacataatactctttcaaatgcctaatctatcaagttagtcagtagttcttagaatgaagttttagaaatggagacctttactaataaaatgacttgtctggtattaatgcaaagtaggctactacttaatattgtgggaaagagaacttcatcaagttgtcatgaatgtatggtatccattccttgagaatattttattttctctatctcattataggactgttatttgctcttgtagtaaataactaaggttgaaataaggttattaagttggatccagaaccaatattttatcattatttcaacatttattcaacatatatatatactctctctatatatgtatattttttgagtgcctatttgtgaaccaggtactgttctaagtgctaaagttacagcagtgaacaggacaaagtcctcatctacattctagagggaaagatacacacatgcacatacacacacacacacaaaataaataataaatactataatttcacttagaagtataattgacagtagtggggtatggctaggaggtgataggaggtgcattttatgtaggatgtcaccaagaaagtgacatttgaggagagactcccagtaatgtaaaggagtgaatcattcagatattcgaggaaagagcactccaggccatgggaacagcaaatgcaaagtccccaaggctgaaatgcacttggtttgtttggctggagtggagagtgcagggtagagagtggcagcgagggaggacagaggttggccaaccagatcacgcaggccatggcaaggaactgagattttattctaagcatgatgaggagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggtttaaatcaaatgtctctgttttcttaaaggctcaaaattattatattccctccaattcctgatcctggcaaaatttttaaaaaaatgtttggataccaaaattattatactctggtaagaacagatttcatggggcttaaaatgtttttttttttttttttttttggaagctatggcattttttaaaaaagtgtggtaaggtatccataacataaaatttattattttaagcatttttaagtatacagttcaggctgggtatggcagctgacgcctgtaatcccaacactttgggaggctgaggcaggaggatcacttgagcccagcagtttgagaccagcctggacagcatgccactgcacccagctaatttttatatttttttgcgagatctcatttccacaaaatatataaaaattagccgggtgcagcggcatgcacctgtggtcccagctactcaggagattgaggtgggaggatcccttgagcccaggagttcaaggttgcagtgagccatgatcatgccactgcattccagcctggatgacagagcgagactctctaaaaaataaaatatatatgtgtgtatatgtgtgtgtgtatatatatatatatatatatatacacacatacagtttagtgtcattaaatacatttataagttgtacaaccatcgccactatctctttccagaaatttttcatcatcccaaatagaaactgtggctgttaaacaataattccccatcccctcattcctcccacccctggtagcctctattctacttcttgtctctatgaattaaatattctagatacctcctatatgtgaaatcatgcaataatttgtccttttgtgtctggcttatttcatttaccataatgttttaaaggttcattcatgttgtagcatgtatcagaatttccttttgaaattggttcttctaaagtacaatttatttttaaaaatttgaaggagagctgatttaaaatatagtatctgaggccaagcataccagttaaaaagtcttcagaatactttgctcatcttatataactgggctccattctctctctggttaggagacatattttatcaaaacatgcaggaagaagggcctcctttatgaagctagcctaatgagcaggccttctgactcttggataatttaaaaaacttgatgtggggaaatataaacatagggtaagcaattgaaatgcattgtgttcatgttgtttcttggaaggctagactccaaagatatagaaatggagcagccctaccccaactgttatagttggtttcctgcagattctcatgctagaatttgtggccagaaaacctaagacattatgggaacaaaagggtttgaggcttctaactttagttggatttatcatccaccctactgaaataataaagacactaaatgaaataaatattattatcattgtgtatatcttaaaggaataataacaagcatagggcagttaatttagggaagtagtactgcatagtagataatagcctgatttctggagtcagattgtctggattcatatccctgctgtgtcatttaccatctttttgaccttggataattttcttagcttctctgtgactcaattttttcattagtaaaatggaggtaacaatagcacctgcctcatagtgttgttatgtggattaacttaatacccaacagttaattgaatggaaactgcttagcctacctggtaccttgtaagtgcttaataagtgttagtgattagtattactattgataataatttatttttatctttaattcccaaataattattgtaataatgggtgattctcaatggtagtgatgatatttggttagggaaggaaggcagagaggcaaatatgctatcagaagaggattcatttggatcactttttaaccaggtcatcttcacagacagtagataactctgccagactctgggagtcagggcatgtagacccagaagttaggtacctgatgaggaaattgtatgccgtatctggagcgagtatgatagctatggttctccaactttagttgagtcacagtcaactggagtgcttacaagaaatacagatttctggaccctacttccaattccctgacctgacctgatttggcaggtcagggacgagttctaggactctgcatatttaataggagcccacagatgatccctgtcctgctaagagagtctgtggaccacactttgaaaatcagtgataaagatatttacccctgtctcttacttcatttcaccagctgtgatagatgctggaggttgggaattgtacaagtaccctaacaactttcaccagctattgaaagtctactatgtgtcagacaatgtattaagtgctttgcctatattaccttattgaatcttcataaccaccctatggagaagatgctgttggtattattttacagatgaggaaatggagccccaatgaggttaagcaatttagctgcagtcacacagctagttggtggtaaggtagaatttgacccagggctgtcttaatgctagacttctcttggtctttctactaggctgcattgcctcttgtaagatagaatgcttgttctgaagaacctcaccatcttctaagacatctgtatgacagaagtagagggttggcataggggatttctgagaaaaagatttagggttgtattatgaatagctttaaatgggaagatattggcatgtcttgtatatattaatggcacttttcatgcactgctggtgggcctgtaaaatgatagatatcctttctggagggcaaactggtaaaatgtaacaggaatctttgagcctatgattatacttttaggaaccaattttgaggaaatgatccaacaatggcacaagagtggtcaatgcggcatttgcttttaacatgaaaaattagaagccaatgaaacataacaattgagaattagtttaaaaaaatatgttaggttttcaaagcatttaatgttataacaaaatactcaaaatacaggagtaagaaacttaccataaacatgtagtatattacaatcataatttttatcaaaaatgcattaatatatacatagaacgaggggaaggaaatgggtccgaatgaatgatcatttctaggcaaagggattgtgggtaactgatattactctctctctacctttctaaaatttccagattgcctatagtgagcatgtactacttttataataaaagaaaccctgtacaagtcattaagggaaaaagaaaatactgtagtcatccaggtctgagagataataggaacttgaacttaggtggtagcagaggagattgacgtaagagacattattaaaggaaatcaactcattatgacttcgtgagtctgtgtgggtgatgagaggtagggagagtaaaaaataatttcaagttttcaagtctgagtaatagagtgaatgatggtaacattgacagcaaaatcagatcaattatctttctcagagatgggaaaattgcttttttcaatttgctgtctagaggataatatgttgtttttgtcccgatgagtcagataattctgtaatttggtgacgcaaatatactgacaatatggaccattaaaagcacaaggtatttttgttttgtccattgcagaccattaaacaaaatcagttctttaaaactaaaagtataataaaaattccagatatggggaagggtaagagaacaaatttttatgtcggcttttaaccaaatgaaaaaaatctgctttcttcacatggcatcaattctcacaaattgaactgcatatgctgcatactcttttacttctagcatcattgaattattgaatgaacatagccctagaggtcatctaatgaggtggatgttgacatgtttaattatttccctttaattataaatgttcaaaactcgagattctcactcatctccctctctttagagatggggacatgaggagccacagagaagtttctcaaggactgtcactgtgttaagccaatcttgtattgctataaagacatacctgaaactgggtaatttataaataaaagaggtttaattagctcatggttctgcaggcttcacaggaactgtggtgccagcatctgcttctggtgagtatctcaggaagcttacagtcatggtggaaagtgaagggggagcaggcatcttacgtggtgagagtgggaacaagagggggtaggaggtgccatacacttttaaacagctcttatgagaactcactgttgtgatgacagcattaagccatgagggatccacccctatgacccaaacacttcccaccaggccacacttccaacgttggggattacaattcagtatgaaatttggcagggacatatatccaaactgtcagtcacatagagaggcaactgcaaaacctggactagaacccatatagcccaaagttaccaacttccaatccaaataaataatcttgtccttttttaaacactgtcttcttccacactgcaccattaatagttgttcttataaaaacttatttagttatggccatgaataagttaaatcttcagtatagttttccttaaagttactcgtgttttgatgatgttttgttcattactatagtaatgttttggccaacagcatttctttctgttgctttgctatttgccttttccttgtgactaattgggcttctggccatattgaggggaggtaaggggagttgcagagggaattgcttctcctctctatctgcatttctcttatccataaaaaaaaaatctgtcctccccctgcttcttggaaaccaattcttattttcagcattgtgccatttttatattcttgttcagaaaggagctttttaaacatggggataacatccaaatactgctgattgttattttttacttcagtgtgtatcttttttttttcctttttgagatggagtctcattctatcactcaggctggagtgcagtggcacgatcttggctcactgcaaactttgcctcccaggttcaagtgattctcctgcctcagcctcccgagtagctgggactacagatggtgccaccatgcctggctaatttttgtaattttagtagaaatggggttttgccatgttggccaggctggtctcgaactcctgacctcaggtggtccgcccgccttggcctcccaaagtgctgggattacaggcgtgagccaccacgcccagcctcaatatttatctttaaaagctaagaatgctttcctacatagccaaaatagcattactgtactttaaaaattattaattccttaatttcatctaatactcagtccatattcaagtatttccaactgcccaaattgtcaggagacagatattatccagtcatctcaccactgaccactaagacagtggttgagattgaccactatatttaaggtgatacaacagcatgtcccctcctgccatctgcacttatttccccattgcttcaacacagataatctgtgtagtgttatgctagcaccttgtcaagtcttcagctaatgctttttacatcagttgatatccttgcttgaatcagtaatttccttaggggttgggttgaatattacagtttttctctttctatcatttctacatttacttttcttttttttttcttttgagacaggatcttgctctgtcaccgaggctggagggcagtgatgcaacctctgctcactgtagcctcgacctcctgagctcaagcagttttcctgcctcagcctcctgaatagctgggactatagtcacgtgccaccacactcagctaatttttaaatttcttttgtagagacaaggtctcactatgttgcccaggctggtcttgaatttctaggctcaagcgatcctcttgcctccttctcccaaagtgctgggactacaggcatgagtcaccgtgcctggcccatttctacacttattagctgacaggtatctacaaagcgctgctttcagtcatcaactgagctctttagttgttctgaaattcagttcctactaaaaaggcaagatgcatatttaatcatttccctttatttatccattaaggtgaggagttggattaatagacacctcatagtaccaagttgttcctctccataccaccacattcaacttggtgtttttttgtttttgcttttttttttgagacagcgtctcactgtgttgcccaggctggaatatagtggtgcaaacatggttcactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggattataggcgtgaacaaccacacttggcttctgttgttcatttttgtatgaaatcagtttcctgaacttttagaaggaggcttgattgagacaagttgtttctttccctaattttatggctgtagagctccatcctctaatgaattacattctgaaatctcctggccctttctgtctacctttctgctttgatctaggctttcttttttgtcgctcttgtccctgtcctgactaatttgtaatccagtttcaccagtttctcctcagagtgcagctttgccctggaagggattaaggattagttttgagtttctggaggcccaggctgctttcagtctagaccacggactccttgcactcaatcactgtttgaaaatgcaaacccttccctttatcagttgttcataaatttgcttgctgaagttgagttattttacagttctcagatctataggatgccatgttgagtccgtttatatactcttccacagcttataccattttggtcctgtaactatctctaatttgtccacattcactcttactttgaggttcatgggggaaatgttttcatcttgttttgttgtagatttcatcttgtgttggtagattttggatttactttcctattgggggaaccagcccccaatatttcaacgtaagttcttttctattttccctaagtgtcagccggtctgataaataaagggaaagagtacaaaagagagaaattttaaagctggatgtctgggggagacatcacatgtcagcaggttccatgatgccccctaagccgtaaaaccagcaagtttttattagcaattttcaaaggggagggagtgtacgaatagggtgtgggtcacagagatcacatgcttcaagggcaacaaaatatcacaaggcaaatgggcagggcaaggtcacaaggccagggcgaaactagaatttcgcctggttcctggtcctgctgtgcatgcattgtcattgataaacatcaggaaacagggtttgagagcagacaaccattctgactaaaatttactaggcagaaatttcctaatcctaataagcctgagggtgctgcaggagactagggcgtgtttcatctctatctatgactgcataaggcagacactcctagagcagccattttagaggcctcctcctgggaatgcattcttttcccagggctgttaattgctaatattccttactggggaaataattcagtgatatttctcgtacctgtttttggcaataagagaaatatgactgtcctgcccggctccaggcagtcagacctaatggttatctcccttgttccctgaacattgctgttatccttttcttttttcaaggtgcccagatttcatattgttcaaacacacatgctttatgaacaatttgtgcagttaatgcaatcatcacaggggcctgaggcgacatacatcctcagtttatgaagatgacgggattaagagattaaagtaaagataggcataggaagttataagagtattgattggggaagtgataaatgtctatgaaatcttcacaatttatgttcagagattgcagtaaagagaggcgtaagaaattataaaagtattaatttggagaactaataaatgtccatgaaatcttcacaatttatattcttctgtcatgacttcagcaggtccctccgttcggggtccctgacttcacgcaacactttcctatttatatttccaacttgtgtttttttatggtgatatttgggaatattcaaaaacgatgctgctaccaccatcttcttcgcagaatttttctgcaaactatagaccaaggggcaaattctgcctgccacttgtttttgtacagtctttaacctaagaatggtttttgtgcttctaaatagttgggaaaaaaatgtaagaatactatttcatggcacatgaaattaagatttcagtgtcatacagtttcgttggccaggcccattcatttatatattgtctgtggctgctttcatgctacaacagcagagttgttttataggcacagagactgtatggcccccgaagctgaaaatacttcttatctagccattttcaggaaaagttagtcaaccctggtcccctataatatagtttttagtggctaaataatattccattgtgtgcacatattataatgtacttaacaaaattcctattggcatttggatgaatcctaaatttcattgtataggcatcatttcacagctaagtataagcatatgtattaatattttattactgtcttaggataaattgttacaagccaaattgcatgatcaagggggagggtatatgtattttaaactctttgactgatacaggctgagtattcctaatctgaaaatctaaaatccgaaatgctcccaaatctgaaactttctaacatgacgttcaaaggaaatgttcattgcaacatttggaatttcagatttttgcgttagtgatgctcagctggtaagtatatagtgcaaatattccaaaagctgaaacacttctggtcccaagcattttgcataagggatattctacctgtattgacaaattgtcatccagaaaggttgtacaaattaaattcccattaaggaaactggctaaataagttatggtgcattcatgcaatgaaatattatgtagaggttaaaatgaggtagatcacttttactgatgtataaaaatataacatacactgttaggtgaaacacccaggttacatatggagagtatgattcctttgtgttaaggaaactggggcattaaaatgcacaaacaaattttttcataagaagcatagattacaactaagttgtgccagttcatatacctaccagcagtatgttcgactggttgtttgaccatacttttgccaatatgatattacctaattttaaaattcttgccaagttaatagatgagaaaagagcgtcttaattttacagtcaggttttgtactttttcccaagtttattggcttgaattaattcttttgtgaaattcttgttccacgtccatttttccttgttgtattcatcttttggtggtttgtaaagctctttacgtattagatattaaccctctggcttcttatccatgttttcctttgtattgtatttagggtgattaatgatgtacaaaaggtttttccttttttatgcagtcaaatcttcctgtatttttaggtgtaaagagccctttccaccttagatttatatagttgttcctctacatatttttctagtacttatttgattttttttaacattgagatctttaatccatcagggatttattcatgtaggctatgaggtagggtttagcattgttttcaaatgcttatattacccagttgtcttagtgtcatttattaaataagccattttttcaaggttatataattttttcaaattgtttttattagaaatctatacatttcacatgttttaaaatcaagtttgaggtgtaatttacaataaaatttactcttttttgagtgttcagttagaagaatgttagcaaatatatgcaattttgtaaccactgctccattaaaaatatagaatatttccatcatctcctaaaagttatcttgtagtcctttgcagtcaaccccctctgttaatcgccttgcaaacactgatcagttttctgtccctaaagtcttacaagatgtcctataaatgaaatcacacagtacatagctttttgagtttggcttcttttactcagcataatgtgtttaagagacatccacactgtggtgtgtgtcagtagttcatttccttttattgctgagcagtattctataatatggttgtaaccacagtttatttaaccattcacttgttcaaggacatcagagttgtatctagtttttaatctattattagtgaaaatgctataaacattcatgtagaagtctttgtgtgacatgttttcatttctcttgggtaaatacctgggagtgggatttctgggtcatgtggtaagtgtatgtgttattttataaccaagtgtcagactgttttccataatgattgcactatcttatttttaccaacaatacatagagatctagtttctctgcgttcttatgagcgcttggaattgtcggtatttttaattttagccattctagtaggtgtgtcagggttatataatttgtttagaataatttgcatattttgagcagtgtttcccaactcatcccctcatctcttaacttgcccagtccatcttcagttgcacaacctgaggcagctcttgtttctgtttttcttctttccatttcttttctaagaacatctgtgcagaaaacgagcttagacataacctaatgcagggtttggtagacttttttctgtaaagggccagataataaatgattttgtttttgcaagccattcagtctctgtcacaactcaactctgccattataacatgaatgcaggtgaaggcaatatgaaacaaagaccagcattcagccggatttgacctgtggaccatagtttgctgacccctggtttagtataacaactttattttacagatgagaggaccgagctcatgtttcaccctttcctctgatttacaagtaaaagtaaaaaaaaggcaaggaccaggatattggcttttaccataagagacatgcttgaattgggttcaagataagtgtgctttatgtgtaatttcctgttctagcaaatgatgttagatgaagctcttaatatagggtctttcggcaatttcgattgcagtaagactttaggaacatcttatgttttaccattcatctcaatgctacttgactttttgaacctattatgtctctggagcaatgagcattaagaaaataaaggtaataaaggtctcagcaaaacagttggagtaagaacggcatgacatccttttattcttcttaatagattttatttccagtggtggaaatgtccaaatttgtttatttctggagatagtcattgtacatcatgtaactatctcatgattcccacctccatttaatattaattcctgattgttctgtttcattaatcattcagatagataaagattcttaggtcaaaaaaaaaaaaaaaacaggaaatcatacccctacggttccatccacacaaacctaaaaataagcattggcactaagtactcagggaaagaacactgtttagatatgtcattgtgtatgtgtttttttcctcccttctagcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattagatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggtgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgatgacaactacagaaaaaccagaggcagcttctttgccaagacctttcaaagccattgtaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcacccaaatgttttcctttggtcttattttggggaaatggtgggaggtagagaaaattggagttaaaagaagaaacattatgaaaaaattccaagccagctattttatcttataatcattcatcatgagtttctttgatgttctggctgttccggtgtgcctatgttttctgataagggcataaatacacttagtttaatattaatttagcctttgtaagcagcacttgaagggacttaagtattcaataaattgtagttatgataattaatggaaatggagggttggtcctttctaatattaagctaaagtggaatgcaatatgattaatgatatacatgatgtgcaatgtctagtcacaagggaatatattagcaggttagattagagaccaagaaagtcagtttttgactggacgcagtggctcacgcctgtaatcccagcactttggaaggctgaagcgggctgatcatgaggtcaggagatccagaccatcctggctaacacggtgaaaccccatctgtactaaaaatacaaaaaaattagctgggtgtagtggcgggcgactgtggtcccagctactcaggaggctgaggcaggagaatggcgtgaacccgggaggtggagcttgcagcatgccactgcactccagcctgggcaacagagcgagactccgtctcaaaaaaaaaaaaaaaaaaaaaagaaaaagaaaaaaaaatcagttttcaatagctgtccttttaaaagctggtgatacagtttcatattttctataactacagcaaaatggttttaatgtcatggaggttttcttcccctcatttgtgttaagctcaaggagtgtgtcttcagccagatcacatttgctaattaccctgaatctttatagaatccaaaccctagggaaagagtgagggtgctgatcttggtcaagttatttatctggaattatccaggaagattctgaaaatccgtttctaggtaagtgtagctgttttgttgttcttgttattttaaaataagaaacctcttttctgattcttaacacatcaacagtgagtattacaacagaaaacatttaaaattgagaacccccttgaggtcgtaaatttgtgtgagatctatggaaaacaaattcctgtagccacaaacatgatcactttgtctcaggggtagaggagccagagtgatctaagcacatttgatttccagaggaatttatcatttccttgtttccatgaactcttgctcttttgaaggtgtaacttatgctcacatgaatagcacattatgctactaacttattagtagttttaaaagaaagcaagaggacaagaacatttatttcagagactctgttttcttttaaaccctaacggttgagtcaaacaaagtcttttttgtaaatactgtagctaaatcttggcatgcttttactttaagcaagggaggagttttactgacatttggatgtgctagatatttttgacatcaatccccaagatgatttcttcttgaaggttctctggctttttactatctttcctaacggtcacatttttagtttaccattagcaacaggaaaatatttaactgctggttttcagcatttattgggtagaccattataaaaagaaaattaatagtttctgagtggctcctatgtgccgagttacatgtgtgatttcacataatctgtatgctggtcccatgagtttagttgtgttgttaacgtcattttacagatgaagaaactgagacatagagcgattgagctgtgtatgcaagatcacatagctagtaagagactaagacaaaattgggaagcaagtcagcctgactttaaagcctgtataatatagtcagtggtatatttacttgtccccaaaaggcagttacctaaagaaaaaaacatcttatttcgcattttgccaaattgcttatcaactggaagatttctgattttaaatcattaattgcaaagtgagcattttatagcatcttttttgttttgttttgtttttttgagacgggattttgctcgtgttgcccaggctggagtgcaatggcacaatctcagttcaccacaacctctgcctcccgggttcaagggattctcctgcctcagccccccaagtagctgagactaggtgaccgccaccacgcccggctaatgtttgtatttttagtagagatggggtttctccatgttggtcaggctggtctcgaactcccggcctcaggtgatccgcccgcctcggcctcccaaagtgctgggattacaggcgtgagccaccgtgcctggcctatagtgtcttttaagagattcatttgtgcattcatttatctacgagctagacaatgtgttatgtaataggaatttagaagtcaataagatttggcttagtatcaggtggttagttaagggaaggctactttgtataggggaaagaaacctggattatcatttaggagttccaaatgaatgtgggcagataactttctctgtctgggtctgtttccctatctgtaaaatgaaggtgttagacagtgatgtataatcccatccatgactcctaatggtgaccataggttgtggagttcatttggaagtgagaatctttgctataaacactagctctaggcatcagcgttctcatctgtaaaatgaggaggttggactagattagctctattaattttgacatccaataaaggttaagatgatttttgttttacaaatcaagaaaatacctcttattcactacaggatgtagcgaaactgccaaaaataaccagaggagcaggccctttaatgcagtgggaagaacaaaggaattaatacattagatgaaacctgtggtctgtccaaatcaggattttcacaagggcccagccatgattgcatctaacaaatatttcttaatatgcatgtatgatactttaaaagccaaagagtattatagggcttatcatttaaaaaaagcagcctcctgtcccactcctccttacccctgattcctgctcctagaaaagatgtcaacaccctaattctgggacctgtggctatgtaactttacatggaaaaaggaactttgcagatgtaattgtggttcaggccttaagatagattttcctggattatctgggtgagcccaatatcaagcccttagaagccgagaaattggctgctttggctgaaagcagaagagggagaaagagccaaagcacaaaaagggctcaaagtgctgttgctggcttgaggatgtaaggggccatgtaggaagtgtgagaaggaactggatactaccagtaacttgagtgggcctggatgcagattttctcccagagcctccatataggagcacaagctggcagacaccataatctgggccttgtgagaccctgagcagagagtgcagccacactgtgctggacttctgacctacagaagtgtgatataatatgtttgtgttattttaaactacatttaacatgttttacctgtttcttttggtatataaccctttacttttgaataataccctaatattgcaatttctttagatttagaaatgatctttcttctgtagaagatgaggaattagcttgcttttatgcctctcaacacgcacttgtgcacacatactcacacttctcttccaaaaatataaatattttcgttaaaatagtcaatatttgcattatacttatataaatattgcttgtggttaacttatgcactgtaccattaattatatttttttgtttttttccccatattgtctccctttctttatttttttatgtacctgtcatgagttcaatcccaaacttttccccatattgtctccctttctttgatttatttttgtatgtacctgtcatgagttcaatcccaaacttttctgaagaaccataacacttcactcaatatgatcaaacatgttaggtaatccatgagtttcatgaatttttggggggagacagccctctttagagtttgctgccctcctgatccatcctgaaatggttgttctctaggccgagcacctagctgccatcctgggaattccctccacttccagcttctgtttcctgcattcccagttgtcccccttcttggattatgccctggttttgctggaccacaccgtttactaagttccttagaaaggttgcatgggaggtgatttttatttttttcagacagggtctcattctattgcccaggctagagtacagtggtgagaggggacagcgtgctggcagtcctcacagccctcgctcgctctcggcgcctcctctgcctgggctcccactttggcggcacttgaggagcccttcggcccgccgctgcactgtgggagcccctttctgggctggccaaggctggagcccactccctcagcttgcagggaggtgtggagggagaggcacgagcgggaaccggggctgcgtgaggcgcttgtgggccagctggagttccgggtgggcatgggcttggcggggcccgcactcggagcagccagccagccctgctggccccgggcaatgggggacttagcacccgggccaatggctgcggagggtgtactgagtcccccagcagtgccggcccaccggcgctgtgctcgatttctcaccgagccttaactgccttcccgcggggcaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctctcaagtagctgggattacaggcgcccgccaccacgcctggctaatttttgtatttttagtagagacggggtttcaccgcgttagccaggctggtctcgaactcctgacctcaagtgatccacttgcatcagcctcccaaagtgctgggattacaggcgtcagccacagtgcccaacaaattctggaaattctttataagcgtagtcagacatctgtgaaggaagtgaaaactgaagtttggccttgaagcttagaagttctcacacaaccaagacatagtcttccttaaaacagaaaaaaaacacagccatgcatacacacacacacacacacacacacacacacacacacacacaaatgccaacttctaatatgtctacggaatgtttttgcaaatggtagtacagagcatatctgtgttgtgtaattttttcccacatgataaggaccaatataaacaaattggaaatgtgatactaaaagagagtacttcagcatggattaattaagaccaatatggggcaatccttttctgatattttacaatgcactgaaaattttaaagcaaggtggaaaaataggcttatgggtctgaatgttaggttgagaaaaattatctgtggtcaagtgtgtgctttgtaaatctgctgagtttacacttgatcatgcagttttctataagttgctggcttgaataccactgggaaatatacagaccatgtgactatgaaaccaacccaattgtcccacagagctgatgtttctgatctctttgaataaacatagaaattgatccttccagtcttaaaacttgagaaagttacatttgtcttatctgaattcctttctcaggaaacaaaccatcaggcctcccagaaagtatccaggatctgaaaatcaccaaatcaccacatccggacagtgagaagccagatccctcacccttcttgattggctgacaaaccaactgcttcctgttgaccaactcctcttccttatccctccctaattcctgttttcccacacatggtttcacttcttccctgctatacaaacacctaattttagttggtcagggagatggaattgagactgatctcttgtctccttggctgctgcacctgattaaagccttcttccttggcaatactcattgtctcagtgtttgcctttctgtgcagtgagaaaacaggacctagatggaactcctgctgttttggtaacattactacagacctctcagaatggctaaaataaaaataatgacaacacctcaataatagtaaggatgcaaagaaatcatatcactcatatatttcttgtgggtacataaaatggtacagctactctgagaaagagtggcagtttgtttaaaaacgaaacatgcaactatcacatggtccagcaattgtactgttgggcctctatcccagaaaaataaaaacatatgttcacacaacaaactttacagaaatgtttataatggttttattcataatttacaaaaactagaaaaactcagatatccttcaatgggtgggtgaatggttgaacaatgtttggtacagtcacatcatggaatactacttagcaataaaagtgaatgaatatcacctcacgctcattagaatggccactataaaaaaaacccataaaatagaaagtgttggtgtggatgtggggaaatgagaatccttgtgtgctatttgtgggattgtgaaatggtgcaacagccatggaaaacagaatggtagttcttcaaaaagttagaaatagatctacctaggctgggtgcggtggcttacgcctgtagtcccagcacgttgggaggccgaggtgggcagatcaactgaggttgggagttccagaccagcctgaccaacatggagaaaccccgtctctactaaaaatacaaaaattagccgggcgtagtggtgggcacctgtaatcccagctactcgggaggctgaggcaggagaattgcttgaacctgggaggcagaggttgcggtgagctgagatcgtgccattgcactccagcctgggcaacaagagtgaaactccgtctcaaaaaaaaaaaaaaaaaaaagaaaaaaaaaagaaaaaagaaaaagaaatagatctaccatatgactcagcaatcccacttctgggtatttatgcaaaagcattaaaagcagggtcttgggatatttgcacacccatattcatagcagcagtattgaaacatggagtctgggagcagcattcctatgatcagtgtctatgctattccactttgtgcttttattaattcattcaagaaggcttttgacgaatatagatcgtgtacgagatgctgtagtagattcaaagaatagagcatgctttcttttcttttttaaaaaattgagatggtgtctcactattttgcccaggctagtctcaaactcctgggctcaggtgatcctcttgcctgccaagtagctgggactacaggtgcagtgcatactttctgtcctattattgctgatagtccagtgcaggaatggcaaatttgtttcattttgtggatcagttcttctggaatactgtttcccgaaggattttgagattgggtttgggctcagtgggaagatggctaagatctatcagtgatgtctcttgttgggtactggtgggggggtgttgatgtacttgtgccacatggttgccaccttggctaagggctagagtgacatatttatgtatataaataatggattatcaacaagacagaatattagcaattagagttatgaaaggaggtccaagtaaagtgctgtatacaggcagtggaaaaaatgatgggggtgtcggggctgggaggatacccagaaaagttttttgagggcagtgctagttggtctgcacattaaagcaagagtagaatctgaagagattaacaaaagggggcatccctgtcctcagaaggagtttgagtagagtggaaggatggattgtgagagaaagatgacagagataagcagatgacctagggattaggcaagaggtggagaggatccgctccatgcctggcaaacaggagaggagggcacagatctgaagtagtttagaggttgactcaccaggactccatgaatgggagggagatgctcaaaatgttatagagaagcacaggcttgggtggggaatggggagtagatgagaaatacgaatttcattttggacatgttcactgtagtatgctagaggaaccattaggttatgatttcctacagggttggggacactcacggatggcaatgagaggagggcagcttcaagagtcagggttatgggagccagctgccagggaaagaccaatgaggtcattcccaaaataagacacattgcaagccctctcagcacagtgtgaggacaacccaaatctaagctagctctgggggcagtcatggcatggtaggttagatgtcaaagcagagacttcatcacgaacttggcagcccaagagtaacacactgctgccatctgggggctgcatgtagaaattgtaatggcagctttgtgaaagccacttaatgagagaggacattattttggaaccagcaagacccttcctctcaaaagccttttatagttcttccttaaattcttttctgcctagttctacttctctgtccccaatgaaggaaaccatgggtgcacatgttctgtagcatatttccagaaggactgaacccctgaaagcagaatactttcagtcagctacagcatcctagcactggattgagatactccatgctgctgctgctactgtgctctagcaactgaccaaagttcttgcctgaaccaccctctgccggatctcccaaatcccctcattttgacttcatcactgcctggttctgacctttgatactagaatactgaatttttgcctccaggggcacaatttactcttctatgttttcttttgctagcatctttttcctaagtggaactggattttcatttactcatttttcattcaacaaacatttattgagtggccacagtgtgtcaggtactaggatacatttgggagcaaaaatagatgggtcccctcagaaacctgtattacagtctaactgtaaagacaaaacaatcattttaaatgtgataattgctatgaaggaaaggtcaatgatgcagtgagatgtagtgaggtgagatgaagaaaaggtcgatgaggctgtgagaacaggtaacaggggattctgacctagtcttgcagggtagcaaaaacttttctgaggatgtgacatttaagctgaaattttaaggattggtaggaattagccagaaattaactgttctgaaaactatgaaacctataagactgggaaagaaggggccatcctccttgttcctctgtcttctacagtggtaatacagcagggagattcaattgctttacataggacagtctctaggaagatctttcattctgaattagcatgtcaactacagtgaaaacatgtctaaaaaataacaattacaacaactagaaaatcaggaaatgtagaaataaagaaccccccctaaaactcctccaaattagactgccctaatgaaaataggaataggtataaacagacaaagaaatactaatgttcttgaagtcttgaaatactatcttttggtttatttcttttcatttttatttttcatttaaataattgaaccgattttttattttttgagacagggtcttgctctgttgctcaggctgtggtgcagtaatgtgatcacacctcactgcagccttcaattcctgggctcaagcaatcctcacacctcaacctcctgaggagctgggactacaggtgtacaccaccacaccaactaatttttttttttgtatttttagtagatacaggattttgccatgttgtccagactggtcttgaactcctggggtcaagtgatctgcctgcctcagcctccaaaattgctaggattacaggcgtgagctgctgtgcccagccgaactgctttttaaaaatctccatatacacttatttgaacaacttgatcataatttctgaaatcttttaacacatcagacctgaaccaaatcaagataccaaaacccacctgagcttcagatgcctcattggtaaaatagggattatagtatagtaatagctacatcttacggcttttggagacttaatgagttgacacttacaaagcacaccattgccctgctcattgtaagtgcataatacatgttaatattattattccagggctgacctgtttgtagaaggtgtcaggggaaaatatttccaggttgatggaacgttgaggttgcttcaaccccatgccatggttggttacttcagctacgcaaggaccagccccgacatgagaaatgataagtgaaaaaaagagaatcaagcccagtacatagcatataattcacctggcctgcagaagtacacacaaaagcttattctgtagttcatattcataagagatatcccctccctcgttcctaacaggtaatcgtctagtctctgcctaaatccctgcagcaacagggagtgccctatttatggagaaaggccattttatttattgatagttctaattttctggatctatcttcaaattccagagtaaaaagtcatttttatcatgtatcttcccattaatcttccttatgccctggagaaccaaacagaacaaaaaaagtcctcactcaaaattggcaaaattgagtaaggacatagattacaatattgcatcaactatcaagtgtcctaattttggtaatggtcttctataagaatggctgtgtccctgggaaatatgcattgaagcattagggagtaaaatggcatgatgcatgtgacctgcctgcaaatagttcctaaaaaaaaagaacattaatatgtaagtaatgagagagagtgataaaaacaaattgccaaaatatttaaaattggtgggatctgcatagatggtgtatgggaattatttgttctacttttacaactcttctgtaatttttaaattatttctaaataaaaagttaataaaaatcctgggctgggcatggtggctcacgcctgtaatcccagtactttgggaggctggggtgggtggatcacttgaggccaggagtttgagaccagcctggccaacatagctaaaccccatctctactaaaaatacaaaaattagctcggtctggtggtgcacacccatagtcccagctactcgggaggctgaggcaggagaatcgcttgaaccctgtaggtggaggttgcagtgagccaaggtggcaccactgcactccagcctgggcgactgagcgagactctttctcaccaaaaaaaaaaaaaaagatagtaaaaatcctctctcttccatagcaaagctcttcaaaggtttgagagcaattaccacatttattctgttctacatttccatctcacttatttgcttactcttcactcattcatttattctttgataaatattgattgagcacttgctttgtactatgcccagagctgggcactgtggaagtggtggagaagaaagtcaattctacctggctctcatggaattcaggggcacttggtggagtccaaaggtaatcaaattattctacaagtaattgtattatttctaactctgatagggctatgacataagaatcagggagggtgggattgtatgagagagcctgccagaacgttctgaacctgctaagtggacccagcatttaaggttgtaggggtgcaaagggcagtgtgccaaagagattagcattcctttatgaaaaatctcttggctgaggggaaggatttgtgagcccaggtgagcagctttggacaagctgttccatttgtcaagttgttccatctgcttccttaagtgtcacaaagtattgaagagagattgcctgggcttgaatgacagctgctgtttcctagccatgtagttgtgaaagaggatagcagagccttggtgccttcacgcagattgagacccttgtcccccatcaatcatagctatgtctgatggcatggctatggcagttgggtcccttgccacacaatttcaagcctgggcctgagttgagcccagatgagtcctgggaacagaaactccaacaggaatcatgtcagtttctgtaacaggatttgccttgcaacctagatgagaaaactgagctttagagtcatcagcatgtattttttttcccaagaaaaatagccattaaatgtgggggtggatttgaagatcaagctgagaatgtgcatgtgaagcttagcacttagaacataatatgcctccaacaaatggcagctatcattcttttcatcactgataccaaggtgggctgagtgaagaaaaatgaggtggctgaggatgctggatatttaatacctccagggcactgtcaagggacaggggacagggctccaaatggaaggatgcaagaacttgcttttttttctttttttttttgagatggggtcttgctctgtcgccgaggctggaatgcagtgatatgatctcggctcactgcagcctccacttcctgggctcaaatgatcctcccacctcagcctctcgagtagctgggaccacaggtccacatcaccatgcctggctaattttttattatttgtagaaatgggatctccatatgtttcccaggctggtcttgatctcctggactcaaacaatcctggcaccttggcctcccaaagtgttgggattacaggcatgagccacggcacccagccgagaacttactttcacccatctcatagttttgcttgtgatgatcacctagtattctaaacagtcagtactcgaactctagtgcaatattattcattcaatgaatgtttattgagtacttgctatatgacagacactgtccaggtgctggggctacacaaggaaacaaaacaagtgaacacttagcttcatatttctatataccatgagagttttcacagtgctttcatgtccatgatttcatctgttcctcatgacaatacaatgagataggtcctattattattttcattttatgggtgggggaactgatatatccagagattaattaattaactcaagagcgatagaacccaggccccaggttgtagtttaatgctcccttcaccacacacacattcggaacggccaccatcctgatctacctcttgccagtctccctcttgccagtgggcccccagggctttccagcctgacttctgcctctggaccccaccctcctcccccacttgctctagatcttgtctctgccacagcagtccagctgatcagtcagcaaggatttctgaagcacccagcaccatgattttaccatgatttcccaaagggctacttgggtctcagtcatttcagtcaatccagaccagcaggctggcctacattttctgaggtgttgcagctatgcagaattggttggactttttgctgggcccctctatggtggtgctttgggagggcactctcctgtgttcagataactggggcagaattagaggaattaacaaaataacagttttggatgccaggttccccattaggagtttgactctgcactccctcagatttggtggcgtgtgctctcctgctggtaatacacttcctgtgacctggaaatcctactgctatattccttaggtttggccagactttaaaacccgccagatcattgcaacttaagcaacttctaagaacatctctttaccaggtgttatttagagaacgcaagagatttacgtctgctctgaaatgttacattggcactatataaactttcccagtacacaaagctctcaggcttttggacatgttttctcctattaagtcatataaatagcttaataaaacagtatttggttaaacatcatttgaatttcccactgaatgatggttatattcaactccaagaaaacgtggaaagtgcaaaggctttggaattagacggatctgttttcaaaacattacgccacctcttaaagctgtgtgactccaggcttcttacttaacctctccgagtgtcagtttcaattacacataccatgcctgtaatcccagcactttgggaggccaagcggggtggatcatttgaggtcaggagtttaagaccagcctggccaacatggtgaaaccccaactctactaaaaatacaaaaattagccaggcggtagtggtgcacgcctgttatcccaggtagtcgggagactgaggcaggataattagttgagcctggcagacggaggttgtagtgagctgagatcacgccactgcactcctgtctgggcaacagagtgagaccttgtctcaaaaaaaatgcaattgtattattttcatgtatggtatctagaataaatggaaaataggacaataacagacatacaacagggactcagaattaatgtatctcataacgagctttagaaagaaataataacagatgccaattataaagcacttacatgtcaaaaaacatactcagctgggtgtggtggtaggcacctatagtcccagctactcgggaagctgaggtgggaggattgcttgaagccaggagttggaggccacagtgagctatgatgagtacagtgaatggccactgcacttcagcctgggcaacagtgagttcccttatctaaaaaaaatattcacaaggtattacaaggataatcttctttaatatgcacagtaacattttagctagatgatattataatctccacttacagatatggaaactgaggcccagaaggattgtgaaactaaaacttaagtggtagatgcagaacctatttggttttgctgtagagcctgcatgctttaccactatttccctatctttagtgctttgcacaggaaccaaagaagcacgtcttttaggaaagtcaaatctttttactctatccaacactctctccactcctattccctcttttaatcttacggacacttaatttaggaacccttttcttgaaatatctggaatcaatagcctggctcagtccaatattttaacaattcagtgtagtccacatacactcaggtgaatgagtttaatgttaacagtttattgaaaatagaacagatatacagaaatgtgcataaaacatgtatgtagatttttaacaaatcgttagaaaagaaatacccatgtaaccaccaagaaagatcagaaatcaaacactaggatgccacagaagccctctgtggttctctttttaatcaaagctcttctctcacccccaggcggaaccactagcctgacttttataggaatagttccatgctttcttttagtttttgatcatctctgtatgcaagtctaagcaatatagtttaggctcacctttgtttgaactttatataaatggatccacaccgtaaatattctttttctaaaaaaatctttattgtgatatagtgtacatctttaaaattcatcctttgaaagtgtacaattcaatggtttttaaatatattcagttacatgaccatcatcacaatcaattttagaacattatcatcaccacagaaagaaaccctgtacctattagcagtcactcccttttccttcctacccccaacccctggcaacctctaatctactttctatctatgtggatttgtctcttctgaatatttcatataaacagaatcatacaatatgtggccttttgtgtggccatctttcacttagcatagtgtttccagggttcacccatgatgtagcatgtaaaagcacttctttccttttatccattcattaattgatggacatttgagtggtttccccttttcggttattaataatgacactatgcacattagtatacaagtttttgtggccgggcacagtggctcacgcctgtaatcccagcactttgggaggccaaggcgggcagatcacgaggtcaggagattgagaccatcctggctaacacggtgaaaccctgtctctactaaaaaatacaaaaaattagctgggcgtggtggcaggcacctgtagtcccagctactcaggaggctgaggcaggagaatggcgtgaatccgggaggcggagcttgcagtgagccgagatcacgccactgtactccagcctgggcgacagagcgagacgcaatctcaaaaaaaaaaaaagtttttgtatggacataggttttcatttcttttgggtattcacctgggaatagaattgctgggtcatatagtaattctatatttaaccttttgaggaaatttccaaactattttccaaagtgactgcaccattttacattcctgtgagcaatatttcaggattccaatttctccatatccttgctaacacttgttattatctgtctttttaattatagccatcctagtaggtataaaatggtatccaattgtggttttcgtttgcatttccctgatgaccaaataatgttgagcatcttttcattggccatttgtatatcatatatattccctggagaaatgtttactcagatcctttgtccattttaaaattaagttgtctttttattgttgagttgtaaaactatatatactagataaagatccttcatcagatatataatttccctatactttctttcattctgtggattgtcttttccccttcctgacagtgtctttttttttttttttttaaactaggtctggctttgttgcccaagctggagtgcagtggcgtgatcttggctcactgcaacctctgcctctcaggctcaagccatcctcctacctcagcctcccgagtagctgggattacaagcacatgccaccgtgctggctaatttttgtattttttgtagagacgggtttcaccatgttggccaggctggtcttgaactcgtgagctcaagcaatccacacccttggcctcccaaattgctgggattacaagtgtgagccaccatgcccggccctgacagtgtcttttgatgcacaaaaattttaaattttgtgagccgagatcgtgccactgcactccagcctgggcaacagagtgagactctgtctcaaaaaaaaaaaaaaaattaaattttgatgaagtctagtttttctgtttgttgttgttgttgttgttgcttatactttggtgtcatatctaagaatgctttgcctaactcaaagacacaaacatttacttctatgacttcttagagtttttataattttagcttttatacttaggtctatgattcattttgagttaatttttgtacatggtgtgaggtggtagtccaaattcattctttgcttgtgacatccatttgtccctgcaccatttgttgaacagacttttgtttccccattgaatggtcttgtcatccttgtcaaaaattaactgaccataaatgtatgagtttatttttggactctcaattctattccactgatctatatactatccttattccaggaccacacgattttgattactgcagctttgtagtaggttttgaaattgggaagtgtcagttctccaactctgtttttctttttcaagattgttttgactattctgggtttcctgcatttctttctttctttctttttttttttttttttgagacggggtctcactctgtcacccaggttggagtgcagtggtgtgatctttgctcactacaacctctgcctctcgggttcaagccatcctcccatctcagcctcctgtgtagctgggactacaggctcaggcttgcaccaccatgcctggctagtttttgtatttttaatagagacagggtttcaccatgttacccaggctggtctcaaattcctgggctcaagtgatccgcccacctcggcttcccaaagtgctgggattagaggtatgagtcaccacacccggctccctgtatttctgtgtgaattttaggatcagtttctcagtttctacaaagaagccagctgaaattatgctagacataacattgaatctacagatcaatctgtagattgccattttatcaatatttggccctctaaaccaggatgatcaaatgtctttcatttatttatatctttaatttccctccacaatgttttgcaatttttagtgtaagctttacacttcatttgttaaatttattcataagtatttttgatgttattgtaaatggaattgtttccttaatttcatttccagattgttcattgctagtgtatagaaatacaattaaattttgtataacaatcttgtattttacaatcttgttgaactcatctattagttctcatagtttttcaatggtgtccttagaattttccatgtacaaaatgatgtcatcgttcaattcccacctatgagtgagaacatgcggtgtctggttttttgtccttgcgatagtttgctgagaatgatggtttccagcttcatgtaaatgacgagttaatgggtgcagcacagcaacatggcacatgtatacatatgtaacaaacctgcatgttgtgcacatgtaccctagaacttaaagtataataaaaaatgatgtcatctatgaatacagatggttttatttcttcctttccaatctggatgtcgtttatttcttttttatcttgtctaatttcccaggctagaacccctaatacaatgttaaatggaagtggcaagagaggacattcttgacatgttataacattgctttctatttcactaatttctatttatcatattatcgtttttaaattttattgggcttattttgtttgttttcttacatcttgagatggacaattcattaactcattaactcgtggattttcatcattgcttacagatacaagggtgggtttttttgttttgttttgttttgttttagagacagggtctggctatgttgcccaggttcatgtgatcttcctgtctcagcctcctgagtagcagggactacaggtatgcagcactgtaccgagctcccacaatttttgatatgagtatttccattattgttcagcaaaaaatatttttaatttcactatcattgttctttgactcatcagttattttagagtatgtgtcttggtttccaaacatactgacattttccagttatctttttattattggtttgtaacttacttgcatt

SEQ ID NO: 11966 - DNA, 24803 bp, Human
tgagataagttttatgaaataaaaagattaaaaattcttacatttttagtgtccttccttggtaaaatgtagagttgtccactgtgtttatctcctcctccttattatcatggttgctgttattatttttaatggttcattaaacccaagggtctgggaaatactcatggaattcatctcacagccttcacactgtatgatatttaaacaggtggttgtccatctgattcttaaaatatttccaagaaaaatgattccacctaatgcataaatgctttcatcagattaagagaacaccatggacattttattttattttattttttaaatattaacttccattgcataagctaaatgggtaggaataagtgagatgatattgttatctagagctttaaaatattcaaagggctgtcatcattatctcatttaatctttgaaaacaactctatgaagtacaaaggacactgagacatttgttgctctatatcaaagaaaaaagtgtttgtcccaaaacttcaaaatgtgtaaattacacattctgcatctttacagctggagaaaattcactggcaatggaatatttaaaattagagcttgcttagtgtgctgcttctgatcactacttgatcccacttcgtgctttcatgttaattggcccaattggactctacagttggaaggtgaaaacttactatttcaacttgagtcacgtatgtattcttatcatatacttcttaaaggtactattttttttcttctgatagtcaccacaccaagcacttccagccaccctgccacagacttcctttgtaatcactgttgaaggacatgatgtttttatgacttcccgaaatgaaaaccctatcttgtttttaaaacaaacaaaccaacaaaaagtagtgtttatgtaagcattttgttccctgactctaggaacccctctgtttttatatcaactctgtactggcaaaacacaaaaacaaaatgccaccttgctaattcccttcctagcaaagtaatacagtttagcacatgttcaagaaaaaaatggctaagaaattttgtttccactaattattttcaagactgtgatatttacactctgctcttcaaacgttacattttataagactattttttaacatgttgaacataagccctaaatatatgtatccttaaattgtatttcaaatattttaggtcagtctttgctatcattccaggaatagaaagttttaacactggaaactgcaagtaaatatttgccctcttacctgaattttggtatccctctccccaagcttactttctgttgcagaaagtgtaaaaattattaaataaaattctaatgatggtatccgtgtggcttgcatctgatacagcagataaagaagttttatgaaaatggactcctgttccactgaaaagtaaatcttaatggcctgtatcaactatcctttgacaccatattgagcttgggaggaaggggaagtcctgaatgaggttataaagtaaaagaaaatatttgcaaaatgttcctttttttaaaatgttacattttagaaatattttaagtgttgtaacattgtaggaattaccccaataggactgattattccgcattgtaaaataagaaaaagttttgtgctgaagtgtgaccaggaagtctgaaaatgaagagagacagatgacaaaagaagatgcttctaatggactaaggaggtgctttcttaaagtcagaaagagatactcagaaagaggtacaggttttggaaggcacagagccccaacttttacggaagaaaagatttcatgaaaatagtgatattacattaaaagaagtactcgtatcctctgccactttatttcgacttccattgccctaggaaagagcctgtttgaaggcgggcccaaggagtgccgacagcagtctcctccctccaccttcttcctcattctctccccagcttgctgagccctttgctcccctggcgactgcctggacagtcagcaaggaattgtctcccagtgcattttgccctcctggctgccaactctggctgctaaagcggctgccacctgctgcagtctacacagcttcgggaagaggaaaggaacctcagaccttccagatcgcttcctctcgcaacaaactatttgtcgcaggtaagaaatatcattcctctttatttggaaagtcagccatggcaattagaggtaaataagctagaaagcaattgagaggaatataaaccatctagcatcactacgatgagcagtcagtatcaacataagaaatataagcaaagtcagagtagaatttttttcttttatcagatatgggagagtatcactttagaggagaggttctcaaactttttgctctcatgttccctttacactaagcacatcacatgttagcataagtaacatttttaattaaaaataactatgtacttttttaacaacaaaaaaaaagcataaagagtgacacttttttatttttacaagtgttttaactggtttaatagaagccatatagatctgctggattctcatctgctttgcattcagactattgcaatattgcacagaatgtagcctctggtaaactctgttgtacactcatgagagaatgagtgaaaaagacaaattacgtcttagaattattagaaatagctttcactttaggaactccctgagaattgctgctttagagtggtaaaataaataagcttctctttaaacggaatctcaagacagaatcagttacattaaaagcaaacaaaaaatttgcccatggttagtcatcttgtgaaatctgccacacctttggactgggctacaattggataatatagcattccccgagataattttctttcacaattaaggaaagggctgaataaatatctctgtttgaagttgaataacaaaaattaggaccccctaaattttaggactcctgaaattcgtctttttgcctatattcagctactttacgttctattaaatcttctttcaggccaggtgcactagctcatgcctagaatctcaggcaggcctgagcccaggaatttgagaccagccagggcaacacagtctctacaaaaaaataaaaaattacctgggtgtgttggtgcatgcctgtagaactactcaggatgctgaggactgcttgagcccaggatagccaaatctgtggtgagttcagccactaaacagagcgagactttctcaaaaaaacaaacaaaaaaacaaacaaacttccttcaaaataactttttatctgcaatgttttcctattgcctgtgagattaaatttactcttttacctgatttccaaagccctccataatctaatccgactttaccttgtgttcactgcaaaatagcaggactgttccactacaatccaaaaatcacaggttgggtgcagtggctcactcctgtaatcccaacactttggaaggccaaggcaggtggattgcttcagctcaggagttcaagaccagcctgggcaacatggcaaaaaccctgtctctccaaaacatacaaaaattagccagatgtggtagtatgtgcctgtagtcccaactactcaaaaggctaaggcaagaggatcacttgagcccaggaggtcaaggctacagtgagccatgtttgctgtgtcactgcactccagcctgggtgatagagcaagaccatgtctcaaaaaaaaaaaaaaaaagaaaagaaaagaaaaaaacatcgctctattcagttcacccccaccacaacattgttttgattatcacataaatgctggtccattgccttctctatctattcaaatctttaagcattctttgagattcaactcaattctccttttcaaactaggccatttaaactacatcagttccattttgatttttttgctttgagtctacagactcaaaaacaaaaacttaaaaacttattttttaagttttctgctactctcacctcttcaacactcacatacacgcattcataataagatggcagaatgttcaaggataaaatgatttatagaactgaaaagttaggttttgatcttgttgctgtcaagatgactacctacctgatctcaggtaattaattatgtagcatgctccctcatttcatcccatacctattcaacaggattggaattccacagcaaggataaacataatcatagttgcttttcaagttcaaggcattttaacttttaatctagtagtatgtttgttgttgttgttgttgtttgagatggagccctgctgtgtcacccaggctggagtgcagtggcacgaactcggctcactgcaacctctgcctcatgggttcaatcagttattctgcctcagtgtcccaagtagctgggactacaaggcacatgccaccatgcctggctaatttttgtatttttagtagaaacagggtttcaccatgttggccaggctggtctcgaactcctgacctcaagtgatccagccgcctcggcctcccaaagtgctgggattacaggcataagccaccgtgcccagcctaatagtatgtttttaaactcttagtggcttaacaatgctggttgtataataaatatgccataaatatttactgtcttagaattatgaagaagtggttactaggccgtttgccacatatcaatggttctctccttacagctttaactagagtctagaattgcaggttggtagagctggaacagaccttaaagattgactagccaacttccttgtccaaatgagggaactgagacccttaaaattaagtgacttgccccagacaaaactggaactcatgtgtcctaatttccatcatgaaattctaccattcactagcctctggctagttgtcaaagtattgcataactaaatttttatgtctgttttaaagaacaaattgtcactgcttactcctgggaggatctttctgaggtggtttataactcttaaaaaaaaaaaaagtcagtagtctgagaattttagatgaaatagtcaaagcatttttatccaatggatactataattttcatagattagagttaaagcaaagaaacacggatgagaaaggaagaggaaaattgaggagaggaggaatggggatgagaacacactacttgtaatcagtcatagatgtattgagaactaacaagaagaattgtaagaaaataagaatgaagaattcaaaatcaacacatgaaataaaaaagaaactactagggaaaaatggagaagacattagaaaaattattctatttttaaaattctgttttcaggcttccctcctgttcttcctccttctcattggctttcaggtggagggaaagtttaagatagaaaaaatatatatattctacacatccctttctacgctgttgtcatggcaacaaggtttatcatagcaaacttttattcatacaacatttattgagttcttactgtgtggtaagctctttccaggtgttgaaaattcaggggaaaaaagacaactcattgtcttaaaactcagatgaaagctgaacagacctatttttaatcaaagtaatctcaatttagggtagtaagagctatttaagaagcatgaacaggtgtgaaggaggtaggactctgaggagagaataattagctaggaatgaaagagcagagaagttttcctagaggaactattaaagctgggagttacgggatgaaagatgaggcagggtttgcaggcaaaaaaaaaaaaaaaggcaggggaaggggaagttctggcctggcagagagaataactgtggcaacaatggaggagagtctggaagcaagaaaaccaagtagaagagtattaaaatagaagatgccaggggtaatgagggcttgatttaaaacagtgctgttggagatggagaggagataccaaattctggagacatttctgagttagaatctacagtatttatcagacaagggaaagattagacaaaggagttaagaatgactcccaggtttcagtttggggcaggtaactaggacatgttttgaaaagtaatgtattagatctcttaccattggaactatgtatgtggagccaaattaaaatttgtacatgtatataactctccccccaccaccagtaactacttccctaactctctactttgtagccagacttcctaaaagaatagtttgtagtcactgtctttacttttcccctcccattctgtcctagatatttgtccacctaccatctgctgcctccactttacccaaactgttctacggttgcccaaaacttcctaattgccaaattcaatgaacaagtttaagcttatatgtaaattaggagctctacagtttgatttcgagcagcccctcctgaaaccctttctcttttgacttctgtgacacatctcagatttacaaaactgaactaattattttacacttgagctgtattttcgttcttttttcttaatgaatgaggtaaccactcaacaaattgcccaagccaaaaactacgaagtcatcctcagttcctccttcttctgtttgacccacaacagatcagctgagaaatcccgctgtttagtatctcttgaattcattaccttaatttatagcctcatcaactcttaattgttaaaattacttcagtagttgttgtctgacctctgtccaatcttgttcaatcaggtccattcttttgttcttggtggtggtggtggtgttgacagagtttcgcttttgctgcccaggctgaagtgcagtggagcacttcactgcaaccacagcctcctgggtttaagcagttcaccctcccgagtagctgggactacaggtatgtgccaccacacccagctaattttgtgttttcagtagagacagggtttcaccatgttggtcaggctggtctcaaactcctgacctcaagcaatccacccacctcagcctcccaaagtgctgggattacaggcatgagccactgcacacggaccagatccattgtttatgttgcttctagagtgagtttttaaaacacaaatttgaccatatctttctcctatttaagtcagtattttttttttcaggaaaaaacagttcaaactctttagtctgcttacacaaggcctttgtagtctgactcttctttccaagctttcatcaaagtatactgcaagttgcattttatgtgaattgaattaggcaacggtataaaaattatagtttatatgggcaaaatggaaataatgttaactcttccaaatagtttatctagaatgacataatttcaaagctgtcaggtcaaatgagttataaactgttaacactattgccacatgcaagtgtctcttatacttggtagaattatctgcttccatgtcattattatgtaaattagactttaaataactcagaagttcttcagacatacaggttattattgtgctttttaaacataattttaaataattttatatatgataatgttatccaagtgctaagggatgtattgttactgctgtgcaaaaaaaaaaaaactccaaataaatatgttgaaaccaagtttatatgcaagaaaacaatattaaaaaggccaaagtaccaccataataggctgtgtggagacagcaggctacaaaacactagtaataatgctgagaaagttgaaaaaagaaagaaagcaacaatatgctttggttgttgtaggtttatgtactccaagaatatctcctctcaaacttttacgttttttccaaagaaaagttaactttggctgggcgcagtggctcttgcctgtagtcccagcctttgggaggccaaggcgggcagatcacctgaggtcaggagtttgagaccagcctgaccaacatggagaaacccgcccccctcactactaaaagaatacaaaattaggccgggcacagtggcttacccctgtaatcccagcactttgggaggccgaagcaggaagatcacctgaggtcaggagttcgagaccagccatggagaaacccgtctctactaaaaatacaaaattagccgggcgtggtggtgcatgactgtaatcccagctactcaggaggctaaggcagagaatcacttgaacccaggcagtggaggttgcagtgagccgagatcgtgccattgcactccagcctgggcaacaagagcgaaactctgtatccaaaaaacaaaagaaaagaaaaggtaaccttgaactatgtgagatctttagaaatgcattctttctgtaaaatgtgactacatttgccttatttatggtaaaaatgttgaggcctcaaacaacccatattttctcggtctccccgctgcctagcctttgttcacattgcttcttcttggtggaagctcttcctctggccttgaaaatgcctgcttctctttcaaggtagcacagtcatcactttctgtggtaaccttctccagcaccatcaaacagaaagaatgaatctcttgtaaattcagctcttacgtcattcattacattattttgtaactctttatagattcttctctcccactagactctgagtcactggagagtaggagccaactctcattcatgtgtggtttggtcagctactggccacattcctgatgcatagttaatgctcaaaccttaactggtgaatcagctcaaatattgtccttctctaaatccattcactcattgactaactatgtactcaaaatagtaaacaccagtaatttaatccaattcctgcccatactgcttggtacatttcaggtgaattagtttgataaatatgtgtgtattacataatattaaagtatgtacagaagatcatgctaatcattatttcaccaactgataactaatcaaaacatagagtgcctctcaggttaacaaatgtctgccttctcagttaatgcagtcattaacaaacaccttctgatgctgataatagggccttgttcagcaatgaagccataaaggtgaataaagaacatgccctcgtggagctcacagcctagtcattattgttctgatttttaatattaatgttggtttgggttttggtgaaaaatgtttagacttatcttagtgatcttttcatcctttgctatattatttttctctaagagtcttccttatcccctcctttaaaaaactaggtgataattctaaattgtaaatttaaatattataaatagcttataaaatttaatatttataatatttaaatgtttgataaatatttaaattttataatatttaaatgtttatttaaattcatttgtacatcagtttttattttatttaaatgtgttggccaggcatggtggctgacacctataatcccagaactttgagaggccaagtcaggcaaaccatttgagctcaggagtttgagaccaccctgggcaacgtggtgaaaccctgtctctaccaaacatatgaaaacttatctgggtgtggtggcacgcatctgtggtcccagatgggagtcccaggctaagatgggagaatcgcttgaacccaggtgagaggggtggggtggatgttgcagtgagctgagatcgtgccactgcactccaacctgggtgacagagtgagactccatctcaaaaaaaaaaaatgttatctaaataagataaatttaataactgttcgcacttagatgagcataaggaactaaacctagataaaactatcaaataaggcctgggtacagtgactcatgcctgtaatctcaagcactttgggaggccaaaattatacaaagttagttgtataacaccaactaacaactattttggggttagcttaattcagattaattttttttaaactgagttttaaattcctgcttactctaccatacatgctaggcctcatattatgctagaaaaattttgagcacagatttatgaatactctcctgcataccatttaatttttaaacaaattttaatgcagtatatatgtgcctttttaccaacacattaaataataagatctactgtgaggactaaacttctgtaatttcaaagtagtaatgagtttaaaccatgtctcaagatctctgcaataactgtagcacaacagaaaataggtatttctattaatgacagagtcacaagtactactaataatactgtggtttgtttcctgcaactaatcatgggaggaatgctaaatttcagaggttggtgaaaatacatgtgtatttttttccccatccaagttcacagatttctcacactgagaactcctattccataacaaaattctggaagcctgcacaccgtattggaagaggggcagaaaggaaaagcaaatggaaggatttaaatttttttcaaatcctgtatcccttgattttacagcaagattgtatttatgtattacttgtgttaaaaatatagtataatcgagactccagatcaaaaatcaccgcagctcagggagaaagagggccaccaaatgccagagcccttcagccttctcccaccctgcctgtaccctcagatggaagcacttttttatcattgtttcacctttagcattttgacaatgaagtcacaaaccttcagcctctcacccataggaacccactggttgtaagagaaggatgaagccagtccttcctaaagggcacgattagatgtgtttatggcatcctcaggtgaaactatatttatattgacaatatatttatatttctcaaggaatactagaataatgattcagttcagtactaggccatttatctaccctttataatattgtttaatgagaaaatgctttctatcttccaaatatctgatgatttgtaagagaacacttaaacatgggtattcataagctgaaacttctggcatttattgaatgtcaagattgttcatcagtatactaggtgattaactgaccactgaacttgaaggtagtataaagtagtagtaaaaggtacaatcattgtctcttaacagatggctctttgctttcattaggaataaagatggctgctgaaccagtagaagacaattgcatcaactttgtggcaatgaaatttattgacaatacgctttactttataggtaaggctaatgccatagaacaaataccaggttcagataaatctattcaattagaaaagatgttgtgaggtgaactattaagtgactctttttgtcaccaaatttcactgtaatattaatggctcttaaaaaaatagtggacctctagaaattaaccacaacatgtccaaggtctcagcaccttgtcacaccacgtgtcctggcactttaatcagcagtagctcactctccagttggcagtaagtgcacatcatgaaaatcccagttttcatgggaaaatcccagttttcattggatttccatgggaaaaatcccagtacaaaactgggtgcattcaggaaatacaatttcccaaagcaaattggcaaattatgtaagagattctctaaatttagagttctgtgaattacaccattttatgtaaatatgtttgacaagtaaaaattgattcttttttttttttttctgttgcccaggctggagtgcagtggcacaatctctgctcactgcaacctccacctcctgggttcaagcaattctcctgcctcagccttctgagtagctgggactacaggtgcatcccaccatgcctggctaattttttgtatttttactagagacagggttttgccatgttgtccaggctggtcttgaactcctgatctcagatgatcctcctgcctcggcctcccaaagtgctgggattacaggcatgaaccaccacacatggcctaaaaattgattcttatgattaatcttctgtgaacaatttggcttcatttgaaagtttgccttcatttgaaaccttcatttaaaagcctgagcaacaaagtgagaccccatctctacaaaaaactgcaaaatatcctgtggacacctcctaccttctttggaggctgaagcaggaggatcacttgagcctaggaatttgagcctgcagtgagctatgatcccacccctacactccagcctgcatgacagtagaccctgacacacacacacaaaaaaaaaccttcataaaaaattattagttgacttttcttaggtgactttccgtttaagcaataaatttaaaagtaaaatctctaattttataaaatttatttttagttacatattgaaatttttaaaccctaggtttaagttttatgtctaaattacctgagaacacactaagtctgataagcttcattttatgggccttttggatgattatataatattctgatgaaagccaagacagacccttaaaccataaaaataggagttcgagaaagaggagtagcaaaagtaaaagctagaatgagattgaattctgagtcgaaatacaaaattttacatattctgtttctctctttttccccctcttagctgaagatgatggtaaagtagaaatgaatttatttttctttgcaaactaagtatctgcttgagacacatctatctcaccattgtcagctgaggaaaaaaaaaaatggttctcatgctaccaatctgccttcaaagaaatgtggactcagtagcacagctttggaatgaagatgatcataagagatacaaagaagaacctctagcaaaagatgcttctctatgccttaaaaaattctccagctcttagaatctacaaaatagactttgcctgtttcataggtcctaagattagcatgaagtcatggattctgttgtagggggagcgttgcataggaaaaagggattgaagcattagaattgtccaaaatcagtaacacctcctctcagaaatgctttgggaagaagcctggaaggttccgggttggtggtggggtggggcagaaaattctggaagtagaggagataggaatgggtggggcaagaagaccacattcagaggccaaaagctgaaagaaaccatggcatttatgatgaattcagggtaattcagaatggaagtagagtaggagtaggagactggtgagagaagctagagtgataaacagggtgtagagcaagacgttctctcaccccaagatgtgaaatttggactttatcttggagataatagggttaattaagcacaatatgtattagctagggtaaagattagtttgttgtaacaaagacatccaaagatacagtagctgaataagatagagaatttttctctcaaagaaagtctaagtaggcagctcagaagtagtatggctggaagcaacctgatgatattgggacccccaactttcttcagtcttgtacccatcatcccctagttgttgatctcactcacatagttgaaaatcatcatacttcctgggttcatatcccagttatcaagaaagggtcaagagaagtcaggctcattcctttcaaagactctaattggaagttaaacacatcaatccccctcatattccattgactagaatttaatcacatggccacaccaagtgcaaggaaatctggaaaatataatctttattccaggtagccatatgactctttaaaattcagaaataatatatttttaaaatatcattctggctttggtataaagaattgatggtgtggggtgaggaggacaaaattaagggttgagaggctattattttagttattacaagaaatgatggtgtcatgaattaaggtagacataggggagtgctgatgaggagctgtgaatggattttagaaacacttgagagaatcaataggacatgatttagggttggatttggaaaggagaagaaagtagaaaagatgatgcctacatttttcacttaggcaatttgtaccattcagtgaaataggaaacacaggaggaagagcaggttttggtgtatacaaagaggaggatggatgacgcatttcgttttggatctgagatgtctgtggaacgtcctagtggagatgtccaaaaactcttctacatgtggttctgagttcaggacaaagatttgggctggagatagagatattgaaggcttatgcatagaaatggcatttgaatctatagagataaaaagacaaatcagaggaaatgtgtaaagtgagagaggaaaagccaagtactgaactggggggaatacctacatttaaaggatgcagtagaaagaagctaataaacaacagagagcagactaaccaaaagggaagaagaaaaaccaagagaattccaccgactcccaggagagcatttcaagattgaggggataggtgttgtgttgaattttgcagccttgagaatcaagggccagaacacagcttttagatttagcaacaaggagtttggtgatctcagtgaaagcagcttgatggtgaaatggaggcagaggcagattgcaatgagtgaaacagtgaatggaaagtgaagaaatgatacagataattcttgctaaaagcttggctgttaaaaggaggagagaaacaagactagctgcaaagtgagattgggttgatggagcagttttaaatctcaaaataaagagctttgtgcttttttgattatgaaaataatgtgttaattgtaactaattgaggcaatgaaaaaagataataatatgaaagataaaaatataaaaaccacccagaaataatgatagctaccattttgatacaatatttctacactcctttctatgtatatatacagacacagaaatgcttatatttttattaaaagggattgtactatacctaagctgctttttctagttagtgatatatatggacatctctccatggcaacgagtaattgcagttatattaagttcatgatatttcacaataagggcatatctttgccctttttatttaatcaattcttaattggtgaatgtttgtttccagtttgttgttgttattaacaatgttcccataagcattcctgtacaaaaatgttcacacatttgtctgattttttcttcaggataaaacccaggaggtagaattgctgggttgatagaagagaaaggatgattggcaaattaaagcttcagtagagggtacatgccgagcacaaatgggatcagccctagataccagaaatggcactttctcatttccccttgggacaaaagggagagaggcaataactggtgctgccagagttaaatttgtacgtggagtagcaggaaatcatttgctgaaaatgaaaacagagatgatggtgtagaggtcctgaagagagcaaagaaaatttgaaattgcggctatcagctatggaagagagtgctgaactggaaaacaaaagaagtattgacaattggtatgcttgtaatggcaccgatttgaacgcttgtgccattgttcaccagcagcactcagcagccaagtttggagttttgtagcagaaagacaaataagttagggatttaatatcctggcaaaatggtagacaaaatgaactctgagatccagctgcacagggaaggaagggaagacgggaagaggttagataggaaatacaagagtcaggagactggaagatgttgtgaaatttaagaacacatagagttggagtaaaagtgtaagaaaactagaagggtaagagaccggtcagaaagtaggctatttgaagttaacacttcagaggcagagtagttctgaatggtaacaagaaattgagtgtgcctttgagagtaggttaaaaaacaataggcaactttattgtagctacttctggaacagaagattgtcattaatagttttagaaaactaaaatatatagcatacttatttgtcaattaacaaagaaactatgtatttttaaatgagatttaatgtttattgtagaaaacctggaatccgattactttggcaagcttgaatctaaattatcagtcataagaaatttgaatgaccaagttctcttcattgaccaaggaaatcggcctctatttgaagatatgactgattctgactgtagaggtattttttttaattcgcaaacatagaaatgactagctacttcttcccattctgttttactgcttacattgttccgtgctagtcccaatcctcagatgaaaagtcacaggagtgacaataatttcacttacaggaaactttataaggcatccacgttttttagttggggtaaaaaattggatacaataagacattgctaggggtcatgcctctctgagcctgcctttgaatcaccaatccctttattgtgattgcattaactgtttaaaacctctatagttggatgcttaatccctgcttgttacagctgaaaatgctgatagtttaccaggtgtggtggcatctatctgtaatcctagctacttgggaggctcaagcaggaggattgcttgaggccaggactttgaggctgtagtacactgtgatcgtacctgtgaatagccactgcactccagcctgggtgatatacagaccttgtctctaaaattaaaaaaaaaaaaaaaaaaaaaaaacttaagaaaagaaaatgatcaagtctactgtgccttccaaaatatgaattccaaatatcaaagttaggctgagttgaagcagtgaatgtgcattctttaaaaatactgaatacttaccttaacatatattttaaatattttatttagcatttaaaagttaaaaacaatcttttagaattcatatctttaaaatactcaaaaaagttgcagcgtgtgtgttgtaatacacattaaactgtggggttgtttgtttgtttgagatgcagtttcactctgtcacccaggctgaagtgcagtgcagtgcagtggtgtgatctcggctcactacaacctccacctcccacgttcaagcgattctcatgcctcagtctcccgagtaggtgggattacaggcatgcaccacttacacccggctaatttttgtatttttagtagagctggggtttcaccatgttggccaggctggtctcaaacccctaacctcaagtgatctgcctgcctcagcctcccaaacaaacaaacaaccccacagtttaatatgtgttacaacacacatgctgcaacttttatgagtataatgatatagattataaaaggttgtttttaacttttaaatgctgggattacaggcatgagccactgtgccaggcctgaactgtgtttttaaaaatgtctgaccagctgtacatagtctcctgcagactggccaagtctcaaagtgggaacaggtgtattaaggactatcctttggttaaatttccgcaaatgttcctgtgcaagaattcttctaactagagttctcatttattatatttatttcagataatgcaccccggaccatatttattataagtatgtataaagatagccagcctagaggtatggctgtaactatctctgtgaagtgtgagaaaatttcaactctctcctgtgagaacaaaattatttcctttaaggtaagactgagccttactttgttttcaatcatgttaatataattaatataattagaaatataacattatttctaatgttaatataagtaatgtaattagaaaactcaaatatcctcagaccaaccttttgtctagaacagaaataacaagaagcagagaaccattaaaatgaatacttactaaaaattatcaaactctttacctattgtgataatgatggtttttctgagcctgtcacagggaagaggagatacaacacttgttttatgacctgcatctcctgaacaatcagtctttatacaaataataatgtagaatacatatgtgagttatacatttaagaataacatgtgactttccagaatgagttctgctatgaagaatgaagctaattatccttctatatttctacacctttgtaaattatgataatattttaatccctagttgttttgttgctgatccttagcctaagtcttagacacaagcttcagcttccagttgatgtatgttatttttaatgttaatctaattgaataaaagttatgagatcagctgtaaaagtaatgctataattatcttcaagccaggtataaagtatttctggcctctactttttctctattattctccattattattctctattatttttctctatttcctccattattgttagataaaccacaattaactatagctacagactgagccagtaagagtagccagggatgcttacaaattggcaatgcttcagaggagaattccatgtcatgaagactctttttgagtggagatttgccaataaataaccgctttcatgcccacccagtccccactgaaagacagttaggatatgaccttagtgaaggtaccaaggggcaacttggtagggagaaaaaagccactctaaaatataatccaagtaagaacagtgcatatgcaacagatacagcccccagacaaatccctcagctatctccctccaaccagagtgccaccccttcaggtgacaatttggagtccccattctagacctgacaggcagcttagttatcaaaatagcataagaggcctgggatggaagggtagggtggaaagggttaagcatgctgttactgaacaacataattagaagggaaggagatggccaagctcaagctatgtgggatagaggaaaactcagctgcagaggcagattcagaaactgggataagtccgaacctacaggtggattcttgttgagggagactggtgaaaatgttaagaagatggaaataatgcttggcacttagtaggaactgggcaaatccatatttgggggagcctgaagtttattcaattttgatggcccttttaaagaaaaagaatgtggctgggcgtggtggctcacacctgtaatcccagcactttgggaggccgaggggggcggatcacctgaagtcaggagttcaagaccagcctgaccaacatggagaaaccccatctctactaaaaatacaaaattagctgggcgtggtggcatatgcctgtaatcccagctactcgggaggctgaggcaggagaatcttttgaacccgggaggcagaggttgcgatgagcctagatcgtgccattgcactccagcctgggcaacaagagcaaaactcggtctcaaaaaaaaaaaaaaaaaagtgaaattaccaaaggcataagcttaataatttaattcaaattttaaaaagggcggggggtggctggaagagatctgtgcaaatgagggaatctgacatttaagcttcatcagcatcatagcaaatctgcttctggaaggaactcaataaatattagttggagggggggagagagtgaggggtggactaggaccagttttagcccttgtctttaatcccttttcctgccactaataaggatcttagcagtggttataaaagtggcctaggttctagataataagatacaacaggccaggcacagtggctcatgcctataatcccagcactttgggagggcaaggcgagtgtctcacttgagatcaggagttcaagaccagcctggccagcatggcgatactctgtctctactaaaaaaaatacaaaaattagccaggcatggtggcatgcacctgtaatcccagctactcgtgagcctgaggcagaagaatcgcttgaaaccaggaggtgtaggctgcagtgagctgagatcgcaccactgcactccagcctgggcgacagaatgagactttgtctcaaaaaaagaaaaagatacaacaggctacccttatgtgctcacctttcactgttgattactagctataaagtcctataaagttctttggtcaagaaccttgacaacactaagagggatttgctttgagaggttactgtcagtgtctgtttcatatatatacatatacatgtatatatgtatctatatccaggcttggccagggttccctcagactttccagtgcacttgggagatgttaggtcaatatcaactttccctggattcagattcaaccccttctgatgtaaaaaaaaaaaaaaaaaaaagaaagaaatccctttccccttggagcactcaagtttcaccaggtagggctttccaagttgggggttctccaaggtcattgggattgctttcacatccatttgctatgtaccttccctatgatggctgggagtggtcaacatcaaaactaggaaagctactgcccaaggatgtccttacctctattctgaaatgtgcaataagtgtgattaaagagattgcctgttctacctatccacactctcgctttcaactgtaactttctttttttctttttttctttttttctttttttttgaaacggagtctcgctctgtcgcccaggctagagtgcagtggcacgatctcagctcactgcaagctctgcctcccgggttcacgccattctcctgcctcaccctcccaagcagctgggactacaggcgcctgccaccatgcccagctaattttttgtatttttagtagagacggggtttcaccgtgttagccaggatggtctcgatctcctgaacttgtgatccgcccgcctcagcctcccaaagtgctgggattacaggcgtgagccatcgcacccggctcaactgtaactttctatactggttcatcttcccctgtaatgttactagagcttttgaagttttggctatggattatttctcatttatacattagatttcagattagttccaaattgatgcccacagcttagggtctcttcctaaattgtatattgtagacagctgcagaagtgggtgccaataggggaactagtttatactttcatcaacttaggacccacacttgttgataaagaacaaaggtcaagagttatgactactgattccacaactgattgagaagttggaggtaaccccgtgacctctgccatccagagtctttcaggcatctttgaaggatgaagaaatgctattttaattttggaggtttctctatcagtgcttaggatcatgggaatctgtgctgccatgaggccaaaattaagtccaaaacatctactggttccaggattaacatggaagaaccttaggtggtgcccacatgttctgatccatcctgcaaaatagacatgctgcactaacaggaaaagtgcaggcagcactaccagttggataacctgcaagattatagtttcaagtaatctaaccatttctcacaagaccctattctgtgactgaaacatacaagaatctgcatttggccttctaaggcagggcccagccaaggagaccatattcaggacagaaattcaagactactatggaactggagtgcttggcaggaagacagagtcaaggactgccaactgagccaatacagcaggcttacacaggaacccagggcctagccctacaacaattattgggtctattcactgtaagttttaatttcaggctccactgaaagagtaagctaagattcctggcactttctgtctctctcacagttggctcagaaatgagaactggccaggccaggcatggtggcttacacctggaatcccagcactttgggaggccgaagtgggagggtcacttgaggccaggagttcaggaccagcctaggcaacaaagtgagataccccctgaccccttctctacaaaaataaattttaaaaattagccaaatgtggtggtgtatacttacagtcccagctactcaggaggctgaggcagggggattgcttgagcccaggaattcaaggctgcagtgagctatgatttcaccactgcacttctggctgggcaacagagcgagaccctgtctcaaagcaaaaagaaaaagaaactagaactagcctaagtttgtgggaggaggtcatcatcgtctttagccgtgaatggttattatagaggacagaaattgacattagcccaaaaagcttgtggtctttgctggaactctacttaatcttgagcaaatgtggacaccactcaatgggagaggagagaagtaagctgtttgatgtataggggaaaactagaggcctggaactgaatatgcatcccatgacagggagaataggagattcggagttaagaaggagaggaggtcagtactgctgttcagagattttttttatgtaactcttgagaagcaaaactacttttgttctgtttggtaatatacttcaaaacaaacttcatatattcaaattgttcatgtcctgaaataattaggtaatgtttttttctctataggaaatgaatcctcctgataacatcaaggatacaaaaagtgacatcatattctttcagagaagtgtcccaggacatgataataagatgcaatttgaatcttcatcatacgaaggatactttctagcttgtgaaaaagagagagacctttttaaactcattttgaaaaaagaggatgaattgggggatagatctataatgttcactgttcaaaacgaagactagctattaaaatttcatgccgggcgcagtggctcacgcctgtaatcccagccctttgggaggctgaggcgggcagatcaccagaggtcaggtgttcaagaccagcctgaccaacatggtgaaacctcatctctactaaaaatacaaaaaattagctgagtgtagtgacccatgccctcaatcccagctactcaagaggctgaggcaggagaatcacttgcactccggaggtggaggttgtggtgagccgagattgcaccattgcgctctagcctgggcaacaacagcaaaactccatctcaaaaaataaaataaataaataaacaaataaaaaattcataatgtgaactgtctgaatttttatgtttagaaagattatgagattattagtctataattgtaatggtgaaataaaataaatactagtcttgaaaaacatcattaagaaatgaatgaactttcacaaaagcaaacaaacagactttcccttatttaagtgaataaaataaaataaaataaaataatgtttaaaaaattcatagtttgaaaacattctacattgttaattggcatattaattatacttaatataattatttttaaatcttttgggttattagtcctaatgacaaaagatattgatatttgaactttctaatttttaagaatatcgttaaaccatcaatatttttataaggaggccacttcacttgacaaatttctgaatttcctccaaagtcagtatatttttaaaattcagtttgatcctgaatccagcaatatataaaagggattatatactctggccaactgacattcatcctaggaatgcaaagatggtttaatatcctaaaatcaattaacataacatactatattaataaagtatcaaaacagtattctcatctttttttcttttttcacaattccttggttacactatcatctcaatagatgcagaaaaagcatttgacaaaatccaattcataataaaaattctcaaacttgaaagagaacatcataaaggcatctatgaaaaacctacagctaatatcatacttaacgatgaaaaactgaattattttaccctaagatcaagaataatgcaagcatgtcagctcttgcaacttctattcaacattgtactggaggttctagccagagcaaccatacaataaataaaaataaaaggcacccagattagaaaggaagtctttatttgcagacaacatggttctttatgcagaaaaccgtcaggaatacacacacatgttagaactaataagttcagcaaggttgcaggttgcaatatcaatatgcaaaaatacattgaaggctgggctcagtggagatggcatgtacctttcgtcccagctacttgggaggctgaggtaggaggatcacttgaggtgaggagtttgaggctatagtgcaatgtgatcttgcctgtgaatagccactgcactcgagcctaggcaacaaagtgagaccccgtctccaaaaaaaaaatggtatattggtatttctgtatatgaacaatgaatgatctgaaaacaagaaaattccattcacgatggtattaaaaaaataaaatacaaataaatttagcaaaataattataaaacttgtacatcgaaaatttcaaagcattctgagggaaattaaagatgatctaaataattggagagacactctatgatcactgattggaaaactcattcaatattgttaagataacaattgtccccaaattgatgcatgcattcaatttagtcttcatcaaaattccagcagggtttttgcagaaattgacaagctgtacccaaaatgtatatggaaatgaaaagacccagaagagcaaataattttttaaaaacaaagttggaaaacttttacttcctaattttaaaacttactataaacctaaagttatcaagaccatttagtactaatacaagatatatagatcaaaggaacagatttcagagtccagaaataaactctaatatttatggttaattgatttttgacaaaggtgccaagtcagtttgatagagaaaataaggccaggcacagtggctcatgcctgtaatcccagcactttgggaggctgaggtgggtggatcacttgaggtcaggagttcaagaccagccaggccaacatggtgaaaccctgtctctactaaaaatacaaacattagccaggtgtagtggcatgtgcctataatcccagctactcaggaggctggggcaggagaatctcttaaacctgggaggtggagtttgcagtgagccaagagtgtgccactgctctccagcctgggcaacagagcaaaactctgtgtc

SEQ ID NO: 11967 - DNA, 10103 bp, Human
ctcccaagctgtgaaccccttttcaagctagcactcccagcagccattactagtctgtccaggttcacacctatgaggaaacttgtgggtcaccttgatcaagtccagtgacctcctccccaattcctactctgctattggaaaaacaggggagcagggaagagaaagcattttccccagagtcacgcaactaaaacagccagggagatgtgattgaaaaccagcccttctgcccctctatcaggggtattcctggctacaaaagtcctaggggcagggaagtagttatggaaggaaagagacaacaaccagattgaccaaatgctctctgaaagccaacccacagaattgacagaaatctaactggggaggggagaggacaggacggttctgtcctgaaggctggtgctagagactccacacagccaccccctagctgagtgatcttaaactagcaccttatcccgtgttctgccggcttcatagatgatcatggaaatctcttaccaggctctaaaccatagcaggggcggatgggcagagagcaaggccgaggggactcagagggggctgctcctcgccccagggagcagggaagacatcttcgaaggcggctcaggaagtctgttggctcttcttgggcagggcttctggagaggaggacttcagagactgaccccaccagagatcccctgcaagcagtctctttccccaactccctccctcccccgctgaggacctctctccaaaaccccaaagacagagaatagagccagatataaagagaggagacagactgagaccaggagcaagagttaggagggagcctcaaatgctggcccctgggggagaagggccactcctcttacctaggtggagttggaacaggagacccggcagcctcaccacgcctaaggaaggcagctaggaccctcagcgtgtcttcccggagccccagctcttcagagcctgccatggaggcacctgtgagagagagggttagggactggactccaagggtttagcaagaagtggaggcttggggaccaggacttgtgagtcccaaggaaggtgctgagggcctggactcctgggtcctttggagagtgtgggtctgggggcctagactcttgagtcctcagacgaaaaagcgatcaggaaaaagactcttcgatccaaggaaaggtggtggggctgggtgcccagattcgtgggtctaaaggaggagggagctggggtcctggacttctgagtcttagagaaaaaggaactggagccccagacccttaggtctcccaggaagaagaggcttagcgccccaactcctggattctataagaggcatatgccaaactcctgaaacccttaaagcatcgggaactaccaatcccaagaggtttcagggcaaatcttcccctaggtccgcgcttcttcgccgcgcagcctgctgtgaggtgtagttccaaatctccgacccctgctggaatctagaggaccctggacccttggatatcagagaagcgggactggggtgcccaccactggatcccggccccctcctcttccctcctcaccccacccctcgtcaacaccccgctgacctggtccggggccccaccgccgcctcctccactcaacttgcggtctcctccactgaactcgtacaaactttattagttcaactttcccgcgcctgcgcactgggccgggtcgataaccggcccagcgtagaaagggcggaacgctgggtgcacgctcaatttgcatgtgacgctcccagcatgcctctggccggaaacccaaaaaagggcataggggcgggaacagcccagcgggccgtcccatcggcttttgggtctgttacccaaagaatgataaagttggttttatttcaagaagtcgatcaaaaagaaagccccagcgctctagagctcagctgacgggaaagggggtgcgcagcctcgagtttgagagctacccggagctccaagacaggggtgggttccagctgcccgcacgccccgaccttccatcgtaggtaacgcggaagagcccgggagagcgttggtggcgtccgagagcgaggagcgggaaagaggatgggtctgcacggagagtggaaaggcaggctgtgtactctggggaaagtggagcaaggaaggagctacagtggccgacgctggaggtcggctgcagaaaaactagaaaaagtagggaggaaagaggaaaagaggaggcgtctacactgagggggttctagagagggaggggtggactccgtagatgggggtagttcagtctcgaaacctggggcgtgctctgtcctggaggagggaggcgggcagtcggaggggaattgaatggaagttctgtgttggaaatgttttgggagatcttctgtagggggactgtggaagggggtctacattggggtaagtgcaggaggtagaggcttacacgtgaatcgattctgcactgaaataactagggaaagaggatgctaccctgaaagtggggatacttactttcgatgatgtgggggagggaggaggtctatactggcggaattgagggagtggagggtctgcactgaagacgctggggaaggatgtgccatggatatgggaaggaaccctagctgattagagagcctctcgggaggatgggaggatgggaagaggaggtttcctgtttgtacccccgaaaatatgggtgaaggacctgtgccgtggcccgtgagaaggaggtctgggtgcggaaactccaggccaggtgggtccgggggaggccggtcgcgcccaggaaatgccctatacgcgcaggccggaccatgggaaccccaaagccacggatcctgccctggctggtgtcgcagctggacctggggcaactggagggcgtggcctgggtgaacaagagccgcacgcgcttccgcatcccttggaagcacggcctacggcaggatgcacagcaggaggatttcggaatcttccaggtgcgtgcgacgacctgggacgctggaaacccggagctgcgcgctgggcggaaaggactcctagtgggcccggctgagaaggcggaggtggcgcgcgaggggcgggctcgtgccaacgctggtgggtggggctagaacgggaggggcggggctagccggatccgctgactgatggtggggcgcaagcagggttggagctgcagggttacgggaataaaaccgggaaagccggttagtacgcaaaggaaatgcatcctgggggtttggggctttctagaggccggggctcttggttgtaggatagatactgggggatggttcttgaaacatcagaggtgaggcctggagccccaaatctgaggttcctaactaccgaattagtatatgccagaggtggtaaacagtgtgaggggcggggttatcacagagggtgtcgcggggcaggtggtgcacgggattagacaccaagttggacttggaagcctggcttagaaagaaaaggtttttgggccgggggcggtggttcacacctgtaatcctagcactttgcaaggccaaggcgggaggatcgcttgagcccaggagtttgaggccagcttgggcaacataggctccatctctttaaaaacaaaagcgaaacaaaacaaaaaccaaagaggtttcaaaggcttttgaagaggccgagcacagtagctcatgcctgtaatcccagcactttgggaggccgaggaggacggatcacctgaggtcaggagttcaagaccagcctggccaacatggtgaaaccccatctctactaaaaatacaaaaattagccaggtgtagtggtgcccacctgtaatcccagctactcaggaggctgagacaggagaatcgcttgaaccggggaggcggaagttgcagtgagctgagattgcaccattgcattccagcctgggtgacaggagtgaaactccatctcaaaaagaaaaaaagccttttgaaaactagaggtgggggatggaggtaggtgggacggggggatttggggatggaccttgcagagttagaacttgccagggaaagagggtggtgttaggactcgggagacagggttagggccccaggagcaggatctaagtcgtcctcccccaccatcctgacaccactgttgccccaggcctgggccgaggccactggtgcatatgttcccgggagggataagccagacctgccaacctggaagaggaatttccgctctgccctcaaccgcaaagaagggttgcgtttagcagaggaccggagcaaggaccctcacgacccacataaaatctacgagtttgtgaactcaggtctgccagcttggggttcgtgtgggaggctggggccccaagggttcctggcactcctactcccctcaccacttttctcaacaggagttggggacttttcccagccagacacctctccggacaccaatggtggaggcagtacttctgatacccaggtgagaatgtgcccaactttcatgcccctcagtctccgacctgtctccatgggccttgtcctctccctctagacgatccccccactcccctgcctccagcctgcccctcacctgagccagtgctgaccctgtctgtccctgccccggtctcctcaggagaaaattccaagtcttcacccagcattcaaggcccgagcacaccttcccgggatttcatggatttcgattcgcagggggctgtcagcctcttgggaactgaaaaactccctcaccttgatcctgctgaggcccaagctgggggagcatcccctctgaaattctacccagcctgctttgcccaggtcttacctgcatagagccagatccttgggttggaatggtagcacctggcgttcattagtgtttgtttggctgttgatgccatggctggctctgtccccaggctggaagccccttgaaggcagagctcaagcctgacctccctgcgttgctgagaacagacctggtccatatgaagtctccagaaaaggatatggaaatgcctgattctctttttttgtttccctccaggaagacattctggatgagttactgggtaacatggtgttggccccactcccagatccgggacccccaagcctggctgtagcccctgagccctgccctcagcccctgcggagccccagcttggacaatcccactcccttcccaaacctggggccctctgagaacccactgaagcggctgttggtgccgggggaaggtgagtgtcagctgcaggctgggagggctgaggtctgggcggcagcccctgattctcaacccctctccccttcatgccgctgctgccgctgctcagagtgggagttcgaggtgacagccttctaccggggccgccaagtcttccagcagaccatctcctgcccggagggcctgcggctggtggggtccgaagtgggagacaggacgctgcctggatggccagtcacactgccagaccctggcatgtccctgacagacaggggagtgatgagctacgtgaggcatgtgctgagctgcctgggtgggggactggctctctggcgggccgggcagtggctctgggcccagcggctggggcactgccacacatactgggcagtgagcgaggagctgctccccaacagcgggcatgggcctgatggcgaggtccccaaggacaaggaaggaggcgtgtttgacctggggcccttcattgtaggtgagtgagacaggggcttcgacctggccagtacaaagcagcctgcacagtggttaacaactcaggattggccgggcacggtggctcacgcctgtagtcccagcactttgggaggctgaggtgggcagatgacaagttcaggagttcgagaccagcctggtcaacatagtgaaaccccatctctactaaagatacaaaaaaatagtcgggcgtggtggcacgtgcctgtaatcccagctactcgggaggctgaggcaggagaattgcttgaacccaggaggcggagattgcagtgagctgagatcgcaccactgcactctagcctggtgacagagtaagactccatctcgaacaacaaaaaaaaaagaactcatgattaggactgaattcagacgctggctgcccttggcccgctgtataaccgaggcaaaggactttgccctgagcccgtggaatccaaggatggtctcctctctctacctgcctgccagcgctggggtgagacacaggcccagtacacagagcctgctcagggaattagctgccactgtcatcatcatcgtaactaatgatggtgaacagaccaatagcaggaaagctacatcccttagggtttcgctgtgcagtggcactttctgccatgatggaaatgacagtcacctgcactgtccggtgcagcagccactagccacaggggccaagcactcaggtgaggcgagtgcaaccaggacgtgattcgttttaattggttacaatttaaactgaaataaccttacatgactaatggctgcaattggacaatgcagcctcagacaggactgaatgccaaccagcttctccagattcactgagcatccttgggagcatgggccccctactctgggcctgttatgaatgctgaggcttgggggcttgggggtgtggccttccaacaaccccaccctgatgggagggagggagggagggaaggaggggactttccccaaacaagcagtcccctggtcgaggcagcagagggccttaggtcaggggaggtggtgggggttatcattcaagtttacggggaagggtgggtagagggtcctcttctcatccctgactaggctcctgggcccccagatctgattaccttcacggaaggaagcggacgctcaccacgctatgccctctggttctgtgtgggggagtcatggccccaggaccagccgtggaccaagaggctcgtgatggtcaaggtgcctgcagacctgagtccctggggctgaaaggggtggccttacagagggaagaggttgctcccaggaactccaactcccagagggccctctaaaaaactgcaacttccaagatctctgcaataaccagtttttcatccccgggagctccttcccatggcctcacctgcagaacctgttttgaactctctaaaccagtggcccccaaactatttggcaccagggaccagtctcatggaagataatatttccacggacagggaggtgtggtttcgggatgaaactgctccactgcagatcatcaggcattagattctcttaaggagcagccgatccctcacgtgcgcagttcgatagagtttgtgctcctctgagaatctaatgctgccgctgatctcacagaaggcagagctcaggcagtaatattcccccacccgctgctcacatcctgctgtgcaacctggtccctaacaagccgtaggggggttggggacccctgctctaaaccatgtagaagctggtggactcaagttttagctgccattgtgaggccatggctgtggctcccaggagtcaagatcacagactgctcagccctgacgtgtgtgtgtgtgtgtgtttgtgtgtgtgtgtaaaactacaactcccagcagccctaggcctatggttcagttacagcagggggtgtgtgtgtgtgtgtgtgtgtgtgtgtgtgtgtgtgtgtgtgtgtgtgtaaaactacaactcccagcagccctaggcctatggttcatcctaggttacagcaggggctgcagggagttgtagtcctccaagccctgactcctaccttggtggacagtggctgggtgttttccctgactcctgtccccacttcccctgcaggttgtgcccacgtgcctcagggccttggtagaaatggcccgggtagggggtgcctcctccctggagaatactgtggacctgcacatttccaacagccacccactctccctcacctccgaccagtacaaggcctacctgcaggacttggtggagggcatggatttccagggccctggggagacctgagccctcgctcctcatggtgtgcctccaacccccctgttccccaccacctcaaccaataaactggttcctgctatgatcacttgtgcgtgtctggtgttgggtgccctctgacccaatatggttgttattcccgctcagggtctcagtttacccatctgtgcagctatatacaactcaggtgctcaatgcatgaagaccaagcactgcagggggcagctgacacctcctcacttctgcccagggacctggtgggtgatggctgtccccgtgttgtagaccaagacacaggctgggagaggcgcaaaggtcacagagtaggaaacacaaagactagccagaacccaggccccctgccttgcctatgaacagtttgggcaagtggtccttctccttccaggcctcaggctcccctccacgtggggctggaggggtcttggtaaaggggctctgcggccaccctggagcctgcaaagcctgcctgcctggtgaccctgggcactgtcacctctcctggttgggccgcagttctgggtgatgaaactggcagaagccagcgcagccctgactcacccttcggcccttgctgctctgtgcctcagtttccctctcaggacagttgatgagatcaccccagcttcacggggctgctgaaaagagaagccaactcaatggggaacacagatcctgctctgggagcaattccaaggcaggcacatggcacccaggagccgagctgggaagatgctgatcaggtggggtccggcccctgcctccctgtgagcagctcgctcccagccagagactgtgctaagtgctccacctgtgtcttgttcaatcatcacaacacccactacacagataagaaaactgaggcccaggggaggcagctgccccaagtcacagtctggtctctgtctcccatcctcagcctcctgggggtccctccccaaccctctggcaaatttgtctccgaaaacaaagggttagaaccatggggctcaggggtaatgtttcatgaaatctttaatgaaattggggagaggggcacaaacagaagggaggggcactggggacaggcttgggggcaagggaggtggacacggggcagggcagggcagggggctctcctcttccctgcagcaaccctcccccagtcatcccactgacgggggagggaggtggggaggtggagccataaatacgtccagagtttcaaagaggtgaggggcgaagagctggccagggctctcagagagggggcaggggcaggcccgggccacccttgtctgggggccctggctccttgggcggccgtgggggccctggggggtcccctggcttgcgaccgtgcttgcggaagtagcggtagcgctggacgtaggcccgcaccaggttgctcaccttcactgggttgatttccccacttttgctgtggcagatctggggggccggggacagttggagtcaccaccaggctcccggggccccatccacccaggactgttgggcgcagcttggaactgcggtaggaggagcttccccaataaccaggccaaagtccctctgtccccctagacgatgggtgccccagggccagcggaacaggcccaggtggccttgagaaaatcctgtcaccctcctcacctcccagactgacctcctccccgtctcccatccgcgtccatctgtctgcacacatctgtccctccagctcgttctctccccggcctgtgtctgcccctctctccgggtgcccaccttgtggacggccttcctcaggatgtccttgtactcctccttggtgatgtccttcttctgatagtatggcttgatggccagcttcacctcctccaccgcccgctcctgcgtgtgcagcttcttcagatactggtggggtggcgacagcgggggaagacacagcaagggccagtgagtacctgcggaacctccacctccactcgcctctgctgccagcctaacctctctggccgtccagctgctctcaggctggaagtcctgctgagggtctgtcccatgcgccctctgctgcaggtgcccgggaccaaaggccaggcc

SEQ ID NO: 11968 - DNA, 174259 bp, Human
ggtctagacatgaatttgatttcctttgcttcttaatgttcagtatttcacacaatagacattgatggaagaatgaacataagaattgtcaagtaatttttacaccactctctaatttatgcaaacactaacttctcacagtctgaaaatgtgaatttttccccctctgtgctttgatggctaacattctttttaatgacagtcatttctataacaggaagatgttttcatttgtatttacttttcagcgcgacgcaattatgcagttttgcgcttcagtagtgtctcggtactttgtgtctcaaaagagaattacagtacttagaacaggactgcaatttgaagcaggtgttgtgttttactgttatgcaaaataacagtaaaatataattgtgggagaaattaaggaaacagctgcaaacttggtatgaaaactgctacattatgatttgtaagcagttcttatagatatcttacatcagaggagcagggaaagattttaatttagttaatcctactggcctggttgtctatcatctggcgcttaaaagactcatacctcccatgaagtcaggaaaaagaaagagaacccaaagtgacactttgtttaaaatgccagagcacggggattcatctcttggcagtgcacttgacattaggaaggcaggcaaggtgggtgttatttagcttgctttgctaatatgaagaaggcaatgatttgagtagaacactctggaatttcttagcccagctagcatatgggggattactcaagccccgggttgtaaaataataaaataaatggcctatggcaggccatctgccttttgctcgatatttaaggtgtttcatgccaattttaaatctcatcttattattctaaatatttttatttgaaatagcagataagattctcagagcttaatggtgcacatggcaaacctattctgacgttgtgcacttaaagtaagagcatgggttacctaagggttacccaaggagtgtactacggcttcttctctaccgcactgatcaattgcaacaacttggacatgagaatttgcttccctcagcctttgcacacctaccataaaaatagacatcttcatttctcaacccagtgcagcaaataatatattgacatttatgaaaaaatcagaactaatggaaattttaaaaaatgaaaccaattactgagaattacgttgcaccaagaatgaggtggcagatgtaatggccgcccttctttaccgctccatcggggcttgaagaagggaggtaatgaatgcattcaaagtggtggtccagacctggaggtgtttggttttcccctgagtgactggagtgttgaaaaaaatgacactacatttaacaagaaagatttgccttaccataaggttctgggccagtgaggaatgccaagcattgcctacctgtgtattttgggagctgcttgtgaaagaaaaaaatatgtgtaatgtgtggttattatgtgcatgttatagtaatacacatgtatttgttataagcacaacattttaaattcttatctgtcattgtgttatatagctgctttaaacatggagctttcaaatgattacgtgacaccaactttgtaaagaccaaacattccaattagcagggcaggtttggaagattcttcacttggagcacaaaccatgtatagccagatgccatggcaacggtggatatgccccttccgtaattcacgctaagtgccataattataattaaagaggaaatcttagtttgaactccattgagaagatttgctagcacccagcaatatgtatagagtgtaatatccactttgaagtgcatgaagggaagagagttgggaacagttgtatccatgagccaacaacacatattcagattttccctgaactagtttcatgtctagatgttaaatttatgtctcttagaacaccctttttctctttgttctcattttatatacattttttttttctttcagaaatgcacagcggtattgatgagtagatccttggattcagaggttggctgaaacgcaccatgcctgcttccatcttttgctctgtaaagttgtgaattgctcatgcctatagggaggaaggatggcacatgggattccttctcaaggcaaagttaccataacggtggatgagtacagctcaaaccccacccaggcattcacgcactacaacatcaaccagagcagattccagcctccacatgtacatatgtaagtatcgcttatgaacttaacaaaattagcaatcaagaaaataaaaagaaaaaaagaaaagcattcactattaacttctgctagggagactaaaaggtaaatgatttacaaatcagatggatatctgtggtttcaaatacagctcaggaggaatcccatacatctgtgtaacatttcaaattttcagagcactttcaaccacaattgaaattagattttcagagcctctgaggactggtggttggttgcccctatttatagataagaacggaaaagaacagagaggttaaagtatttgccacacagcgaatttgcctgagactcctgacccctagttcaatttgctttacattgtattgcttgcctccattctgaaatatttctttaaaatttctgtagttttttttttttttcccacacctcaccccactagccctttacattcagctgggaaataggcctaattgggactaattgtccagctactgctagatccattgtcttgcctgttgctagtgaaacgtgtgctgcatgctacaggactcaaacaatatggggaacaaaggaataagggacagtggaacagttggttccaggaattgtactttcctctcactccctaatactatttaagtcatgttgaggtttaaactgtttaaggagcaaagtgtggcagaaacccagaggcaaggattttgcagcacctggttgcacatcaacttttttctggtcctctgctacaggatgtgctgggctttcagaagaagggagcaaaaggtcaccatctctcttgtttattcaaggcctggtgctcattctctatgagacccttccaatgtctaacatgagtctttcatagtaggactaaacctctttgaaaactattgtatagtcaagatagaaaggaggttagagctctgttgactgtttttaccactcctggaagaattgaactcggggcatgtccaagtcacaagctctttttttaggaattgttttacatgagcatttaaaaaaaaatagtaggacaccccaaatacacacacccccccaccctggaatttacaaacgctaaccaaacaaaagggtctttccattgactgcctggatattagtgtaaatactaggatgttgctttgcaagtatattctggagagcgagtcagttacctatgatgagatttctgcaaagcagccgttttaaagcagcatgcttgagtgaccaaaaaaaaaaaaaaaaaggaaaagacaatccttgtaagtggttactgctaaactatttgaaagaactttatacgttctttaaatgagaatatattcatgattatgaaggatcgctaacatgattttaaggaaaaatggataaagtttttctttgttaaaatagcttttctgaacaataaatatctgtttaattcaaatattctttttattctactgtttctatttacttgtttttcttcaaatatgttacaatatttgtgtaagccatactttagaatagcttcagttctgttttgctggtgttatgtttttgtattaaagaactacaaggaactttgtagatgctgtttccattcaagcaaaacaaagtgtgttttgcccagattccttggaaaatgactgctggggaacctcagcttagttctcaagtctgcagacatctgctcacttgttcttggcctcaagattccactggcgaactgtgaatgcacagagatattttaaaaatcatgtaactttaaagttgatctgcttttatctagccataacaaatttgaaggatcaaattatacctcttttgaaaaaaatggcttgaaaatggggcaacctagacagctgtgtagtgctttcaccagactcctgatcttggaatagaggattcttctacaggctagttccagtgtaccttttcacttttattgccaataagggcttcccatctgaaccctctgcttcagccacacagtttggctccctgtcatctgaacacatcttagcaccttccatcttggtgccattgccatcactgtttcttacagagcgtaacacatttacgctctgctcatcaaatgcctcaaagctagtttaggttcctccacttaagccttttctacctatccgtttccaatccaaaatgatcatgcctgcccaagttacttggcaacactttataccacctccattattatttttcttaatctgtctgtttctctgtctacctacctacctatctacctatctgtatctatctatctgcctatctgtctcttattcttttaattttttacttcttaaagaaaggcttgttcttctgagcaggtgacagatgctcaaaaacactggtcaattgatccattgatttgattatgcattgaatagagagaatagattgatgcttggagattttcactggaatttttctgtcagttcttgacattttgaatgttttcatgatggtacgtgttgtcaggaggctggcttaccttttccctggctttactctttcttgcttgagaacatgccattgttttgtaggcctgatggcctcacacagtgactgacctatggtaggtggtcagggatcttggttggatttaatcatgtcatatttctgttatgttaagaaacaaaaattggccttaatctaattagaaactttaattggctagaaaatatctataaaatatttagtctaaaatgtcttcagtttttctgaaaatttcaacatgtcatggcagaactttgctcctctccccgaggtaaagatattttgtcttttccacttgcgtagttgctcatttattttgcatgggattgttaaattatttgcttccttttttcacttacacttgagatttctgaagacccctgacagatcacttggattatagttaaaaaccctatccctttaatgatgtcttactttcttttctacagccttgtgatggtagttggggtttttcaccttaattaggaagagctcacttcccatttaattcaattagtctcagctcagctttgtgactaacaaattttcttttccaagtctcagtttactcatctgtaaatatttgcaccaaatgatggttaaggatctttttagctctgacttgctaagattaagattgcagttaagacaatgtttatttgcaaggcgatgctattaaggaaacaaaaataaataagacccagtccccatcttcatgaagctcattgctgatttcagagctgatgtttcaaacagctttaagaagcattggtttagttttcatctctgagttctgacaagattaccaccaagctctctaagaatgactggcttgaatctctgcttgttatggagggaagttttttttttttagaaagcaatcctgtatgaccttgggaaagaaaattaaagcacagctggagttggcagagcaaaatttaacctagaatttgtgtgcctcacttacccagactcttgagcatactaatagatgtgatgattgaagcccagcaattaacagggtttcatttttccacaaccccttcatctttcccaagcagaatgataagaaaaattatttagtatttttaatgatggtgggaggaggtgctgaaggagccaatgtaggtctgaaaacaccataaagattttgtatgtgtttcataatctgaggcctaatcaaatgttacaaaactttattagtagggtatccagccatttcagttttagcattgaaatccccgtgttattggaatgccataggacaataggataccctactcaggttaattcttcatgtttttctttaaggattgacgactagggaactcaaatcaagccttgttttcagttttagccactttccttatctgcgccttctgttgttaacaccccttgaatcttacactgcacttgttcttttaccctggttctgtggaggcaggttagcatagtggtcaacatcacctgtggaatcagattaccgggtttaacatttgcttgcaccactgactagctgtataaccaactgtgaatacatactctaacttccttatgttttatttttctatctgtaagatctggaccataaaagtaatgcctatctcaaaaggctgtggaggatagaaggatgaaacagtattacatgttaatgcttatacatacatagtctatgctcaataaatgttagctgttatcattaataattttttcattgattctgggtttttaattttaaactgccaattcatttgaaaagcagtggagtgtatacaaatgaataaataaagtcattgctaaatcttgtcctttcttcctcatggagctatgagcagcaaagagtcatggaaacttttctaggtgggattttggtttgtcagggttggcaagtgtcctggtttagtgcctttcaagattataaacagcctaggagtgtctcatccacctccagttactccacgggagtggcagtcccaaggcggggatggaatcttgtgagctgagtgctgactggttgctgtctgtggaatcacagtggccttcctccacatgagctggacctaggttctctgtaccccagtcagtttcttagacttcctatctctatctgtggttaaaacaaaaacatcaagcgctatctgtaattaaccaggattgagtgcaaaaggcacagcttgggctggggaatgaggacaatatacacatggtagctgagaatatggtctgaaatcagcgatctgtatacaaatactgatcctgccagttactggcgtggctgggtgatgatggaaaaattgttgaacctgtcttctcatctgtaaaataggtttaatgaccctttaatatggttgtgagcattaaatgaaatgatatataatgacatatagtgcccaaaagataccacttgataaatagattttatgataatatatatggtattgtctaccagctgatgagtatgagataagttgttaacattttcctttctaaactacttggctatatgaaacctgacaagtccaacttgttttattttgtattgtgtagtatctgtcagtgttgcttggccatcgctagttaaaaaaaaaatctgtagcttttagggtatctgggtgattatttcatgccaaagtactacaagattttgtttgtctgatctgagatttcattcttattcagttcaagaatgtggtaggaagtaaatgtttgttttagttctgtattagatatgcttacgtataaaaacaatgttacagaagagtgttatagaaaaggtgtcatttggctaaataactatataaaagtgtatggaaggataaataacattactggtgatttttagggaatacatttggaactgaatttgcaggagggagtgttggataaggaccttttactttttatttcttatactttcatataatttgaattattcttacaacaagtatgtaacacttttatgattaaaacttttttaaattgataaaaaatgtaatttgtctccaagtccttatgcctggcctgtaatatttgctttaaagtcttgatctgatgcaaatcttctattttcttttgtactcactttcttgggtagcaccttcttctattttatattgcaatcaaggaataggccaaaggctgttcattggttcagtataactcaacttgctcaagtgtgggaagatgagaacagtgttgcctacttcgtcgtcttataactgattggaaatttttaaagaagtatggtgtcacttaatgacagggatacattctgagaaatgcatcttctaggcgatttcgtctttgtgcaaacatcatagagtatatttacacaaacgtagatggtataacctaccatacacctaggctatatggtatagcctattgctcctagtctacaaacctatatagcatcctactgtactgaatactgtaggccattgtaacacaataataactattgtgtatctaaatatatctaaacacagaaaaggtataagaaaggtagagtataaaaaattaaaaatggtccacctctataggcacttacatgaatggggcatataggactggaagttgctctgagtgagtcagtgagtcagcggtgagtaaatgtgaaggcctaggacattactaaacactactgtaggctttataaacagtctacactaaatttataaacaatatttttgtttcttcaacaataaagtaagaaacagcttactgtagcttttttactttatacgctttttaattttttaaaacttgttgactcttttataagccagattaaaacacaaatacattgtacagctgtacaaaaatgttttctttctttatattcttattctataagctgcttttgtaccaaacttttttatttttatttttttgctttttaagctttttgttaaaaattaagacatggtgggaagggaatgaaggatttaaactacatgttggatacattgtacactactcaggtgatgggtgcactaaaatctcagatttcatcactataacaatttatccatgtaaccaaaaaccacgtatatcccaaaagctattgaaataaaaaatgtgtgtgtgtgtataaaactaagacatgaacacacattagcctaggcctacatagggtcaggatcattcatattactgccttccacctgcacatcttgtcccactggaaggtcttcaggagcagtaacaggcatggagctgttatctcctgtgatgacaatgccttcttctggaatacctcctgaaggacctgcctgaggcagccagggttttagttaactttgtttttgtttttttaataagtagaaggagtacactctaaaataacaactaaagtataatacagcaaataagcaaaccagtgatagagtcatttatttcattgtcaaatatgatgtactatccataattggatgtgctatactttataccactggcagggcaggtttgtttacaccagtatcaccataaacacatgagtaataagttacaccacaatgacattatgacagctaatgtcattaggcgatagaaaattttcaactccattgtaatcttatggtaccaccttcatatatgtggtctgtcattgaccaaaatgtcattatgcagctcatgactgtattttcaaatccatttggggaagctaaaagagtatacagtaatagacttcttgatagcgtttcagggaatctgcattctagtcctgtcgtgatcactaatcagctctgatatttagcaagtagggcctctctgaatttcaggttccttaccagccaatagacgtaatggtcttagcatcatctcttccccttttaacagtctgggatttctcctattccttacctttacatttgtccatgtaaaattaagaacacaaatcccacatcattagtcatattctttagggaaagaatataatagagacatcattgggatatggtggtgagagaagagaaatgacccctaacgctcacacagaggaaaagtcatatcagtggatgaatgaatgaatgtctgggactctgtaaaatggcacttactaacaaggtagaaatttattttgttacagagttgggctgcatttgctgttttaaaaaaattctaaacatacacttctttcttggtaagccactttcttattttcattacagattcatcactgtcctgcacattagcatggccataatttgtaaaatgttctcaatctgaaattcatcatagaaatgctgaattgtccttttagtttgcactttatatataaacactggatatttttattttcttctctcatttattcttaaaaatacgttctttttcctatacactccctgagggcacctgtcttgtggtccgtgacagttggacttcattttagagctgactttttccctattctgtacatttctttgtttgcactcaagcattaaagaagcaatctaaaattagatttgctttttgtccataggaatttgttcctagaaccctagctgtatgttgcataattggacagtggtttttgtttatttgtttgttggctacttgactttctgggagggtaaagaattttgatgaaataaaacaaatcctatcttctatgttatacctggattttgggtttggaaagttacctacatttgtagggataaagaacgactcatagagaaagcatagtcatcgtcaactcatagacatatcctgcaactaggagccatcagatcacctctccttacagactgaatctatctatctcctgctctaaatacaatttttgttttctaaacttctttcatggggatattttggtaaaaattattcaagtggcaagacaagccaaacaggctgtaatgaaataggtagtttgtgtttgcaacatactcgattttaattctaagctttcaaagcttatgaagatgagattttaagatgtagaaacaaagctaatgctgctaaatctactgcatcctgcacagcaaactctagattattctgaactgtttccaaaaaggagaagcttactgagtcttggaagatctattcatcagtttgtttttcttctttttcagtattgccttagctctttccttcccatgtctttttcccttttagactttcatagcttactggaaactagatgtttaagtagctatcctagcatggttagactattatttcaatatcagtatggacaaaactgctgcaattttgcagaccaccatcttggtcttctttttttttctttttttgttatttaatgtaaaaggtacacttagaagctttgtctgtgtggaaacactaactctgcaaagaggaaactctgttgaatttattggctcctgcattatttgggtctgcatatttttattctatttttctttgaagattggttttattcaatttctgtccctgtagaagggacaaaatatatgcaaataagaaaatgcatttttgcagatttttttatttttttcttctttaccacaaatcaagaatataagcttctctagttgatttacatttttgtgcaagtttttattaagcctcagagctgttgaaactagtttaaaaaaaaaaaaagaaaaagaaagctaacatcaccatggaatatagggaacagataactttttcacatttgatagtattgagctttaaaatcctaagtgagaattagaccattaccgaagttcctctgttggtagtggcttccttaaaaaactgcaggactctacatcaaaacatggactctactgaaactcacttatttctttgtacagactgtctctgaaaccttccagctcaaagatttgataattcttggattggaaaaatatcctttcctgtcttgctgtgggcttttttggcatttatactgattggctaagaaaagtggcttacttgtggtatttggctttaggtatttgggccaaggaccaagtttcaaaccttgtacatatttgtacacttagtttaaaatatgttttgaacaaagactttaaactgaaatcaagaaaaaaattaagtctcccaccagctaagcaagctcagcctgtttccctaatttactgaaagagttagccttcttctatgacataggcattttactagctcgtttaagtcctgagttttgggaaatttttctccagtttgttttattttgctttgcctggagacttcaaagataaccaccgaagcctatcaaactgtattcgattttttaatcataaaatcttaactattgctcttagcaccttttatttaatacattctatgtttaagaatgatacgacttttatgtactggttctgcttggatagtgctatggtttgaatatttgtacccctccagaatgcatatgttgaaatcctaactcccaaggtggtggtattaggaggtggggactttcagaggtgattttctcatgaggatggaacccttataaaagaggccccagagtaaccccttgttcttctttcatatgaggttacggtgaaaagatgcctgcctgtgacctgggaattgggccatcagcagacactgaatctgccttgatcatggactttccaatctccagaattgtgagagataaatgcatgtcttttatgagctacccagtctacgctattttgttaatagcatctcaaacagcccaaggcaggtaggcagggaatataatgggaagatgaattttatagagggaacaagaggagaaatgggcgtatttgtgaaggagagagggaaaaagtaggagggaatatatagcagatgtgtttgtgagatcataactcttccttgtcagttacgatgtcctgaccttgggcttgactttagcaccgggagcaggtcagcatccctagacttcagtcaacagggagatgagacaaaattgcaacttggctttctagggtacacgtgccgactcaatataccaatgaatctagcatatgaaaggatcaggatagcaacttttgatactttgacctatgttgatctctgagaaggaatgatttttggggtaattcaaaacttttaggcttgtatttcaatattttttaaaaaatcatttgacaaatagtgaactctgaactgactttcgagagatgtaagactatctgaagttgtgatttcccaaggttcgccatctgttagtatctgggagacttaccatatgttgtgctcaaattctgacttttacaggttaacttgttttcactttattcttcacccatacattttgggtacagccggtagcattgaaacctttcttgactcaataaacttagagagaagaatggtgaggaaagaacaaacaggctaggaggtgttgactcctaaaggatattaattcttaattcttccataatgcaattcaaaaagtctaatgctttcttcatgtaaaatacatgtaaaggcttgggtatcctgtttggtacagtggtgtgagtcctgttctaacccctcttgcaactgatcctcctgagaattcggaagggaaataataatcccgtgggagtctgtttgctccacgttgtgcccctcggtggtggtggatggctcccctgttttgcatctctccatctcgaccccaccacgatgttaatggctgtcggcacgctccactgtttatcttggaatttgatcccatcatcttggcaaccaaactgggacctttactgctcagattgtttgtcatttgttgttaattatctgttactataaattttgcactttgagaaaaaagggaatgttttgaaatatttcctccaacatgtaagtggagcttcattttctgtggacaaaagagaacaaaaaaaaatgagcccttttgggagctggttttagggaaatcaagtgccctggtttttcagatgggctcagtgagatcccactagtgcagccaggatttgcactgaaagaacctttgcaattcagcagtggtctaagacagaccattagtgacaggtaccccccattggagggaaaaaataatttaactttaaataaggggttttgctttttatcccaatctctttatgccataattgcgttttttgtatgctagggcctgttcccttcagccactttttaaagattattaatacaaagcagtccagagtgagaagtagcttctgcctgcctgtctttatgaggggtttattttgtcaagtgtagaattaaaatgagctgtctagtcattagtggattttagttctggtctcacactctgcaggaagggtcgtgccatgttataaacagatagcactgttttgcagggtgctgtaccacaggctgcaggaaccatggttgagcttaacatcttcataaaacggtaaacaaaagaacatgaaagagagagagagggaaagaatgaaggtttgtattttagagggagcatttgagaatagagtgactgttgctaagcagaaatctgggcaccattaacatatttaaaaatgaagtcatttgagaagttccaaaaagaaaaaaaaagtatacccagaactactactagtgtcttatctttatagcagggatcataatcatatatgcttcaaaaagtaatggtgagggttatagaagataatgcttagtgcccagtaaagcacttagtgcagtatctaaatgttccatgtatggtggctattattgttaataatattgtgtgtctttattgcctctaaaacattaacatgagcttctgcagttttaatagtgatatgtagtccatcatcactataagttttttcgtgcctttaagtttggtgtgtctgttttattcttgtgaagaagtttttagggttttgctctctcccaagggagacacagggagggaaggattgagtctctgttaacctggtagccaggggcagagacttaataaacacttagctccttgcctgctgcctgagacagtgtaactctcagtgatgtgtcttttactggagttgtggaatttgcttgggtgaaaatgttctcaagtttataggggttcatgataatagtgttggccctgaaataaagcaccatttctaaatattccactttcactatccttgtatgtcttctttctcagtgtttttcaaagagaacaggataagtgcttgggcactactttagaacacagattataatcagactttgggattaagacgtgtagccaatgtattaaattagtcacttagtaactgtttgagtatgagaataagaaactggagggaggagattgggagctggaaaaaaagcaccccctgattgctctcggggaggctgggaaaaaggatttaacactttggattttttaggagacattaaaactctgatgggatcaaattacttgactgcacatctgaaacatgaaactcttgccctaaaccgtgcaattgagttaagctcaaaattctaggcctgcccctaagactggcctctgggtaagcctcattgttgatcgcaaaatgatttcctttgagaggaacaagactacagtgaggtttttatggccaatttggtctgtgcattggtgccagccagacttttggcaagagttagtgccaactttggtgatctgtccaccgaatttttcccaaggtcttcaaaaccgtctggatttactgctgacattgaaggaaagatgcattataagtccagctttctaggcacacctcctgtattttttgttttttcaagtagagagatactgagaggtgccagagaacaacaggctgatccgtggccgtaaactttgagtcacaaaagaatgttgacagtcttcttcactaaacactattttctctctctagctttgtcccctttttagggagcccctgtccttctctctggattaggtgtccccttatacatactcccagaacctgtgagtgatactgtcctttggctgcacttatcttaaatatattcttgaattgttggtgaaatgtgtgtcttccactaggatataagctctatgagggcagtgaccttatctttttcgttttatttattttttgctgtctgtattcacaacacctatcacaatgctaggcatgttctggagactctgtcaacacctgttgaatgaatgaatgaatgaaagctgagtttgcaaggattcgaggaattaacatgtgcttccccaggaagtgagtgctgccttgtaatcactcattcattttgagagcatgtatgtagacttgagggtgtacttggctttaaaaagggtaacttatgtaagtctcccgtgtttttttcaggatggagctggatgaagctcagagtgagtatttctgatactcgtacactaatgctatcatctctgccttcagttgacttttgctttgacagtagtaaactctcatttctaacataggaaaaaatatcaaagcttccactttcaatgtgaccctagagatttgggttttctatattgttctttaattttaaaatggaggcatcggaaagtatattgttttaactccttataaagtgctcacttattgatcatatttggagtcaacaattatcggtcagaagcattaaattaattaagatatatttcagcccacttacctggaacgtgacaactgctcctaatatgtggagtttacttgaaatgaagaccatgaaaacgggtcatctgtcatcatgggaatcatgcgttttgaataaggcgaaccagtttttattctgtactctgatgtttaacgactctacattttttttttaatagtaaactcttaaaatttttacagaacaacttttttgacaaaaatctgtgatttgggttaaatacagataacaccgtcataacagtattggtatggcagtggttgaaaaccattcttaaaaacattgacttaaaggtaaaacaaaggaaattcaaagtaagtatgcaatggagttctaattgtgggtgactaaactgtcaacaccttgaaaagcaaatgatcaggaaaagatcctgctgtaaactgccaggcttaagaaaattttacatggcacagaaattaaaagaggggagatactaagaaagagaagtctgtatcacaagcacttttggggcaggaagtttttaatttagatgactgacttcaggttttctctctaactttccctgtggctgtgtctactaaggaaggtgttgtataattagactttctggagatgacctttggctgaagacctaattgagtctctggacttgagtgcagggttggagctggaggagctttttgccctgtaggtaaaggggctctgatggacctacgtctttgataagtacctgtagggctggcagtgacattgtttaggtaaattatggtttagtaattgaggagtcagtgctccttagtatatgaaaatctttctttaaaatagggaagacaccaaaatccacatgcgcaatttaaatgagcctgtattctgcattataaatatgcaccggatgccaagtagaaaaccggaacactctctcaggatgctgttagggccaagcggaatctcattagggacagcttcaaagatcagttcctcgcgtccataaaaacaagtgtaaattatctggtgcgcgcctgctgttagcagttgcggtgttgcattatgcatgattcaagactgcacaggggagacacaggctgcacggagttccacaatatatgtggggatttctctacccatttttttctttttggtgctgagtcctacattttggaaatttattggtgtgtttcagttaatggaggatgtcatatataactcactcttacatttttgatgaattggagtcagttcagagaggaatgataaggttctgaattgtttacatgaacagccacgctactcagatttatgtatcttgtttgctcacacatggagtcagattggggggcatgaatgcattccatgcacatagaattgagtgcatttgtttcaaggactctctccctcattttggtctcttggttagattttttaaaataagtgtgaatgctcagtaaattaagaacatgtagtcgagtttaacatataaggcttcaataaatagttttgtaataaatgcctaagggtctgaaaatatatttctgagcttcattgcctgaggagacagggaagcaatatagtgtttaagaacgtggtttccagaagcatactgccaaagtttgaatcttggtctccctcttactctctgtgcaactttgagtgagttacttgacttctctgtgttcttatccataaatgtgacctctctgtgttctcatccataaatgagggaagcaaatagtacttttctcaaagggccattgcaaaggttaaatcaactgctttaagtatagtacctaccaaattttctggggacgtagtaagttctatagaagtgtttcatttggtgttatcgtcatgatcagaggtagaagaccttccagtgcagctgggcatgactaggtatagaacacccagagcctgaatttataagcctatgtttgcttgaatggatagatatacatgaaagctgagggcagacaaagtcagggaatgattaccttggggtcaattagaagaagccactaaaaatacaaaatgcttagtagatgtgtatcttgccagcccaggtgactcacagagataaacatgagatcttgagaaaaggttaagacatagtagcaagagggagttagctttcctctagccagagtagaagaaagagtttgtcaatttccttttcccagttgtttctcaaggcctgttcccagaacaaagaagcatgtgggagaaagatcaaaagatcagccttacacagtgtctcatgacttaaatccatcaatttcccagcacaagttacctccattttgacatgtacattcgctcctataaggggatacccacacatagcaatattgccctttctagactggaagccctataagggcaggattgatgctggctgatcttgaatcctctgccttgtccatgattcagtaacaaattcatctttgacaaatcaataaacagtcttcaatatgtatttctcctgtcattttgtcctcacagtaaattctctctgaactcagaatctccccaccctctttagagttgcctctgctactaacatgcttacctaagcactagttaatggcctatcatgcttgcttcagtgtccctccttacagtttgctgaaattgcccctactatctcctgtcacttacttatcaataccttaagaatggtttgttgggagctctcattttttggcactaagtgattgaggctaccttgggtattctgtagaggtgagctgcgccagcattactgcctgacttccacctcctgtcagatcagctgcgacattagattctgataggagcccaaaccctattgtaaactgtgcatacgagggatctacgttgcttactccttatgagaatctaatgcctgatgatctgaggtggaccagtttcatcttgaaacgtaccccctcatacccccatctgtggaaaaactgtctttcaccacacctgtccctggtgccaaaagggctggggactgctgatctataggacagggagggaggaaatgagcaaggagagtgggatgtctgggggaagctgggtgtcattgaaaatgttacagtaaatcaataagtatttattagaagtagcatgggatgcagggatcctggttgttttgcttctcgttttatccccaatgcatagtacagtgcctgatgcataaataattattgatgaacaaattaatgaaggaatgttttatttggtttagcagtcaggataatatagaaccataaacccccaatccttgtctgctagcgtgtcttgcctgtttacagagacaatcaaatgcatctgaaataaataatatttaataaaataatcatgtgtgcattattggtaatagaatatcaaggttcttaaagtacttttgtgctgtactcactgtgaaggaaacagaagtagagaattttacgtatggcctactggcagcccagagaggttgagtgatgtgctcaaggtcaagcagaactgctggtttctagtacagaatgtgactctttatgacccttaataagctgtaggtgcctaaggaacttacagtttggggcacaataaatgctaactgagtaggagaagcaaggaagaattcaagaacatgtctaaaataagattttttgggcgtctgccttagttctactgaaatgctttacaatgttatttcctagtttttccctgtaggcatgcatcaggtttgattcttctcccaaacgtgaaagaaggtaggcttcccgtaggaggcagcctgtgatggaaagcagtttaaaataaacaggagcagctattttctgccctggaagatcacacattactttcatttcagaatatgtcctcctgtttctaccactcttttgtcctttggttcttctcaagtctggcagcatcttctggccttatgggctccagaaaccactgccatttcctattcagagcctgtgcacacttggacagcaattgcatttttgcttggttgtgggagttgagaagtatgtggccatatgctgtggcttggataatggcttacatttcaaacaagttaggtggtttctggcccactgcttgctgtgtgtggaaatgagcaaacctatatgcttctaggtcttttccatttggagacatgaagatgaaaggtgggatgcttcaacccagtacattttacaaagctcagtttgagtgtggttttcagatctgactatggtcgagtatcaaagatcaagggtaacttcaaaggcaccaccatttttgagaagttcacagaggttactgtttgtaaatgatgtctctgaccaaaaggaagtggtgttactgcacagaaaattgcttctgttctctatcattggtgttggcatcacttggtaggctactgaagtgcatcttcttctttagggttgagaaaccctgtggtcacaggttgctccacaaggagcacttttagccacaggcaattttccttttggaaaatgtggggtggcaggtgtaaggtatcacattaaacttctttatgttggactgcagctgggcccaagttggctttgataataaccctctttgcctaggttgctacgatctagctatcagtaaggctgcagccagactcctaggatgttggcacagtggctggtggctgggcattggtttatttgccagcattgagccagtattacctgttagacctttaaaaactgagcatctcaggacatactagaattcttccagctctgttgcttttctgggaagttcagagatggcatttggcagtacattcacatttagttgagactgttgaacttcacattaagttgaactattgaacttcataatgaggaaattatctaataaaagctctagtttttggtgatgattaaaaacagtggctctggaatgctcaagaccccaacttagtaggcagagaagttcataaaatacacattgtgcagagtccaactagtgaatatactggctgtagcagtatttatttcactgtagaaattatatatctatgcagtccatattgaaataagtgtgtgtgtgtgtatatgcacacccacatgaaggtttaaaattaaacatagatgaaaatgcttgcagaacactccttttggctatttaaaaaacaaataaaacattggacatgtttgcatgtgggttgaacacctcagctaacgattactcacacagttgaccttgttttctattcagggcaccaagaagccacgttgttaagcatattgggtcaacccagggttcacgttaacatcatttttctttctgtggagatgtaaaggtcttcagcctgattgttttctttttcttccacaccaggtggggggtagcatgatttttgcatgactatgggcctgctctataaataagcagattcagtcctttgttttaaatgtaatcagcaagattgcatttgcatcgcctgtaagtgaatcacataagtgaaattacattgcctgcatctcatttggtatcataaaatgttatgggatgcaggctgtttttctccaagtaaagtgtcttgagttagtattagggtgcttgctttcattttcctttgtgaccaaatttgtggcattctacggagctagggcttgtattttcacttatgttagttgctagagaaatacttgttcatgtcctctagaataagctaagatattggttcagtagggggtaaatgggagttttaagactatctcatgccgtgtagcaagtgattgctaatcactttctgtcgtttgtgacaacttctgcttactaagagtaaatgccagtcagtgttggttggaaatataaagcaatctgaagcttttcaggcagttggccacagaaaatggttaacatattttttttttttaaaaaaaaaacttgttagtcatcttttaagcaactactatgaaatacatatcttaattgaccctttaagaggtatccttaagacagaggactcagaagtcattgtaagattctcccacttattttcttgaaaacaaataaacacaataaaaataattactgacttcaaaagtcagtaattttggtgacaaatgagaatgctgtatttcatacaacacctcccctctcccctgaggttttcttaattcgtgaatgctggtggaagtcaaagcaaaggtatgagttcttagataacctataacacagtgtggttacccacaaaacatctgtttattagctacattattgataaaactccacaaggcaacaggcagctatagtgcccattatgccctttggcataatgtgaagactattttcaaaatagggcataatgtgaagactattttcaaaaaggaaatacatgtgaagactattttcaaaaagaaaaggcatgccagtcataatgatataccaacacagtgtaggtgcttgatacaaaatgccctttggttatttggagaggtattaaatttagtatgcctcacatggaataaaaataatttatttttgaaattatatttaaaaactaaaattaaaaaaataactttcaaacatagcttataattttttctataagactttgaaggagatacgcaattttgtgttcccatattatttaaaagaatgtatctaggaaaaacatttcattcggaaggagaagattgagtatagtttctttttaattagtaagcttttaattgacacatcatgcaagttaaaatgtatacaaattaagcatgttcatgcaataaatttccacaaagcaaaatactcatgtgatcacaattaactatggttttaaagatcatttttttgttttagtttgcaaaataatattatgaagtcataagaatttaaatatgattgcaatttacaatacatttttattaataaaagttgtaaagacctttgttactattgctctgtggtttacaaagaagataattgtgaacactgggatcccgttgggttcctatagattcccctgcagctgggtgttttagggcatagaattacatatgtgactattgtgacttttatttcaactggactctaaggaatacttttcattagtagtcatttaagatttcctggaagctcttctctgtgatttgaaaaattctctggataatatttccaaattgatgaccttctggagttaaaacaactttttctttggtctagctttaaagatatctttattttctattccattcatcaccattttttcattgaaaaaattaaccatgcttatcccacttcaaatgagcagctgcactttgaaactagatccttcttttggctgtaattgtccaaatgaggaggaccaggtttgtggactatttgaaaagaattggttgtgactcaaagcatttttctgctttcaatttttctcttcaaattttagtgtattcccaagccagaaaaaaaaaaagaaagaaagaaggaaagagggagggagaaaaggaagaaggaagaaaagaaggaagggctgggcaaggtggctcctgcctgtaatcccagcactttgggaggccaacgcagggttattacttgaggccagcagtttgagactaccctgggcaacatagcaagaccctgtctctatcaaaaattaaaaaaaaaaaaaaagctgagtgtggtggcacatacttgtatttctagctacttgagaggctgaggtgggaggattgcttgagtctggcaggccagagctgcagtgagctgtgatcagtccactgcactgcagcctggtggcagagcaagatcttgtctcaaaaaataaaaaataaaaaaaaaaagaaggaagcaaaagaaagagaaagaaaaaggggaaaaaagtttacaaagtacatataagtaaggcagttcttacctgggaatagctgaactatagcttttgaggaaagagaaagatataggatgatcccagaatttcagcatgagaacgactattgggtttgaagtgtgactataaaccactcagccagacttttctttctttttaataaatttaccagaataggtaaaataataataataaaatacatacaaaatatatacgtgtgtgtgtgtatatgtgtgtgtgcatgttctattggttgaccaattcctgcaataccaatatcactgaaaacaattgtgaaaccactttttgaggattgtccttggagccaggtcatgggcacataaagaaagagttcttcatattttccagccacagacattatctttactcgtatttatttatatcttcctagcaaggcccttagattccagttcaacacgcccaaggaataaaattcattagtgagttctcacatttgactttctccctctgaccatgaggctcttcttaccaggctaatgtttctttgattggatccctcatggtcattgccatgaagagttctcacatacatattactatagcaacttttcacttatcttcaaatatgttggactgactgtcagaatgttgacccagcagttgatccagatcattctatataaatgggaatatgggagacggaaataattgcacattccattgttaacagcaccaaggtagctggttagagatgtttattgattggttatttagccagtagcctttccttaaaagaaaacaaaaggaaactaacaatcataatggatggacatgtgctaaatctcataactagaaagaatatttgtaaataaacatgaattatagctctgtttattatacaatagtgagagctaataatttgccttgacataatagctgctttcgagctatcatgagtcatgaataaatgaaaatacctataaatttccaaagtatatttgaattcttatattttgcattataggaaatgatacattttctccaacaaagcgttttaattgatatctccagttaagatagaaatattctaaaacttactttaaccttataaatgaaatagcaaatacagctgtttcagagttttgatatatatattatatatatataatttgcttatttggcacagtcattcttttattcattcgctcattgaattcctgctatgtgccaggcacacaaacaaactgaatctagcactgtttaacaaaattgaaatgataatctcataaatgcattatgggggaaaatgtttcaatgtaatgcccaatgtatcagtcttgatgcaaaatttgtgatagcctagagtgtaaaactaacccccttatgattttgatttttttttattctgatgatcttttcctcatcttattgccctaacttggttcaacactgcttttggggaatcccttctctttcttcttacattttctggcctatagggtcatatggcttaagttagaacaaggagaccagtcaaaaagagccaaggcagacaaggcaaaatctacagaaatgataataatagtaatgataataaataatatggctaccatttattgaatgcttattgtgtaccaagccaagtgttaattgttgtaatatattatatcataaccctaggaagtgagtggtgttattcccattttgcagataagaaaaccaaggctaaaagaggctgccaagggtgacctgggttttacagcttgtcaatgacacacaactttgcctgaatctataggccatgctaatctgtcaaggaagcagtgacagacttgtggattaaaggtttggatttgactattttattttcttttccaaacaatgttcatgataaaaccatgtggaattgaagtcatgaagaagcatgaggtaaatgcaatccagacccacaaacatatttttgggatagttccactgattgagattctatagagaagcatgacctaggatgacatcttcactcagaaacaaatatggaggaattcattgtttggaggttggggaatggcatggagaagagcatattgggttaagagtcaaatggtgtaggcctccattccttagtctgtaaaatgagactaatactggttagagaagatggtctccaaggatccttacatttcaagcattctaagcttttaggctgaagttacttaaaattctttgtattattagttcccggactttccactgaaaggctacagggattgatgataatgcaggagagagtggcaaatggaaacctcactctcgtaagtcatggaattacagaaggaacactcaaggctattaactttcagctgaacatctaaaactgagtggaaaaatttaagaaggaaaagattttctctaccttgaggaatctttggcctgtggaagaaagagatttcctaaaagaacatgtcagtatgggagtattaaaaaaatatgtggagactgggctggaatgaagaatttgagattccaggggaatgtgcagaggatttgtttttttcattggttcatagacatactcattgtattagtccattttcatactgctatgaagaaatacctgagactgcgtaatttatcaagaaaaagaggtttaatggactcacagttccacacagctgggaaggcctcacaatcatgacagaaggtgaagaaggagcaaagtcatgtcttacatggtggcaggaaagagagcatgtgcagggggtctgccctttataaaaccatcagatcttgtgagacttattcactatcatgagaagggcacgggaaaaacctgcccccatgattcagttacctcccactgggtccatcccatgacacatggggattatgggagctacgattaaagatgagatttgggtggggagacagccaaaccatgtcactcatctaagaaccatgtgaacagtagcctgaagtactctaggtctgaaaattcctagtttcagccttgccactgactcacactttgatattaatatctgggtctcattttcttatctgtaagatataaagtaagtttctaaaactgctttctggtgccacaaatctgtgatttggggtatcttgatatcactatagcaagagagtcacagtgttgaggtggtgtttggggtgcctggactgtcaagtggactgagtcctggctgagtgaccagttcagaggacatggactaaaatagtttccatgaggaggaagaaaaaaagtccaacattaggaaaataatttgtagttgagtgagaatagtttgtcctgtggggtgaattaagtagatgatggtaattctgctttcatataccatggcatctgggaaatggtggaggagacagaatagtctaaaccagcacagctgtggaatctgggagactatctgcatttggggctggtgtgaattgtgggtttggagaggacaagaaatcacaatgagcagtgtacttagagaactgatgtcagagaagccagcatgtgacgtcaggcctaaggacagacacacgtggggatcttctaacccaaagaaaatgtggtgcaggctgggcatggtgactcatgcctgtaatcccagcactttgggaggccaaggtaggcagatcatttgaggtcaggagttcaagaccagcccggccaacacagtgaaaccccatctctactaaaaatgcaaaaattagctgggcgtcgtggcaggcccctgtaatcccagctacttgggaggctgaggcacgagaatctcctgaacctgagaggcagaggttgcagctgagatggtgccactgcactccaccctgggtaacagagtgagactctatctcagaatgaaacaaaacaacctctaaaatgcagagcaagtggcaaacatctaatggatattttggagtttcagagcaaaaattttaaaacaggagactacccttcaaggaacaggacaaggacatactgcagtccctggagttgtggtaggatagcaaagcttaacaacaggaaagaggcagaagcccatttactagaattgaagtgaaacacaagcagtggcagacaagcagaatgacttgtctctgagcagtgtgaagcctgcattaggatttttctgagtgccacctacaatcagggtgggtttaggagcctggccttggactaaactgagtgatgggcataaagttgccacggctctgtgtaggggattgacatgagggcggagaaccagtctctgcagttgctgagaaattcacaaagtacccaaggactctaaattgggcaggctgcctcaagacaaaccaagaagtctaggaagagtgtactttttgttctcagttcttggtttgcttcatgaagttaacaaaaagaagcaatagtcctaggttcttaatctctaggtccttgaccttatgcttacgattatttacactcataaattgtcagtgcaatatgactccctgacagcttcctcctccttgcagtataggcttttcttcttgttgacaataattctgcaatccttacactctctgtgccagagatggtgcttggcattgtaggtaccatgtttaacactcaaagaaccctttgaagtggctgcttatccctcccgcatgtggcttgaatcagaattcaggcccagctcttatcctgacaaagcccattgttttccattaagccatcctgactttcaacttgaagcagtttctttcctgtttctcaatcttgttttaacaggaacggtgaagattttcaaaattccagctactgtgcctagaagtgcaaaaatgctcttttgtatttgcttaacctttaactgcttaaaacaaaaattcgtgtttgttgtttgtttgtttgaaccataagaaatgcaaatgcaacttagaagttgttctgtaagaccacacaaccatttttaaattcaaagacttagctttgaatcttggatttttagatgatggtcatacatgtgcatgagggtgttaaaagagccttggtaattgtgatttctgatttcagtgttacagtctatgactattgcaagttctacattgttttttctacctaatgcttgcccttctgccttcttttttaaaaaagaaaatataatgaacgtggtctgttatttaaaaagtgtgttttatggtgcagttcatggcaaatggtgttgagtggtgatggaacagtgatttttggaaataaactgagtagggcaagaggagaaaagaaggaattcacatctgcacccttggtttgcattggaacacaggcagcagaggtgggtgggaggtgtttgtgctcttccctgtgctcaccgtgggtggccgggcctgtcgagaacattattttatttatcctagaggagttgctgtaattgttgaccagaactactggcatttggggttcacacatcactggactcagggtctgttggcatttgaagagtaggactcatggtgattcttacctatcgtgaaaagtgatgtacctagttcccaaaatggcttggtttatgaccacaggcaggccccatccttagggctgtgtgtctagaaatcttgtctgggcctgacagcttaaaagcctttggggggtatagcaaagggaaatggttaagaaaattgtgacaaaactaacctgtgaaatatcccacagccagtgaaaacgtttataaagagtctgcagtaacatggaaaatgctgacgttataatggtctaaacggagagagagagaaaaaacaaaacgaaacaaaacaaaacaaaaacagaaagaaagagaacccagaatataacattttgcatgcagaatgattccaattatatttttaaaatgcatagcagaaagatgaaatggaaagataccaaaatgttactagtagctatctctgggaggcagaattatgggttcatctttctttgctttttatatacatattcttaattttactaacgttaattatccctaactttagtaagcatatattacataactagggtaaaaaaagcattttcacagtaaaaataaaacttcttatattttggggaaactcccgtttgtggatcggggaaatttgcttgtcccttgccattctggcttcgcagatggctcctgtttgaccagattaacgcaggacattgtgttcaagaacacctacctatctgataggagtactgaggtgctatagaagatgacagttttaatagtaccggatgaataataattttaagagatggaattgacttatgaagtgtaaaatgacatgatttttttcccagttagggtgtaggatgctttattatctgtttgtgagagacctgtatttggaacacttcatcaaggagtgtgttcaggttttttcaacctagtgaaattagggcaatcctgagaaattttgcagaggcagaaaaacaacaaaacaattccagtaattatgggtcatttataccgtgctcagtgcattctcattacttcttcttcataacatccttatgaagtatttttacccctaacacagatgtgagaatactgaagtatgaggttgagtaacttgcccatattccagaggttgtccgtttgtgtatttgggatttaaatccatgctgtttgtctctagaacttactatgctcataaagtttgctggggagtctagaaaacttcatgcaggaatttatattaaaccatctgtttttcttttaaacgaaataagagatagaagcaaataatacttggatcagtaaaaacacctgacaaaagacagcacttttcagtttgtagtgtgttttctttttgacagtatcaaaatggaccaaactagaattcataaatttattagatattttaaaaggaatttatttgaaatcaggagaaaacttacaatttttcaacttagcattgagtttgtgtagacaaaagcattggacagggagggactataggtaagctgaggaattctattcctcttataacagaggcctcatgatttatagcatctctgactatggggaaattatgtaaccttgtaagtccagtatttctcatctgtaaaatgggattaataatacctaccttatagggttctctcaaggaatggatgaggtaatgttcataaagtgcttggcatggtgcctaagcgtgggaatagtgttcattgatgttagtgattatttttattactgggggttaggaagtatagagtgtggatccagttctgctgctaacattggccatgaacaagtcactcaacccttcttgttcttagactccaatgggaataattacaatgccctttttactgataagatgagaatgaattgaaattatgtatgagtcaactttttgaaaaagtatgaaagattctaccaatatacatgataaagatggaagggaatagcaggcaggtcagaggggcaaagtagttaactttctttgggtttaagtcctaactgggacttaaacacaagtccagtttgcatagaacaagttgagtgaattatactcaatcacttgtgagaaaacactgtaactcagaaacccagcattactgctaccaaattttcctgatgtttggcctctcatcatgaaggggcctgaactggacctggcgggagattttattgcattttttccccaggctgtgctttctggttagtaaagtgtcccggacagacctggctgaggttttactctttcactccggaatgagaggagaatggaaatagctcatttcttcagccgtgcaagccgtggaaacatcaaatgtgtgtgtgaacttgtccatacccttcaggccaagtgcttttaaaaattacctgcttcctaaattgccaccagtgctctgggaagttttgctgtggtaaactcccatcaaaattcctgactattctcacatcccctctgcaaggccataatgggagtactgacgggctttggctctggaagcaaacatttaagagtcagggcaaacaaagaaaaattatattctagtcctgctgcactcattgaaatgggttcaagatactcagtgtgtttcctagtatagatgacatgctacagcaggggtgggaaagacacaatgatttctttggaaccaggggctgatttgttgttggagattataaatcttttcactgactgtttctcaggctaccattcaccctagattcctacaggaatcacattgcctccacggaacagcgccagccccagtgctaatcaaatttaatctatcagcgaggactgctttcctacaatggacattggggggcattgcccattaaaatgttgagtcattagcactgtcttcaaagcaaatctgaaggcttgataggtgctactatcttattattattttaaaaaagcaattgatatgggagtgggaagaggggctgatttgaacttaacatgcccccttggccacccctccccaaaagatgatttaaaaacaagcagtgagccagagaattttcaaggctaactttctcacgtggaagagaaaaattattgcaatgccctttagctaagtacactcacttcagcctttatcgatgacggcagtcacgtgtgcacctcttcatgaggaagagagcttgaaacaatcacagggcagaacctccagagactagagctgggatgagctctaatagtagggcacagggagtacctgtgaggtttttgtttttgtttttaggagaaggctttttgaggaagtaatcttcctgcccaaaattgaaagttaaatcttttccatcttatccatcattgctcttaacagagacagttgatattcctgagttataggagacctgcaagtctctacagtaggcaactttgtagaactcatatgtatagatagtgggccttttacagtttagcattcacttgagcatatgaaggaataaaaaggagcaaacagatgggattatgcaaacatggtgcattaagagtttctagtaaacttttagcaaatgttgacacagaattgagaattatctgaagtttattctcctgtccaaagtatccaagaaagcaattgattggaaatagagcaggggaaattttgatgtgaaccataacaagactaataaaatgtagaaatgacatataaccaggtacagaaagaaagcagttacgtccaggataagagcaaggatgtaattggctttgtgtgttattttcatgtgtgtatagggatgcatatgcgtacacactgaatgggagctaactgttaaagtatgttgtataaagttcgatctgtataaaatgtggtttgtactttgaactcatatttttttgttgcttataaagtttagaataaaataaccacttattcctgaagggtatttgaactggtgagtagtcacaactgtagtcatgatgatttggtgtctagatttttatgtaaattggtacctggataatgcattcctatttggctttagtaatcttcatacaactgtgaagtagagaggcacaagctttaacaaatttagaaaaattcaggtcacctgacaaacgcagtgtccccctgggaattaacctctttgtaaatttggcactatgactcacctttgttgatcctttcatgactctctccctcttcaatttaaattgtttcttttatgtctaatgacattactccagttctttgcttggtgacctaacctttcaagtcccaggtaaaatgcaccttcttttgtgaagatctacccatttttaaatagaactaatttctttcatcaatatttctcatagaagaatctcaataatgatggctaacacttactgagcattcgatatgcactgggccctttacaagcaatagttacttaagctgggcatggtggctaacacctgtaatcccagtgctttgggagaccaaggtgggagaatcacttgaggccaagaattggagaccagcctgggcaacatagcaagtccctgtctgtacaaaaaatcagaaaataaaaacaagctgggtgtggtggcacatgcctgtagtcccagctacttgggagactgaggtgggagaatccctggaacccaggagttcaaggctgcagtgagctatgatcgcacctttacactccaggctgggagagagagagaccccgtcagttaagaaaaaaaaaaagatagttacttaatttttgtgttgatagtcaatcttatgaggcaagtactattattatccctagtttatagatgaggtaaatgaagctttgagaggtttagtaaacttgtccagagtgtcatacccaggtagtgggaaagccatggtccaaagccaggtcttgtggattctgtaagtgacctcactgtttgctgaagtgacctcttaatcactttattctttctccattctccctccccagtatgtacataggtatatataatttgtggtcacattgattacagtttggtatgtatgccctcccaaatgaaagtgtgaggttcaagatagtaaaaatggcatcttcgtaacctctgcaaaagaataatttttttaaaattgactcaaatacagatatgcaaacacctgtcagaaaatttacttaggttgttaatgaatgagggaaccaagaaagttgttgtaacagatttgtagaaccatgaatttatatggaataaaaaaatgctgaaattaatttgcaaatggatcaaaagtggaggggaagtcgattgaacctccactggacataatttatttgcatctgtagacaaaaattatttgcattgcttttcattatctataagttacaaagttatacaatacaaagaacataggctcatggtttagataggccagaatccagattctaacttccaagcttaatgtttgaccttaagtgaagtttggagaattcagaatatcacacacacatagccatacacaaacatcacacagagattttgagaagattaaaggtaataatttagaaaaagcccctggcacatagtaaatactgctaaatattaggcgtgattgttagtagtaataaagcttctatcagagctctaacatttagttattgcttagtaaatgtttgttgagtgactaaatcaggagtgaacaaacttttccctgttgaaagagttctggacatgccactcctgttgtagcacaacacagtagatggtagttctctttgttagtgtttgaagttgcttaacactggaattgcagttagacctagatttgattctcttctcagccatgtactagctgggcaatcttgggcaagtcaacccatcatgtctacaacttggatatacaaaccctgtgaaaatcatgaggaaactatgatatactctgccaaggtagtaagtatgcatttccagagagggaagaaagtagtctttcatgagttctttggttgagtgggaactatgtgagttttgtggctaaaaagtgaaccagccatttctgcaagggataaagaggtagggtaaaatagttctttattgttacaaaaccacctccagagaaacaaatattaagtctaataattattgtattgaattaattttgaaaggtggttaactgttgacatcatgttgtcttacaaataagcatttgtcttcaaactcacataaatgatgtcccctatgtagtaaaaaatggtctttttgtcttaggcattgatggttcttagaaagtaagtttatcaattcaactcaaagttgggaaaaaacaatacagaccattaaaagccaactaaaatggccacacactttaaagaaggcccattagccatgcaaatatgaagtcacctgcacttccaataagcacaattaactaaacaatgaagcccattaacaactacttgtgggacattaagctttggggaactgggctttgatgagttggaaaggaagaaaagacagaatttgttctcaatttgggctgaattttaataaaaaagaaatcttgtagagtcagttagggtcagttaatgctctttgtaaaccccactcccaactctctcccctacaacattaaaaaaacaagctcgtgtgtttgatggctcttaatgttctttctactggagtgagctaagtgaagacatgtttgaggccgggcagtgtttggaaataatccacattttgttcatgatgttgtaatgattgatttaaaactatgattttaaaataatagttttaggcatgtctctattgttttttccgaactttgggttgaattgataaacttactttttaagaatcagttgtggccgggcacggtgactcatgtctgtaatcccagcactttgggaggccaaggcaggcagatcaccagaggtcaggagttcgagaccagcctggccaacatggcgtggtggcagacacctgcagtcccagctactcaggaggctgaggcaagagaatagcttgaacctgggaggtggttgcagtgagccgagaccgtgccactgcactctacctgggcgacaagagcgagactctgtctaaaaaaaatatatatatatatatcagtcatgcctaaaactatgtgtcccattttagaacagaatctgctcttagatctctgtgtgctgttttgtgtaagaggagattgtagaagctggagtaaagcagacattgagcagtcatactggagcagagccaccgcctatccctgtacctttgccctattgcttaatctgagtctcagtgtctttgtgtgccaaatgggaaaaagagcctatcgctgtaagggtcaaatgaaagtgatccatgtaaagtgccctgtacagtgcctggcttctcaatgaaaactgctgccatttctcatcatcatcatcatcactattactctattcagccaaaaaatgatgttcgtgtcctgatcagtggtatagatggctgtaagatagagctacgggagactcggtgtaggatgttgtagttcatttttgactacttctctacttctcccttacagtagacatttatgtgattatcatgatggtttctgtttacgataaccatcaatttcctgttgccttcacattctctcctttgtattttcttctcaaatggatttggttttgtcactatatacctagattcttagcaataaattacaaaccaacctttcctcaagaatccccccacctcccatcctgtagggagcaaccccacttttcctaaaattcagctttccctgtggccctctgttcctcttactgggtagagggagaaagatgttttccatgccctccaggttcaagccccatagtctgactccctgaggttcagaccctaatcccgctggcctttcaaatcttcttctgctcaccttcatagtgactctgcttctgccatgcttgtttactcacaagtccctgaacatgctaagtgctttcacaccactcttaatagttctctagatggccttcttcctgagtttccaagtcttgtgcttattttaattccaagtgaggtcccagcttccggccactctcatgcgtcttttttctgagctcctaatagtgccaatcctttgtctcgtgcatttgaaatcgacatactaccttgtgttctgtacccactgcaatgttacctgtccttcttcctagcccataggcagtgctggatattttttccttttactccatagcacctcaaacattcttaattataacactttgtgcattatttcataaatcacctatttacatatcacatggaccatctcagactggctggtagctgtctctccagcaactagcacagtctgtggcccataaaaggtgctcaataaatgcttatgaaatgactagatgacagagcagctaccaggcatgttcgtaagcatttgttgaatagtaaattggcagaatccttgagggaaccatctttattgcttctttgtcttctttatacataccagggtacctggtacacaggtaggtgcttaagacatggttattgacctactgcttgaccaactgacagaccaacatactgtgtggaataatgggcactcagtacagtattacatggctttttttctcaaatgcaaggccattacccagaattttaagctgattaacgtgattgccatgttagaagggagggaaacgtttaaccctggacaatacatctccagtgggatatttatgacccagcgatatgtcatctgagaggtttcagtggctgacacggtagttagcctgatgcacataaaaacacctcagatggcactaggagaaggaccatgaattcatattgcatgcagtgctcaaagaattaaattgttaccacttaacattcattgaatgtcggcactgtacttttgtaagaggaaaaaatagaggagacacactccgtgcagtgggctttgttagctataattagttggtaatagaacagtgttgatacagcagttcagcagttaaagaaaagcagtgcctgtggtacaaatgtgaatatctttatacatctggttctgttctgcttactgtgtttcagcaccattactgttctggggcataatggctaaactaagaattttaccagctcctagtttaaaaaaaaaaaaaaaaaaaaaaagaacaacgccatttctggaacgccttagttcaatcacatattctgtcatttttgtttttttgttataactggaattctggcttctttgttctctgttggaatagatatatctagaagctcagtctacagtcgtaaattgcaatttcacttctctttatttaaagtcttgctaattctgattatatgtggatggatctggatggcatttatctttgcattgtctgggaaagcataaaataaaattgcaaagagaaaaacaggtttggagtgacttcagaacctgaattgtttctgctctttcatcggtaaatagtggtgtgtaaactgtgtggctaatcatggaactttggagtcatttggtcttgcctctcttttcacactagagggacagaggctagaagatgggaagtgacttgcccagggtcacacagctgattgatgatatatgtagtaagaacacaaaagccactggattccacagccagggctctttctaatgagactcatcagtcaactgaactagtccctctgaagagacctgtatgtggaagcaaaatccatatgtgcatgtgacgtgagatccttgagaatgaggaacctttatatctttatcagcattttaaaaaacaaacttctgtattgttcactccctgtaatatgcatttttttcatttaggagacttatttttatttttttggtaaacttaggagacttatttagtttaggagaagtcattacttcacttctcatgtaaattatccgtgactggatagagagcactaaaacttggatatttttgacaactaattccaataattttggactgtctctctagatattaatggttgccagagttaggtgactgatttgccagtattttgtcatttttaaaattatttttattctccaagtgcaggtatattttagcttgcaaaattaagtgggtggaaagataagtgaattgaaagttagaaaatctgagttctacttatggctcagattcttcatggtaaaatgagtcaatttaaaccagatcagtgttttccagagcatggactatgtatcattagtattaataagcaagacactttagaggagacataccttaaacaaaaattgaacacttacatgtttattttattttatttttatttttatttttttaagatggtcttgctctgttacccaggctggagtgcagtggcacaatctcagctcgctgcagccttgacctcctgggctcaagtgatcctcttacctcagccttctgagtagctggaactataagcatgtaccaccatgcctggctttttttttttttttttgtatttttggttgagatggggtctcgccatgttgcccaggctgatttcgaactcctgagctcaagcaatccacccaccttagcctcccaaagtgctgggattacagacatgagccaccgaacctggctcgtgtttattttaatgtgttactacacattaaaaaagtaaaaccatcatatctgactgatgacttcaaagatgttgtttttcagggcaaaactaaaaaatatttctgtaaaaactattaagcatctaacaaaaattaaggactagtacaagtgagtaaggcaaaggccatgaagatgatcctcaaagaagtggaacacaggatcagatcatctctaagttcctttaaacataaaagttctgtaattctggtaacttaaacctgttatttatttgttcattgttgtgctggcaggttttacttgtctttatcaaatagtatgtccaggttggatgatagaacatcacaaatataagtttagcattaatgctatctaaattttctgggtgaaaaggaaagccttgatatcacattggaaagtttttagagataaagtcagtgggccaggcaccgtggctcactcctgtactcctaacactttgggaggccaaggcaggtggatcacttgaggtcaggagtttgagaccaccctggccaacatggtgaaaccttgtctctataaaaataccaaaattagccaggcgtggtggcgcatgcctgtagtcgtagttacttgagaggctgaggcaggagaattgcttgaacccaggaggcagaggttgcagtgaggtgagattatgccactgtacttgagtttagacactgtctaaaaaaagcaaaaacaaaagtaagaaaacctcagtggaatccataagcacagcctgaggattttaaagtggaatgggggttgctaaaagcactgaaatccctttaaaatgctttgtaaggatacagttctattctctcactgaattataggttgattgtatacacaaaggttatactgcacacatggtctaaagaagaaatccatgtcacaacaaaccacatgacagcttttctgaagatctaccaatgaggtttgcaatactgtattcatttgttattggaaaaacaataataaatatggccggaagaggaatcagaatggaagccataatattatcatattttttgtgagtaaaaaaaccctaatatgtcaagactgaataaacaagaatggtttatttgtttgaatatgcagtgagatatgtaagcatttgatgatcaagcttcaagaacaagatttgaggcttggcacaaaacttggaaagttcattggaaaatggtttaagatgatagctcaggccttctctagaaaaatctgccaatttgttcagcagtgccacctccccatggcctgggctagcatctgtctttgatgaacagctcattggttcatgaattcacacagaccatgaattctgacactacaaagggagggattctccccagtgaaattgtatctgggaggaaatagccttctgaggacattagacatcttatcacacaaggaaaaatggaagaaactgtagctactccactagagtggagatgatttccggggattataatagattgttttcaaatagttgaagaactgtccaatggaaaagggactgggttcttattttcttgttatttcagagtgcagaactaggattaagaaggagggacaggcaggaaataaatatattaaagaccatggattccgctcccagtatatgctgggtgttgtgtatgtgatttcttttaattctcacaaagtccctgagtgagtggtagatgttattatctccctacaacagaaaaagagatggaggtcatagaagttaaatgatactactactaatagtagtaaaaatactattagttactagtaaaaaaaaaatactaacatttattgggtatctacttcatgtcagacactgttctaaatgctttgagtacattatcattttttattctcataacaatcttaggagataggtactatatttatatctgttttactgatgagggaaccaaggcacaagggttaagccccttgcttggtgttgcatgttaataagttgtggagtggatttcagagccaggcagtctggctctgcagccaaacatccttcacccttacgctattctgctactctatttttggagcatttgttgtgtgtcagatgctgtacttgatagtttgcatccacatagcaacacagaaaattaggcattattattcccattttacagatgagaaaaagtgaagcttaaagaaatcaaggaagttgcccaaagccaatgactgacctaaaattgttacttagtcttcaggttccaggccaaagtctttggaccatgctcagctttctcagaggtacagaatctgaaacagaactttctaacaagtaaagctatgaaaaaactaggatgggttgcacagggggaggaaggagctctccttctctggaaacctcagaatgaaaattgaagccaggtgggggtggctcacgcctataatctcagcactttgggaggctgaggtgggaagattacttgagcccaggagttcaagactagcccaggaaacataacaagacctcacctgtactactgctaataacaagaaaaataagctgggtgtggttgcctgtgcccataatcccagctactctggaagctgcggtgggaggattgcttgagcctgggaggtcgaggctatagtaggctatgattgtaccactgcactccagcctgggtgatagagcgagatcctgtctcaaacaaacaaacaacaaaagaaaaaacaaccaacaaaccaaacaaacacaaaacattatgtcgtctagagggaagggatagaggagattcagatgtcatgtaaaacattgaacgagatgccccataaggtttagtcctgctttgggattttatgctgctatgtttttttctcatcttcccatgtcaccttgttgtcccccaggtgtactcaaacatatgtgcaaatatcactctaatatttgaatctggctctggggtttagattgccttggtaagatactcacttgctaggatatttgacacgatgccttaggggaaatgttaggtcatttgagaactcagcagcataaacagtaagtggtaaagttgtaaactaaggatgaaaatatagtgtgagggccttcacacaatatgaacagataggatcttccagtagcagttggagtctcccttagatgtacttttatagtgaaaatgtttggctgtcttgacttttccaggtgtttatcaaatgcccaatttgggaggagtagtttcctgagggtggtctcagttttaattatctccactggaatttgcccactctgctagaggtcttattttcaactctatgcctgtgggtggaaatgtcttcttcctatgagctccaggtgatatttgttgtaccatctcacagagtggctttggcatgttgcactgccttgtcttctgaaaccatctcttgctttgtacttattcctatggatagcaaagattctcagtgcctctgggtcaggatatctatataaagtctgcatctgtatacgcctcacttcccccatcccctgccttgaatcgatcttctgtgcattctccctagtgtctacacattatttctctttgatggcatcatggtggtggtgtagatgtgcgagccttctttgcttgtcttgctgtctactttggactcaaagctgagaagaaacacttactatttcagctcaaagctgagaagaaacacttttcccatttttactgtcccctctactcagctgttccttggactttgatatttaaatgtttctctgaaggaggtgggaggtggagaaagaggttgaagtgattcagaaattgcctagtgttccccataatgtcagaaaatttattgcctagtatgaagtcaagatgaggaaccaattatgtaccatgtgatgattggctactttaaagtgggtagattcatagaacagggaactatttacaacaagaggtttacatctgtgctactttcagtctaattcaaaataatgacaatgatgtctgtctgataagctgagatgacctcccaaaggattttgatgcagtagctgggtctgtagcttagctgagttacagaaaaggagaaatggggctgtgtctgtatgttagtattagaatgaaagctagaaaacaaacactagaataggtagatattacatttattcatatatttagagatgtagtggctgatttattaaattttcattcaaatgttggtgcattaagtataaatgcaaacagtcctattctagtgagcatttaactattggtatagggatattgcttatcacttttagagagtgacacagtcagccccagcagggaacagtcattcattctctgggaaaactacttttcaaagacaggaaatgttgctaagattgtaagcaccgagactgagtgtaaccaagtctcagtgatggaaaggaagacatcaaacatttttacatctaaaaaagcaacatcggctataatgaggagggtttccaggttactaatgagatcacagtggattagtgaattttctacgtggtaacagcatattaatttctaacctttctaacagaaaaaatccattaattttttgcggaagttaaactttctttttgggcttccaattagacccactgtgataaccagttcacaattccttcctccctactctcctcctttcctcccttccttcttgctcctcttactttccttctccgacacagataagaggaaataaaaaggttagtcattgaagaaatgtgggactatccaggttgcacactgatctcttctatttccctcactgaaattgtcattgttaaaacagattgtttctttaagaaaataaataaataaaggaaaagagaaaacaaattaaacaaagcctgtagaggcaatatgtttagggagtcttgtgtggagctttcagtgtgttctctgctgcatgttaactatcaagggttggggctgggatatgaaatattgttccttatttaatgtttcacactctaatctctgcattgcatatttgcttctcttgtgaccttctctttgcatttataactgcttcttttcacctataatccgaaaataagtgtacattcctacagagaaattaaaggaggctgtcagtgtagagttaatatagttaaagcatccttaactctgcgacaaaccccttaaataattaaaactgtatgcttgaagagtcagatttgcattcctttaccaagtttatttagtacactttgttacactcaattaaatgaggatgttctgtttcattttctttgctttgggttgatcattttgccttttgattcttatgccctggtgtaatttcacagtgcttaggtctctaaaactatacatatattaacgtatatgtagatatatacatcccattaaaaggcttaatatttgtactgaatagaatctttgcccaaggcatttgagcattcctggtaacctcaggtgtaactgggactgcagataattcatcgcagtaaaaacgagtttgacaaagttcttttaacatccagtgtctttttttttttttaatttttaaagctctgttattttggcatcaccttctctccctacggtttgatttgtgaatagcaaaaaccagaagatacaggtgttgaatggttgtggaaaggaaattaaatataagtgctatctctccacatctcagttggcagagcatgtgcagactgctctctgtaaattagttcattgcttaagttatgcatgtttaagaaggaataaattagttatctatttcctaatgagtagtgggatcaattggagcatgatgagagagaaatagcataattttgcttccccagttgaggttcagtatccctaaacttcaccattaatcactctatcagtttcctgggttatttcagatctatatgtaagatattcattccttttaattttcctaccaggtaagtaagtccttttgaatttgcccagtgggtttgtaaatgggtgatgctgtctctgttacacccagaagtgtccttaattacagtgggcccttctgcctttgcgtcagtttgtctgggtgcattcacgaataataataaatatgtatgtgcgacgacaatttcaagggttctaatatgtttaactgttatgggatctgttatgtctactttagggtcgaccccatcccatatgacactccaaaaccagcgggccacacgcggtttgtctgcatctcagacacacactccagaacagatggtatccagatgccttatggggacatccttctccacacaggcgatttcaccgagctgggactgccctcagaggttaagaagtttaatgactggttaggtaaggaatgattgcgttctggcggccccaattaacctttcccgtccgagtgtcactcactgcgtcctaattgaattagagcacttggaagccagctcagccatttctcgtatgatatgcggtggtgtctagctttaatccaattctgttaattaaagatgaatttttagatatttaattttactgtgcatcctttcagtgcctggccttggtggctctggggcaaagggatggaaagctttgaaacccatctcatctcactcattctgctttaatgagggcattcattggcacacaggagacctagaatcatatttttaattcattggctctgcaatctttttttccccagatattataagcaaagatatacaaatgacctactagtaagagaacatttctaagaaatgaaggggttataaaagtccttatatgaaacaaaattcctatagcacagtgctgcttgggagcggatttcctaagtgagctggagggtgttctagacccctgaaaacatgagatatattactgtaaagtaaaaacttgggatgtgaagttgccctgtgtcctgtaaaaaggataatagcaattttctggatattgtggaggcacccacaggtcagttactgcaaaatattggatcctggttcctcttagcggagggaaagaagtgcaaatgttctgagattttagaatccctaaagacgaaagaattatatagtaaagagcagacgtcactctgggagcgtaacattgtcaataatatgtcagccaacaaaaataacttgggagatttaggcaaaaacattacaactttgttttccatcaaactaaagcagggtttgaaaattttttaaattttcgattaaatgataagacgtgttagtggaaagatgatattttagaattgtaagcaataaacttaactaataacataattattttgatttttcatgtgactttgctcatctgttcacattttgtatggttgacatctgagtacatatctgctttttgacttttggctgttttcatttaatagtatttattggtaagacttaaaacgtttttgcataattttcatattctttttaatagcagcatggcattcatatggttggctatgcctttctttaataagacatctctctaaaaatgagcatttaaattgataacaatttttcctctggtagctagcactgaaatgtgcatttttgtttgtgtatgtcgttttgtttctattgatttatttcttagggaaaaatactatacttaatttgctaagtcaaaggatatgaaattctttatggtttttgctacatgttggcatgttgcttttcaagggcactgtagctgtgtgtttcactagcagtgaatgaatgtataggtactagttttatcatggtcttggcagcattggatgttggagcatttatattttgtgctgttttagtaggtacttaatcatgttatttaaaatggcaagatattttaaatattatttagcataatctcatttttacagatgacacagagatgtagagaagttaagtgattttttcagtttcatagtggcagagttggttctaaatccagatcttttcgcttatgtcttttttctctacaataatctctttattttagcaactttcatccatgaactattagcagttaaaattattgttggtaaatcttgagagttttgaactagtctgtgtcaatggaatttcaacacagaaattatcgagctgcgttgacaatgttgatttttaaaggaagacaacagcactgtgggaagtgtttatagaaatggaggacaggttagggctggttataatcttgtttagccactgaccttgggaaactgagttaaccttccttttccccttggtttccctctgcaggacgaaggattaatactacttgtctttctggattgttgtgtagattaatcagtaaatgattgctgctagtaagtttttgtgggccattaataactgaatggggaatgtgccaaatgaaccatcaaaatatatttaaagggtaaaaagaagaggccagaggaattatttagtagatcagaagtaaacactgggagattttataagggaaagtactccataaatggaaatgtgtcataactaaggaaatacaatgataaggaaataaaatgccaaggcacagctgcatggtcagtgccttctcttcttatttcccctatgatctggtgagacaggaggaagaggtttcagcatgggttgcagaatgtgagatcgaagggagccctgggatatggttagagaagttgggatcccatagagaaggccaagaatagctcactgttacccaggcaacctcatggtgctcagagggtaagagatggtgtgtgataacactctaccacttggctcaatgaggaccctttctgaaagggtgcttctagcagcagctgccaggtggcctggcagagtggagtcagaggtcagatcaatctagggttttagggctttttccataatagggcatccgactgtcagtggggcatgggtctcacagatttggtaggcatttggagtccactgaatctctgatttctggctttctactctagtgtagactaccctgattattgaaaacaacctgactgtcccccaagctcctttattctgtctctgagctaagttgtttctactataggccaggcactccctctatacctgtaacatccttctgaagttgctaatgttatccccattttacccaaggtcatttagtatgtaagaagctcatagtggctgagtatccacccaagtacactcagctagtagacatggggctgtctgactccaaagtgtgagcccttttcctttgtcattctgtgatattatgacagggcttgtggcatctggaagcatgcacatttgaagcttgtactagaaagtgctgtagcttctggcagcttcatgtggaagttgagtagctgtttggctatgtgctaatattgcacgtatttgaaagatgtgtttaagctctgcccatcttaaatctcacccttgacttagcagctgcaaggccagggaatcccatcatgagttctttgttggttcagagatgatgatccctggttaatctgtacatatgtcacctagtaggagtaacaggcaaagtcattaacatgcgtaatttatcagataatcgagcacagcttcatcttaggtcataagaagattgaactcaaaccagatatcactacaggatggaaggggagtataacatgtaatgattatgagcaactgggaagacccagccagttttgaattcactacctttgttaagttgtgtaaactctcaagccttgatttgctcatttccaaaatgggcatcataatgataatacaccttacggtggttgtgaggatatgctctgtgataaagctcatactgttcttagaacaacctctggcctgtatacaactttcaactaatagagtagaggaaaccaacagagccagtggcatagaatcccaaaagcagaagttaaaaggagctggccctgggcatttaaagagggatccagagtgtaaagagggagcaccaaaatgtataaaaatgagcctcccttataacagtgacactaaccagacagaatgttaggacaggaagagaccttgaaggccatggagtcctacctcctaatctgatagaagtggaaactgagactggagagatttaatgaattgtccacggtttcgcagataattaatagccaagttgggatagaatttggatggggcaggatggggtgggtgaactaacatgtattaacatgtattgtctatgggaggtaaggtccagatgctgtacccctgcattacatgtgtcatttcatacaacccccacaataacttgtgaagtaggtattattagcttccttttaacgtgtgaggaaactgagccttggtgaacttaacagttcagcagtgacctcaggatttggacttacgtccatcagactccaatttccaagtgtatttccttacctctcttcccagagtggggcttgaaatctgttggaggaactacatcctgggtaaaaccatggttcttcgaataactgcctccttttaacacaagtacttacacgtacatatgttcagggcctaaggtggtttatttcctgagaaagctgttttgtggcacagcctctctacgtaagctggccgatggaagagcattatgaggtagggaagtattctccccatttggtgtagacaactttggtgagttacaacaaagcaaatacccgtaaagaattctacagatgcagccagtcatgtaagctccaaagaacagtctaaattatgttatgacattagcatttcattgaccagtcctggaaatgagtagctactgatggtagcctggaaatatcgtctttttgggcaagcatttcccacttatgaacacttgaaatgatcaggatattctaaaaactgcagctaccaccgcattggcccctttcctcccaaatctctaccatggattggggaatgaaactttgaatccctatatcagacagctggagggagtgacagagcccctgttttccatctctccccagtctggctaatcagacatcccagtcctccatttgcccagacaacctgtgcctctcttcacctggctgctgcccgtagtgctgtcttcagggcatctagtctagggtcagagggacaagtggcttcttattgtcaaagatttattgccagagtatatggagagaggtacagatgaatccttcttaaagaaatactttttaaagtgatagtcagctcctattgtctcattaacattttagctaagatgtgttctaggtaagccatgaataggctttggtgagttgaactgggaccctgccacctaatagttaataacattttccttcttatcttagcaaaaatgcataccaatcccagacttggcttaaaaataaacttgtgaactagataaagtacctgtcagttaaaatgtgattatttttattgccttgaacatcagtggcttctaataccacattctctaaaggtacattttgcaaggcctcttaccatgtgtgttcttcctgcacgttggccctgtgttccttccacctgtgcttctttgagattacttactgttccctcaattttgtccctgttgtgctttcatcttcagaatacttttggtagccttcttgaatattgcagtttatgctcatggatgctacacaaataggcattagaagatctcatcgtttgattgcacatccaccttcttatttctgattttcccttatgcccatacccagtttcttcccatttttcaaatgcaacatgtcccttcacacctctttccctttgaaaacgctgttcccacttcctggaatgaccgtctctaggagaactcatcctttatgacagattctctttcacagtaagctactttccttaacacatcagtcaccagtctgtgcatcccttcccatggctatgccattgtttacttgtttctctgccctaccagacagcagtgtgcataatgagtgctcttggtatgcctggttctgagtatagggcctggaacattgttggtgtacacaaatgtttgttgaatcattgagtgagtggatgaacataaaggtacaagatgttttttcctgcctccgcttttggccaaactttaaaattatgtatgtatagtgcctaatccttccctccccttcctttttcttttattctcaaagaacttataatatcccattggctgttgttgttgattcctatatactgtgcagaaataagaagggtatattgttgctgttgagtttcccactttataattagaaaggcagagtttttgggtggtctattctttcagtcaaaagtttacgtataacaatccagtcagtcaaaaattccttttaacacagcatcattgccatgaacttttaattatggcctttcaattatggcctttctttggtctggattgtcatttaatagttccgagcttcagtttctccagccctaaaagggagaacaaaaatgcttcaaggaaaatctcaagaagagggtcattcatatttgtaagagcattttgttagacatggctgtaacagagtgtgactgtaaccaacatcccagattgcagacatacaaatcaatttttgcctctctcagaagactatattccctttctagtgatcctgctattggcccaaagttttggagctggtctttaggaaaaaccttcaccgccaaggctgtttattttattcttataatatatgttatacatgtgcattccttttaacttagagataagtgaaaagaagaaaacaaaattacctatgaacagatgtaactactgttaacattagtgtgaattcatgtagaatgtcttctataaatacacacacacacacacacacaaatatcttttgccaaaatataagtcttacagttgtattgctttgtagtctctttttcatcttaacgatatattatgaaccacttttcacatcactgaatgtggttaaaatactttttcccaagaagaatactttcattgtaagatacacataacattataaaaatccaaatatttgatgtgtgtaaagtataaaatatacattcctccataattatatttccaaagtaattacttactatttgatgtataacatttcaaaattttttctactttctgtttctttttataatatcctcaatagcaggaaatcttcacccatttagggtctttattaaggactattttttaaaattgataaaactatgagtgtaatcttgtaacttaaaaaatgaacacatcatgctctgtgtcagcatagcattctgttgtactgatgcactttttatttagctagatctcttgctagatacataaggtatttccattcttttattattctacttgcactgaagtgatgaacatctttcttgctctctctttgcaaacatccttaattatattcataggatatattcctagaagtagaattgtttcttcagatgatgtgtatttttaaaaaattatgtattatcaaatttctcttcataaagattgcaatttctccatgatactctcagtagtatttgagagtccgtgtcacatatttttgggtaccctcagtggcagcaaatcttcaccctttaaagggttttaaaagatgacgatagctggatgcagtggcacacacttgtagtttgagctactttgaggttgaagcctaaggatcacttgagcccaggagttcgagaccaacctgggcagcatagtgagaccctgtctcaattataaataaataaataaaaacctgtaaacgattttctaattatgaaagctcacatgttcattgtaaaaacatgtaaacaatgaggccaggcacggtggctcacgcctataatcccagcactttgggagccaaagagggtggatcacttgaggtcaggagtttgagaccagcgtgggcaacatggcaaaaccctgtctctactaaaaaaatacaaaaattagtcaggtgtggtggtgtgtgcctatagctccagctactcaaaagactgaggcatgagaatcacctgaacccgggaggcagaggttgcagtgagccaagatcgtgctactgcactctagcctgggcaacagagcgagactccgtctgaaaaaaaaagaaagtaaatagtgatacagaaaaaaattaaaattgccaatatatcctataaagctcacatgtaactactgttaatggctggtgtgtatcctgtggtgtggtagatgtgcatgtgtgtgtgtgtgtattgtgtataaaaaggcagtgtggtattaggttacaagcatgagtattggattgagcctgcctatatttaaatcctggtttcaacattattaattctgtgatcttcaatgtattcatttgtaaaaggagacttattaatgcttagtgtatccagcctctaaagattgctgtgaagttaagtaagataaaggagacccaatgtgtacaagtagtgaatggtcaggaaatgttatttgctgctgtgacattttccgagcatgctgtgcagtgacagctctttcatgctctgttgttgaggttctgttactcctggggagggcaggaattggagagacagggggaggggagaacttggagaaggtggccctgaagtctcttgtgtcatagcgacctgctggcctgtggcccactctgcctgtgcaacagagaaaacggtgacacagtggccctacctggccaccagaaacctgatgctgtccccttccaagtaccccagaccaaacttacatagacctctccttagactctgattaacatctgaaccacagaagcagggcagcagggcctctcctttccctttccctcttccccatttcctgtcctctcccctctgttcccctctttattctgacccactctctctcccctccagcgtcaccacccctccttccagaaaccacccttgcccaccggctcctgtcttaacaatctccagcaccaggctttattcaccaggttaccaagggcagtttttaattaaaaaaaaaaaaaacaactctttcacataatactttccaggcatggttcacacatttaagatttctgattttttgaaacaataaaaaatattaggaactggagctggtgaactgggcaaggtaggagatgccattttaaatagaaaatagaggccgggcgcggtggctcacacctgtaatcccagcactttgggaggccgagacgggcggatcacgaggtcaggagatcgagaccatcttggctaacacggtgaaaccccgtctctactgaaaaaatacaaaaaaaaattagctgggcgtggtggtgggcgcctgtagtcccagctactccgagaggctgaggcagggcaatggcgtgaacctgggaggcggagcttgcagtgagccgagatcacgccactgcactctagcctgggccactgcactgtagcctgggcgacagagggagactccatctcaaaaaaataaaaaattaaaaaaataaaaaaaaatagaaaatagagattgatacctggcaacttttctctagtaaagtacctggcacttcccaaagaatcacttcagaaaggatttgagcagagcagcctcactggaatgtttatagtcatgcaagtttatgattacctaacagtcatatctaataaagaggtaaaggtaggagccttttttttttttttgagatttattcttgctctgtagcccaggctggagtgcagtggcacgatttcgactcactgcaacctccaccaggtagaaggctttaggaagggcagataagattaactcttcctatgatttacaaaggagaatatgccagaggtttccctagagtcaagatctctgattcttactgttgagagtttaatactcaagtagtttcttaatctttagcttgttcacaaaaacagtatctaaaatgctatacttttaagtttttgattcataatttggttttcctagcaaccatcctagagttatgatttattgaaagcttctctttctagttcaagaaatccacttagggtccttttttctatttttttttctttcccctttctcatcatcattgttgtccttgtcgtggtgtgtaattctaggatttcagtaggtgtctatgagttgcctgtatgttctatcaggtagctgtaacacagcttgttttgtctgtaatagtacaggataagagtatttgcttaatacaagtaacagttgattcatgcttattatctgtgtgtctttctttacattgaataatttttttcctatatgaattacttcatggtctaattcatataaaagtgcatctttccaataaggacaaaattaaagtgtagttcaattttgataacagaattaagtaaagtacttgggggaaaataatgaacccaaacacagcatagttgaatatgctcaaataagtaagattggattttgttccattagaaaggatcattagtgacctgaggacaagatgactaggtcttttgtgatccatgtgaacccaatcctctgtgttatgggcagccattttcttaaattacataaattattatgcctttaatttatatgacatctttcctccaaaggactcaaagtaccttttgagtatattagatcattaatgcttatattgtttcaggggagttgatatgggcagatagtattatctctgtcttactgatggatgggtggagatccagaaaggtggaaggacaggctgggtcacattggagccaccattagagctgaagtcactgagttgactctgtgttccagccttcaattcttaagcttcctactttctcctttcctgaaatctccccatctcctaaagagaaaaaaacataggcaagacatacataattattacttcatcagcttagcagaaaagccaggaaagcactttcctgaaaagggtgaccttttaggaattttactgtatgaaaattgtatcactgttaaacaaaataaaaaagcggctctttgaaaacaaaaaagttctcaacttttccaaactatctggtccaagaggaaacactgaagccccctaaatcctagagcaggactcttgtgtcctagcacatgaagagacttcatcctcagaagattatttgtgtatattctaagtgtctcctgagggccaggttactgctttgtgggaggcactgagaatgcagaagcaaagtcactgcatttagcatccagtctctgattgtcattattttttccccattttgtaaatgaggcagctagaactcagagagttcaaagatcttgcccaattttgcacagatttgtcagtgggaggcctaggactgggggctttgtctttccttctgatatgatgacatttctcatcatagggtaagtctgcctatcaaaacctaggagattattctaattatttgaggttttattgttagaatggagtgctggttttatcttaatcattccctctttccaaatacttgcatctaactggagaccagatattttgacatagatggtagaaagtacacagacacctcaaaaccaataatacctcaaactgaaatatatcgcctccaaatattgcttgttcttttaaattccccttttgactcacagtaccattaatccaggtacctgaacctcctggaactatgactacattttattcatttcacttcctgagtgtctttctgacctctatggtgcctaaaaagactgccaaaccccaacttgccattcatctctcctggaatcccccaataataatatctaacacttgttgatcacccactatagcctgaccctctacctgcattaactcatttaatcctcacaacactctgaggctggttgatgctgttatcaccatttttactgatgaagacttggtatctctttgttatgggccctcccaacatactgatatttttgtggaatgcattttaggaaccatgaacagatggaatggagtctactgtggtattcagagctcttcatgaactggtccaacctatctgtccaccttaatttcccaccacacttctctctggcctctccctcactctttggacttgtgtgttactgttttctcccctgttctctctcttatttttattttttatttttttccttttttgagacagagtctcactcttgtcgcccaggctggagtgcaatggcgctatctcagctcactgcaacctccgcctcccagactcaagcgattctcctgcctcagcctcccactgagtagctggaattacaggcactggtcatcatgccgagctaatttttgtatttttagtagagacaggtttcaccatgttggccagactggtcatgaactcctgacctcaggtgatccacctgcctcagcctcccaaagtgctgggattacaggcatgagccaccgcgcccagccccttgttctctcttcttgaccacagcaactttccggtccaagtttgttcccacctcgaacttttgtacttaatcatctcttcagtctgtcaatttctgctcaaatgccacctctttggtgaggtcttcttattttacctctttctgcatatccttctttgttgttagttttcctccgctgaatgctagctctgcatgcctgtaatcccagctacttgggaggctgaggcaggagaattgcttgaacctgggatgtggaggttgcggtgagctgagatcacgccactgcactccagtctgggcaacaagagcgaaactccgtctcaaaaaaaaaaaaaaaaaaaaaaagatgtgttgcttccctgggcttcagccccctcttttctacaacaaggggaagttgtcacagagtcgtgaggatgaaattgaaggcgccttattggaagatgtcaaatgtcatgtaaatgttagacatgatcattttgttgttaatatcctgtcctatccctcattgccctaggtaggaggcctcccaatgcatttccagtccctgcaacaggtttctggataaggatagtcatccttataccaacgtggcatttggtttggctttgaacttcccagtactccatagatcactttcatcttaatttcccacctccccccagcctgcctgtatattgtttccaggaatcttgattccatctgtcccctgggtttttgaatgccattttcctggcccttcaagctgtatggagagtcatttccgcttccagtctatcactggactcactaattcttgatgtttgccacccgcccccacctttgactgataaattttcattattggttttgcgtgaaagtcttcagggctctactctgcctgacccctgtggtcacttagtgattacatgtgccagctgaggtaatttattcactttgttttggtgtgaacatgtcccatggggcttgtaactgctgtaatcacttgaccctagtgattgttaaatgctttaaacacagttattttaaatttataattgttttcattaaaaatcccttatagtaacttaactgaccttgctgtcaatgtggcgttatgtgcagggggaggaaatgaaaatattatgatgcaaataatatagtactcatcagagatatgtggcaaatcattagctcactccacacattctcacttggagtcctgcaaggaagatgaaagggaagacgacataattatagcactgtccacgtaattcaatgcagccattcccacacgcagggcaggccactagcctagagaggtgaaagtggagtggagcccaaggttaagtcccagaagagcctcgcatcaggcctgttaaatgtgtagacagcacttctcacactggtgggcggcctccattgattaattattttttaattaatatttcttcaagtttcaggaaagttgcaagaataatacaatgaacactcatatacccgtcacacagatttccccaactgttaatgttttgctacatttgctttattattctctttctaggtgtgtgtgtgtgtgtgtgtgtgtgtgtgtgtatgttttcctgaagcatttgagtttaagtcatagacatcatgcccctttaccctaaatatttcaatgtatctttcctaagaacatggatattcatttacatgagctcactacagttatcaaaatcaagaaatataaattaatacaactgttatgtaatctatagacctttttcatatttttccagttgtcttaatcatgccatttatgacatttttttttctattccaggcttctatacagaatcatgcactgcagtcagttttaaaactcaaaccaaatcaaaacactgtttcttactttgttgccttaaggaataaggatttcttaatggaaacttggtcctatgaaattaggatttggacctacatttctaataatcatgagaattgctgtatattaagtgacaagacaccacactaggtgtgtattttgcaaacacatttatctcattcagcccgcccagcaaacatacaaggaagttattcttgatctgcagctccagatgctgcaactcagagaggtcaccatgctctgggtcacagagctccaaggggcagtatctatgtcccacatcctgcattcttctgcggcatacaagaagggtgggactccaggatcctggagactagtagccacgtggaaacgactgatgttatatttgtttcatttctagtttttacattttactggcaaaggtcagaagatatatttacattagaaagttacctaatatgtattttgacttcaaaagatacggcgtggtgtcctgattaattttaacaattaatgaaatttgtaacaaatgtcaaataaactaggtttgtttaatggaatgctgctagactgctgaccagaaagtgctaaataatgaaatccaaagagccttgataacctggcttgtggtactggacacttggatgttgagatactctgtgtgtttctggcctggctgttagtccttgtggaaacttgaagtcatgttccagagttgtgaattgaatggcccttacaaaggcgtttgattagcaagctttcgtaatttagcctaaatggggctggtggggatgattcagttccagacatatggttacatccctatatttggttttggttttgtttattcttgttttttttctttcctttctgttttattcctaaatccaggatttctgtgaatactggattcacaaaatgaagaatatacaatgaaaatactaaaatatcagttaggtttcctaaatctccccccaaattcataaattacagctaactattctagcattcctcctagtagccccagtactattattactattactagcactaccaccaccatcaccaccacttggagaaggaagtggggatagttgtgcattttcatttaaaaattttcagtatttttccaatatgttatttctggttggggctgctgcttatctgtaaagtgcttttctacaaagtgtaaagaggagtcccctgggcctggtgggtacatactcggtgaatggcagatagctcccacttacccccttggctgctactcttcttgtacagtgaacaacctttgcaaccaaaattaaaagtcatttcttccaacataattattttctggaacatcataaaattctcccctattttttaacgtaaaaagtgacattttgactaaggaaattgataattattttaagaaatgatgtatgttttataggctatttattacaaatgctaaaattaaatgctgtaaatactcccttcatttccaaatacttactgtatatgaaaatgacatataagacaatatcaaaaagtcataggtgacaaataaaaataaatgctagcacaaaacattaaccaaagataggtaataaaaagtgaaaagaaaggcaaacaaaaggaagtcttctgttttgatttgtcccccaaatgaacattctttttgtttgccttattttagcatttatgtagggaaaaaatgacttaattttggttacattgcctgaatttcccagcttttgtcacatccggaatttgtgttaatgccatatttatagtacaccctaaatgaataattaagcagctaactataacatgcattattgatctatcatagatgttattgcagcaagttttgtgtacattatgaaactggggtaaactttttttacattttttacattttttttagctgttcaaattttaagagcaggaaagaagcagcattctttttttctaatttcaggataaacgtgtacaattaaactgtgttgtctcccttctcgctgccgtttttatgaatctcacttatccttctttgtttggaaattaggaggtaaagctccttttggttttgaagagactgtacttgcctgtgagggcagacatctaactataaaatatacaacctctgagctttgatttgtctgtaaaatgttgagaacaatgttaggaagttcttcacttgctgactctaaattaatcctattccctagtcgtttgagactcagtgcccaccaagtcctgtatagttcttccctttattacctcaatttagaattgttaatcaaccaagagcatataataatgttagtggtggtgatggtgatggtagtggtagtaatagtaataatagtactggggttactagtaggaataccagaatagttagctgtaatttaggaatttaggaaacctaactgatattttagtattttcattgtgtattcttcattttgtgaatccattattcatagaaatcctggatttaggaagcaatgtaaccacagagcctgaaaatgtttgtgtatatatagacacatatatatatctccttaacatcattttttatgattttacactcatatatatgtgtatcctagcattcctactggtagctccagtactattattactattactaccactaccaccaccatcagtactattatatgtgtatattttataggctattacaaatgctaaaatcacacccacacatatatatgtgtatatatatgagtgtgtgtatatatatatgcacatacatattcatgtatacacacccacacacacatacttttttgtgtgtgtacgtatatattttgtttgtttgtttgcttttgagacaggatcttgctctgtttcccaggctggagtgcagtggtatgatcaccacttactgtaacctctgcctcttgggctcaagcaattctcccaagtagctgggaccataattttacaccaccatgcctggctaatattttaattttttgtagagatggggatttctctatgttccttaggctggtctcgaactcctggcctcaaatgatcctcccgccccggcctttcaaagtgctagaattaaaggtgtgagccaccatgcctggccctgaatgtgattttatatatgaattccaaaatgaatattttaagcatacacatttaatactatgaaagtgagtaaactaataatttgcctataaaaatagatagaaacaaaaaatgcaaaaccaaaatgtatgtcttttgtaacgcatctggagattttgtcctttgaaaaggccacacaagagttaagggtggtgggaaggcaggaaggacttctatcttcacagtcctgtgcatacgcagctcctagtccagttaaagccttcttatccaacctgacaaggaaagaaaagtgttcagttcatcaaaaaagtcagctaacgtaggaacccatacaaatgataatcatatagctaaatagttttattttaatgtgaagcataagatgtgcatgctttggtcagtgtcctgaggtagaactgaagccttccctttaagtatggacacagtgattataggtcagcactgtctttcttgggtaaatcacacatttaatttctcatctttattaaaaacgtatcacattttcattttggcatatttattggtgaacataaagatgcttgtgaaacaatctgagtgcagaatctttctagaatgctatgatttttaaagtcatttataattacatgagatgattacattaaaaaatacagctggataaactggtttggagataaacagaggtggctctaggacaactgtgcatggagcagaagagcacaggtgactactagagacagcccctggctgctgttagtgggtgcatgttgggcagcagacagtatgtgtctcagagaggctggagactgtcggttaaaagagtgtctagaatatctagaaagatcctaagcagagactgtgtgtggttcttggtagctgttctgtggctcataatctaccataaactcttgtagtagttctcagatctaatgtttgatttctttgcctgcctgggaattgtttttttaaaaatgtcatggatatagttcagtaatagtgtgaatttgttgttcacaagtcagtgtacatggtgagttcctcgtttttaccataagtaaaccaaaatgcatcgcagagtaagaattcatagtataaggtatcagagaggaacttaaattttaagaagggttttatttcttagaaatagtttatacatgattttactaaggtaattatggagactccttctcccatgacagaaggaggaaagatcaagaagcttggcatggcagttctttcttcgtcctttggtagttcttttcatcagggccagaggggttgaagtatgagggtgtccgtgcttacaggacaagctctttcccttctcattagtaccctgttccattgcctaaagagagagaaacatgcaggatgaggaaggacacgtcccagacacataggcctacactttagcagcgttactacgtcttctcgacgtggatagtccagaatttctgaagtgtgattggttcatcaaatatatagtatatagtgttctgtccattcatttgtaaaatataacaaagctcctcaatattgttggtttaaaaaatgtcttttaccgtatacataggcttgaatctaccttgttaaaaattttgtgcttgtgattattagggaaatatgcccagtgttcataaaagtgtttgtgtatgccctggcatggaatatagatatacaccgactaacaatagctataaaaatgaaatcttgcacagagctgtgccctgccttcccagtcagcagtaacaatgcttttggagttgaagggaagcttttccactggggagatatatggggagtatggggggatagcagcttaagaaatggggagggagaagtgctgcaaattttagtataatgcataatgttgaaagaaattctatcccatcataaagattagcaggctgtgtaattcaatttaaaattggttggcgtgtcctgactattataaagcctttcctttttttgttgttgttttatcgccattccattatttgatgtcatataccaatacagaatggagcatacagccaacccatccatacagggtctctttccacatttgcatccattggagaaattgttggggaatgtaagagtttatcttaaaatgaattaagaaaatgcttgctcaattgaatgcctccttgttttctttctttcttctttcttttttttaacacaaaatgaatttcttctgggcaagcaaccattgagagtgaaattcttttaaaagcatttgctggacacaggacttggttctcaaaattccagcattagcacttatctacagtatcatgggcattacagtgccattgaaaatcaagatgcagtagcttatgttaatgcaagactgacagacccacatctgatggcaattacccatactggggggttaataaatgttcttagaattactgtctttattttctttattgcaagaaaaatgggcagcttcctaagccgtgcctcctgcttcttgctaccagccttggtgacttgataattaactgttttcattccagtgcttcatgggctcttctgagtttaatattcatgttagggaaatgctacgtcctttagccaaagtagtaaaaatattaaattaaattcagcaaacatttatccaagtaccctttaagaacaagaaatgaagacgtatagaaataataataataataacgagacttggatgcatcagaagagtgtctggaaaatgaatgcacactgttttttccttctagaagggagcgagcttaatttttattccttttctgaaggggtttcagcacaggtgtggcagagagaattcatcacacttgccagctctgatcaatctaaagtggctccctgaagcactttgttaagaaggatcctcatgctatatccaaactcagtgggaaagatgttatgatttatcagcagtgtctctcatgctatggggtaggggtgtggttactcataccatgcatttgctgtgcctgctatagtgtcattcatctttgttcatattcatgctctatgaatgtggtaggcagaaaattgctgtggtggaaatgtatgcctactttattttaactctttagagtcaatccagactttggaatatctccaatactaagttcctgaaatgattgtgatcttcgcttgatgggattttaaagttttcttcacattaaaggctattctatgtctgtttcaagaggttcttagctgtctgtaaggcaaattgggggtagtgcattagtaaggttgtcaagaagacaagaaaacacatacaacttttggggtcctgtaggatttaggaagcaaattaactttggtttgtgatgctaaatctatagtaagaattaaggttgtacaaccactctgatggtgtggttaacttgtgaagctgttttgcatacctacttggaaaggaattcagagatcaggagagacaattcaattcaatttatcctgttatgtcccccaaatcttgggcagctcagttttctctagcccctagtttctatctcctaagcctgactgcccatcagaatctctcaggcaggtggttaaacattcagattcctggaatctagttcagacttattaaatcaaattctctactgatgagtcctcataattggagctttaatgagctcttccctggttctctcacagccagtgcactaccaccttcttgcttatggataaaatggattgccgggattggggatatattctgcatactcctattatcctaaacccagccattcttttccactctcttttcatgatgacccctgtagacttcatttagctcctctgtaaaagaggataatagatattgcctcataaggttactgtaaagatgaggtaggttaacgtataaaggttttttgtttgtttgttttgagatagagtctcactcttttgcccaggctggagtgcagtggtgcaatctcagctcactgcaacccctgcctcccaaattcaaaggattctcctgcctcagccccctgagtagctggggttacaggtgtgtgccaccatgcctagctaatttttgcagttttagtagagatgagtttcaccacaccaggcttgtcttgaactcctaacctccagtgatctgcccaccatggcctcctgaagttgggattacaggagtgagtcattgcgccagacctaaagttttttaggatggtgcctgacagaggtaaatattggatgtgttggttccaaatctcataattgtcatcatcatttgatttcatttacagggacactgagtatctttgccagaggcagcaaatcaaattataatatcttaccaggctgttgtaagaagcagaaggtatacaaaaagctttgcttggttgaaacactattttttgaatttatgaacatgtaaacatagaacagttaggaggcttttgactgtaagaaacaaaacgctgtaagaaacaaggaatttagtctctcattaaaaaaaaatgtccaggcacaaagcagttttcagcatctggtaattcaggggctcagtgatgataccaggaactcgggttctttcagtattcctcttacatggtggctttgtcccaaaggtttgagaatgactgctgccgaagttccaggtatagcatgaagtaatgacagtgttcattggaaaaacaaggtcattccttccagtatgtctctttgtataggtgatgaccatttccttgaagcccatccacagacttttcttcatgtttcgctggccaggattgggtgaccgcacctccttaaaccagtcattggcaagggaaatagatgtactaactaatcaagataccctcacctgggtctatgaataagtttacctttctggagcacaggcttcccaggggaagatgaatacatgaataaaactgggggctgtgctattgaggaaaggtggggtgaagatttgaatgtgccatcaatagcatctgcttaatgagtctcataatgaagtatctttgcatggcaccttgaggaaagtagcctatggtcttcctagaatggagtcccttgggtatggcaggagacagcactgtagtgaggcttggccagtgactgagataggcttgggtagcattttaaaatatcatgccttgtttccttgtttcaatatcttgtttcctattttcatcctgaaatctttacttttcttgtttcctttttttatgttccttgttctcttttctttcattcttttgtttcctcttttgtccatgttataccaggatccatgtataggacagacttctagccacctgtgtccctttcccatagaaatgatctcagaagagaagattacaggttcctgttatgtggtcagattccaaagttctgagagacttaacctatcatcacctgttatgtttcatggctgtttggagcagtttaaccttctgtcttatccatctacagttgaatagtttacttcctgaagatcacgtatttggcatattgagattctgaagataccataggaactatacttttaacaattcaagctaattatctgtcaccatcaattggccacgaagagatggaaagacacttggttgatatctgagcccactggtagagtgtagcaagaatccctggctagacctcttgaaacaaagatgtgcacagaagacaaggcctgaccaaaaaagagaaagagaaacagtcatctgtattattttaatggttttgagctcatttccctttatagaggaactaggcttaaccatgggtggactgaggactcctgtctctggactagaataaaagtagggcaggaggcccccattatccctccttgctagggtaatgctggtcactgagatcttgtctctcattagagatgcaaagaaaaaatggaagaatatgtttttttttaaggtcatggcccactcagacctagagaacagaatctttcaggataaagcctggaaactgatttacttttttttttttcttttgagacagagtctccctctgttgtcccaaactagagcacagtagagtgcagtggcgtgatcttgggtcagcgcaactctgccccccgattcaagctattcttccacctcagcctcccgagtagctgcgatcacaggcgtacaccaccacatttggctaatttttgtatttttagtagagacgagttttcaccatattgaccaggctggtcttgaactcctgaccttgggtgatcagcccgcctccaccttccaaagtgctgggattataggcgtgagccactgcacccagccatgatttactttttaacttgtacataatttggaagatcaaacgggtttgggaactactggcctaaagtgactatctcaggctttataatcgttaaagggtttgtacaatcccggttctggggcagtgatttttccaagggccctgaggggctagaaatgtggtgttgtggggtaaaactttatccctccctccttccccccacaacaagagcagacctaatttcagtttttttgtttgtttgttttgtaaattcaaacttcttcataaacttttctttgaacaaagttttcccttgaccccacttgccccagcatgcaacgagaaatgatctgtttctgggccaagacacattaggtgccatggcttcctaatgtcattatctgggccatcttggcagagccgagggaaaaatcccatcaaggccactgaatgtctgaggtcacatgaacaagatatggaaagtcaatggtggccaagtagaatgaccctggaaggggaccctggaaccaaggtgcatggccctagtcatgaggacatcttccctctcaggacttctagaagcccaatgacaatagagttctcataggacaccgttactactgcctatttggtgtctcctcagtgaagtcattgtgttgtggcgcatctcaactccccagagtccaattccctataataatgagaatttttaaggagacaaaaatagagcctaagaaaataaagaaatatgctagctttgttgaactattccaaaccacacccagacaataaccacaaggacaacaacagtaattgacgttcagagtatacacacatttagcccaatcttgctaatggattgcattttaatctccgcaaagttgcttcaacattagaccattagtagcttgccttctgaaggtagaaaattaaatattttagaaaatattttcatcacaagggtagatttttaaaaaatattgtctaattaattgtcagctaatcaactatagatgattgcactgagcgttctaatgaaaattgagatttacaaggaactatgtgcttgctatactgttctaaacatctctggggtgtgtgtgtgtgtgcacgtgcacatgtggtgtgcatgcatgcatgtatttcctgccttcttacattgtgccgtacataatcaaggaagtttatttcttagctatctttactgttcgttgaaaaagggctagacagacagaaaatattgacttatccccctcaaagacaccttcctggattgccatatcttggtaattttctctgttactctctttcataggacctgctaattctcttccttgcagttataatctgagttatgttgataggttatttacttctttattatctgttgctcccacctgaatataagttccataaggccagagaccctgttctgtttgctgcattattatattcccagccagccccatcatactgccagtcacatcctaggaccccagggaatatttcttggaggttgtagaaagactgtggtcatttcatggcattctggggccctatttcattatcaaatctcatcctgacttttgagagagtcagaagcttagtgggatttaatggaatctaatgggatttcttttatccaatgctacaggattcgaaaattaggttgagacctgactttgcaagacccttgaaatgagccaaaacataaagaaaagtgagggaagagagagttaaaccacaaagtgggtgaatctgagaatgtggggttgaaagtgaaatgccacatgacagagttaaaaagtaaaaacagtttaacctgaagaactgaaatctggccacactttcctagtaagggatcaactttacaagctttggatgggtttgaatagaagaggttggagttctcagttttggagaattaagttaagccctgcaaaaataccttctttttaaaccagtgtatctaatctccagtttccggtcagaacgctccaaagtaattcaattttaaaaaataaataaaagtagccgttttcagagaaagtcactcttcattttcaccatttaagagtcaatgatctgagccttagcttccactctgaggaaaataatcttagtgaaaaacaaaagctggcatgttagagacatgtagaaatgaaatactaagctagagatgagcctacatattataaaaagataccaatctagaaaatcttttgctctcaaccttgagaaaccaccttggtggtattgatatgaaaaagaggtgctgtattggctgaggataagcaaatgtagccccttagttattgatgaaaataaaagtaaaagttgtgatgttagtatcatggaagaactttaccattgagtttcattaaaggtaactcagtgatagtgtcagagacagaagaaaagcttggaagaacagtagctagacacagaaagataatttctatcatcttaaattactccctggcttaagctcatgtttaagatggctaaatagatgctttccatgagtcaactgaaaaaaaaatggccttaaaccgtgatagtacaggttaaaaacaaaagagtatcttaacaatgaaatttgattagtcctctgtgtctatgaaataagaagaaatgagtgactatatgtcttgggtgttactgcatgatacttgctggtagtggcagatgaatgttaggacccaggattcatgattgtaggcacagtctttagaaaaacttcttagcttctctgaacctaaacattctgatctacaaagtgaatcatttaaatctctgacccggtgattatgtgatatggtggagaaggagaggattggtctgcaaaatcagaagttctgaattgcaactaagtcattgggtgaccttggaggagtcattttagccttgctaggtcttagtttcccattccatggaaggaatgattcaaatctctgaggactctgctaggttggaatttcggtaagcctggaattaaaggataaaaggtcaggagcaccctgctgtcccttgattttctgttggaagcaaaaggatagaactggccttgcacataaattagcatggattctttcatctgacccagtgacttgggggcctgagaagatgcacacacgtgtcctgtttgggcctaggcagtaggctcatttataaagagtggcctctgcaaagccagctgtcaaaacagcagtgattttcctgagaggcctaggggtgaaaactttcagatgaagggatacaatgaagaaatacaggcaccttcctcaaataatgaatgactattccattaactccatctattgattactcctctgagctaccgggaacaaaggctggaaaaatctttaagtgcatagtgtcaaccatgcagcaataattcccttctcttttgaaattgtaacattatttgtgtcatgtatatagttcatttattcatttattcatccatttatttgttcactcattcaacaaaattgagcccttactacaggtgggccaacttctttgccctcttttgcctttcccagtaaaaaaagcccctgtataacagattttaaaaatcagatttagtttattaatagcaaattaacagtatactttgtgatgtatataattggtgtcatccttgaataaaataaaaataggacttataacacttaaaggccattttgtagccaaaattgaggtcttcgctaatcatatccacatgattctcaggcaatatagaattatttcttcattcattcatctatttgataagtaatgattgaggccttctgggaatgcaaagatgaatagaatatagttcgaaccctcctgaggtccatagtcatgtggcagaaagagaactcgttagacaaatcctcattctgtgaactgcaagcacttggcaagctcagacctccagatatgagtggggaagtggctggcagggcacagagagttctacacaccataccacagaacgtttggccctttgtctgtgggcaataatagagaatctgggaagatgttaagttgggtgagtgtttaagtgtgtggagggagtgtatatgatcagatttgtattttgatgagatcacccagctttagtgtaggaaggattaagccaaggcagccttctaggaagggtattactttgctagggctgtcaaccatggaaacacagactatgtggtttaaacaacagacatttattttctcacagttgtggaggctactagcaggtttggtctatgcattttgggggaacacaattcagcccataaaagaagcaaaccaaaaagtaggggaaatctgctctttgacagagtgtatgcatatgtatgaggagggagagaaatttacatgttttttaatgaacaatttaaggcaaatgtagtatgcatttacctgacttcacatgtctaggaacaaagaccctcatagaacaaacacattttttaaattttttcattttactgtcatgccaaacacctttttatgtatttatttttgtgtcttgctttggaacaacgttcagcagacagagtatgctctccaactgtgttccgattacctgaattccttaaaatacttaattcaaattatttaaggaagaactttatggaatactttgtgccttaattatactaattaggagaaaacacagatttaggaagacagtgtaaatttatctcttgataaattttaagatgctgaggcctagatctctagaaattggaaaacccatgagtaaggaatgaaaatgtagaaagtaaaatagacctccaattctgcttcttggaaccttgggtaccaagggccatgatggaatttccagaaatcctttcttcctgaggaattatactacgtactttttactgcttcataccagcgggaggcttgtgggataaagccataaaagcattgccaaagaaatatcggagactattggaaatgtgttccagtggaaccaaaacattatccaaaggagacttcatgatttcacaccccccaggaagtcttagtggctctgattcagggtagctcttatagtagtaaatgttgcccattgaggggtggagaaagcagaatggaaaaggaaatgaatatggtctccattccctctatattgtcactgccactattgatcaaaataaccttctctgaggggtttctttgtaaatattgtacttgaaatgcttcactcaaattttgagttataaaatgggaagaatcaattttactggctcctaaattttgctctatgcagcttcctgtccagcgtggatattattaaaattgacataggatgtgtgtgcaaggtaatatcccctttcgtaggcacttctctaaatttcaggatattctgtagagtggattagattatacagtgagtggggattcagaaaggagaatagaactgtgtattgatgccttcagaaatattatttgatggcaataaaatattccccgaaattcccttcagagggaagaaaatggagtttgtttgcagtaattgcattttctagcatttgctcttacactttccaatataagccaattggaacccatgatttggttttgcttattgacaaaagtaccatgtaaattgatctgtgatgcatttaaagaagatgctttgaaagtttggaaattgagatggctttttcttattagattttgagagtattagggttcatttctatattttagtctaatgtaatattagccaaatatgttctttttcaatttagttttaatcaagttctggaagaccattttcatttagccccagtggcgctgttaacgcagagattttatttccactgtcaaccctccattctggtttctgcagccctgccccgcagaattcctgcattcggaaatcctgcatcatctgcccaaatgttatttcagcatgcaaaaatgacagtagttattacaaaaagatttttaaaattcttatttgcaggcttaaggaggggaggaatttaaaaagcctctaaaatggttatttcttttaaaagatatggcctttatgccttatgttatttttatttaatttgatcatcaccatacttaatggtttaaaatgcaaacacacaggatttgcatttgttcctctagttattcagtagaataattgccacttattttataattattgctggaaggaacacctttttctcagttgctttttaaaggctttgtgggggaaaaataaacatatcattcttcatctcatcagagactttgtcagccaacactactagtttattaaagatatttattaaatactcttttaaagaggtagaacataggagatgggctccttattctgatctaagttacactgcaaaacagaagacaggataaaaataacagtaataggccaggcacgatggctcatgcctgtaatcccagcactttgggaggctgaggcgggctgaggggatcagctgaggtcaggagtttgaaaccagcctggccaacattgcgaaaccctgtctctactaaaaatataaaaaattagccgggggtggtggtgggcacatgtagtcccagctacttgggaggctgagatatgagaatcccttgaaccctggaggcggaggttgcagtgaactgaaatcgcgccactgcactctcacccgggtgacagagtgagactccatttcaaaaattaataataataataataacaataataattatcatcctttatgtggcaggtattgtatttggtcctttcctgctctcacttattccccatacccacttcataaggtagattgtacaattattctttttcttttttcctgatgagtattgtgaagctaaaattatgtgtttggagtctgagtttaacaggtaataagtgacagaagcaggaacttgatccgaaatctgtctgactccaaagtccacactctttcctttatgccacatattcctgtaagttcaggttgtataaacatgcacacaactgatccagatgaaacctgacaatgtctttaccaatttttcttgtgattatctggtggaaccttgatttggatgcggttttctaatgcttgaggaagtagattgaagggtctttagaagctagtctgattgttcagatcgaatttgttgtataaatctttctttataagccaagaccctcatttgtaaaggaaagtttggataaaataaacagtggaagagtctaccttatgattcttttgtccagccagatggcaatactggaatataattggagttgcatttaggtggacggttaccactagggattcccatttagaacatgccatgttgatttgggtggcaacttagagatactcggttgggaagcaaggaggatagtgtcattcatttctactaccttgtggttgtcttaaaaatatatataagcgtgaatgagtatgtgcgagtgtgtacgtgtgtgtgtttaggtcacaaaaagttgtgttggaataaggccatggttgaggcaagaatgcttacaaataaggagttgctgagcagcaataaaatctctgggcagttttcgtggtctaaaaattgtggatattaatggcctgcttccccatcatttgcacttgtcagttgttacctgccatcagtgcaatgcagtagtgactactgtaagggatggggagtggacttttgtcttctttgtgtggactaaggtttatcacatctcctggtgccttgggattctctttatggaggaggctgaagcggaggagggagcatttccgctgtggtgtcttacactggtgctcattcctgcagtggaccaccgggctttcactccgcatcccctgccttctcctgggtttctggctcagccctgacattattgtaatatagttttctgtgtttaatatttcttagacctggtttcccattgcaagcatggaagaaaccctaatgcatgagtttcagaggagaaggtagcagtctgaacctgctgtgtggctccatcagcaagtgtgagtattaacgttagagctgtcaggacttgtgaaaattaatggagcctgacgggggacagactgaggtcagagacagagcttgccctgactgaatgtttctggtggttttgtagctgagtcaagtgagtgcaaactgtggagccaagggggatttctggagtatgcagtgggtaccaactaagtgctaagcattcttctaggtgccaggggtacagcagcaaaaagttggctctgcctcctcatagcttatagaaccccctccccacctccaggctggactcaggccttctctgctatcagcccccagtaattgccaaggaaggaatttagatgaaatgtctccttagcccatcctgagcctcatagttcttccatgctcctagcagttggtattacttttttcctttcatcttcctgcagaattttctgcttggccagttttcaagcccaggttattcttattcattcctcagtgaaatagagaggcttcaaaagttttaacattttccctgttcctgctggagttacaatattaaacatataataataattttaaataggaaaaatttcctccttctgtgtgccttgggtgaaacaaagtaactttatatcactggcattagggaacagggttttaaaacaggcatctggcactgccccattgcaggcaggtttcagaaatgtgatcaaattgttgtatatctcttatttagaaacagtcctgtgataacaggtctgactatatatttgtttgattcttttaaatcccaacaagttagcttttttttctagcacattaccaagggaaagtgagcctgaaggctgtgccttgtgaatttgattttcctgggcacctgggagccatagcaagttcttcttctgtcctgtcatctctgttgtttttcctcctgctatagaatgagctttactgactgtgagtgctatgccccagacatttttggtttccttatatattttaaaaatctataatatgggagaatagaggggagagggcatagggattggcagtcttaaaatatgtcagctttatggaactaggttttcttttatacaggaaaatgacaagccatgtttgcttttggaggctctctttcacaaagaactactgctgaatgctggggtttttctcttggttttagcaggagtaaataggagatagtaatcaattagccttgctgaccagatctctgattttaaaaaaaagggtgtggagaaaggatatttggtgttaaccacgacctgatgattgtgatcgaccctgttttccatattccctgttcatggggaatgaagagtatgaggcaagagttgtcttctgaaagttggcaggctgtattagtctgttctcatgctgttactaaagatatacctgagactgggtaatttataaaggagagaggtttaattgactcatagttcagcaaggctgggtaggccttaggaaacttataatcatggcggaaggggaagcctacacgtctttcttcacatggcggcagcaagcagaagtgctgagcaaaaggaggtaaagccccttataaaaccatcaaatctcgtgagaacttactatcatgagaccagcatgaggataaccaccctcatgattcaattacctcccaccagatccttcccacaacacgtggggataacaggagctacaattcaagatgagatttggatggggacacagccaaaccatatcacaggcagattcctgggaaaagtaaatgttctggaattgaccttggattttggtttgacctaaacttgaattttctagaggaattcattctataatgatttatagcagaaaacctgattgcagttgtttgatacttatttttgaggaacattaacttgtattgagggagaggggcaagctagagaggagatcacgtttggccagagcagtgcttatatatgtttattttaaaatgctgatgcacatgtgcccccagtcccctcattgttctctattatcttccacctagttcagctcaattcacattgtttctttacctccctagtccatgtaggtgtttgaatttattacctcagacctccattttcctatcaaaatctcatcctcataattgtagcaacaagtttttagattctgggacctcacataaagttggccttctcttcactgggtaggctcccacattctcctgggagcctgtagataagaaattgtaccaacagctgcagtagcattcggggaatgttttaattaagccaggatgtgttttaattgttacagcatgaggctgacactgctttatttcccatacaggagaagtctgtgatatagccagagaagcatctagaatggagagttctgtttcgtgggtacaaactaaaagggccataaatgcttaatattagataaaaggttactatagatggataatggcatgaggaggattcatgtatgagtaggccttaagtcaaactttatcaagttgtcacatatgtggggtcatctgaaaactactggtctgggagccaaagagctagattctggccccacttgtggcctgtgactgcacttagtaagtggcagcacctctctggcactcagtttcttcatccataaaatggaattgcatgaatcagtggtttcctcttaatttttttaagccagggttaactttcttagaatgatgaaatctttccccagatggtaaaatcaaggaaagcatagctgctctggtgaacctcagagaaggtcgttcccctctgcccttctccatccctggggaggcttcacggagcacagcttcaaaccactagattgtcttggaggacccttaggggttcatgtgttgtgattcatcagagccattataagtggcatgttaaatgtccagagttttataagggagttatgctgactttgacataagttgctatgtgtttgttttaacattgttatagagttcatcagacatgtgcatagctggagatcttaaacttttcatctattccttgctgcatgctcatagaagaataaccccacctgattctaagaagaaattctggatattctgcatgagtagtcactcttgagagaaacagtctggatgctatctattacaggttatactaatcattcatgaatgagaggccactcggcacattttttggtatttgataaatactggaagacagagatatctggatgagagaaggaggcaaaaagttgtgtgttaagggaatacattgtgcgaggttaggattatctcaacagaggtgctgtgtttgcattgtgtgcaggttggagacctcatagccgcactgaccttcacttttagatccaaatgcttattggccctaataatacttttgttagtttgaaagacatgttggaacatgccagtttctgccatgagaaaaatcaaaatgttctttttcgtcttcagatgctttgctttgagagtagtgacattgtgcctggcatcagggagtggtccaatttgtggataaaccaatgatttattgatggcgattgggaaagatggtcatgacaataacataacaacacagctaatgtctgttgagtgaatatagagtgtcagaaactgtgcaggttgtttatatgcaggatgttgtttaatcctcaccatactttagaagcagtattttatttttaccctatttatatctgagaaaactgtagtttaaaaagagttggagattagtcggctagactggatgttggggagaaggaacaggacacttcatgcgggcttaaagttggaagaaaatgtgacattggcttaaaccttaccatagcccaagatgacaacccgagttcctggaattctatggaagttaccaggaagtcttgtggaggttcattcgttccttcacttactcaacaaatctgagttgtgtgtctgccattttgaagatacgggactaggtactttgggtcaataaggaacaacaagccatgatccatgtcttcaagtctatggggatacaagtcacatgcaaaagcaaaactcaaaaatggagtaataatagtgaacgtgcactgatggtttactctgcaccatgcatgtgctttagaggctaaatttcattttatctttgccaaaactcatgaggtaggtgttattatccccattttgctagcacactttagagaacataaggaatctccaaggtcatacagctaacatgtagcagagactacagagtccccattcttatccccatgctgcgtccacagtttaaattgtaatagttttaaaatcgaatcattaggaatagaaatgtgagaagcacagtaagaaactattacatactgcccatagaagtaaagatgaataaggagagtgtcatggaataagcatgcagatgagataggatgcaaaggaagctgaggaagaagagagaggagaggaaatatcagagagggaggaggagaacttggagagtgccacagcagtaatcaagggaatggatcacaccactgtagtgtgatcaacagaggtcagaattcaaataaagccatggctttggccattaggaggttattagtcacattccagggacgcttttggaaggagagtagaagcagaagccagattgcattgagtaatttttgagtaaccatttggctgtacattgttaaatctattaatatagtggcccatcaggcagaacaaatgtggtaagtgggctgtatgagaagaaatcagagaggggagatctcttggcagactggaggtcagttttgcctgatcttttgatttcccacaagaagctggaagtgcagaaacttttgggtgatatttcctgagttctagatgttagttcattacaaaaacaaaacaaaacaaaaaacaaacaaacaaataataacctcagttgagggctaagcatgacacatctgagggctgaattggtcccaccagcagcaagcttatggaatcctcttttaagaagtttagaagtgaaatgaggaagcatctcaaagaagcaaaaaagtcaaggaatgtttacgatcatgtttgaggcacgtatgtgtgtgtgtatgtgtcaagggttgtttgtttttgttttcttggagtgggtaaatataaactcaccaaggaggaggattcaatgtatagagagaggcccaaaatatcaaagagaggagatgcctggaaaaggaaggtgcttatgggagtgggaggaatcagattaagaggccaatttgcaaattgaacatccctactatgagaatccaaaatccaaagtgttccaaaatctgaaacattttgagcactgacatgacactcagtgaaaatgttcattggagcatttcagattttggattttgggatttggaatgttcaatcagtgtaacacaaatattccaaaatctgaaaaaatccaaaatcctaaatgattctggtcacaagcatttcagataaaggatgctcaacctctgttagaaagataagaagatgcaaacagatggtgtgatgggaaagtgaaaaggcagaagtgaagagaacctccctccttctgtacacatgtggttagagggtattttgcatgtctggagaggggctcagttggagcctgggagctagagaggaacctggacaaattttgtgatggctgctttggggaggtagtggctggagtgtggggcacttagaacgtcaagtagcagcgaggaccctgttgactttcagttcatgagtatctacttatgtgacaccactaagtgcagaagatacagaatagataaaactcaaataactgcctcttttatggtctcacttacattctgtagctctaacctgaactgatgagcaagttttccacatctcattaattcacttcctaccattgtcactttattgtccctgtaagttacctctactatttgctcagtaattttcttgaaattacctcttattttacatataaagatagaaaaaaggaagctatatatcattacttatacttttatattgtatttgtccaaacaatgcattcttaaaagtagttttaaaatacaaaactatttgacattttgtcaaaggttcctttccatttcacctaaaataatcttgtgtaccattagtagaacatagaccatgccttgggaacgatgaaactggttggttggtagcgttctttttttttttttttttgagacaagttttgctcttgtcacccaggctggagtacagtggttcaatctcggctcacagcaacctgcacctccggggttcaagcaattctcctgctaccacacccggctaatttttgtatttttagtagagatagggttttatcacattggccaggctggtctcaaactcctgacctcaggtgatctgcctgtcttgacctcccaaagtgctgggattccgggtgtgagccaccgtgcccggctggtagagttctttgggtcattcagagcaaggattttttttccatgttagagtatatatatggccttggttttttttatacaagcaggtcagcttagctggcatgatctgaataaaatggaaaaaggcaggcacctctttgcctgacaattttaaagtgttgctatttgaataccaagaagtttgaagcttgactgcagggccttcccaattaatctagtctggaaaaaaaaaaacaacgaaaatgccatcaagtaacaggagatttgtcagctgccctgtttacacttttcatataaaacataaaggttggcagattatagatgaaaggtcagttcagcaaaaaagaaaatatgtcagacaatctcataacatcggtaacagaggatagaagttggaagctactactggattctcggaaaaagatgagtttgttggtgatgtgtaaatatcatcaccttttttgtggctcttcattttggtggctacctttttatgctgagtctccaaaatttgatttaaaagacaccaaagatgcttgtctttctgagaaagatttactttgcagcagttttactaaaaagaaagaaagaaagaaagaaaggaaaaacccagtctgaagggggaaaatatacttcctttgccatagtggctagtctcacccacgctgtccctgaacccgagccctaaaacgaggataaattgagaaacccaggcttcctgcaagagcggtggcacataatgaaagggtttacagtgagtcccatcatcgtgaatgattaaaggggaactgggcaactacagtgtgacttgtacaggtaaaatcttctgctctaagaatcacacagtaaggaccggccttggaagacattgctgtctgggaaaacgttttagcctgttccggctttgggagcacaggtgaattggggcggggagcactattagactcatagggtcacagagccatgatattagagttgtagggcctctcacaaatttccagcatgtgcagtactgggaatttgtggccctattgatatatctttcatctgcacttgaagttctggaattgtgcaagataccaccattctatccaaacaacttgctatgtacatcatactcttaattaccaaattcgcataaacatgcatttgagggaggcttcctattcttttttgaactcttcagcatagccttacaaataactgaggccaaagacgtgacatacagcactgtgggctagtagtcaaagatatccattgctgcttggcctcagcgtttctggtttcctctctctgcagtgttattttctatcagactgctttcatctctctcttaagcctccccattattgcccttgctatatatgcaattttattattgtcagaaatctaacaattaataactaaagaaaaggcagtaatatacaaaacatggtttggcagtcttaaaaactgcttcaatattagcaaatatgtttgtgatgtgctgctgagactgtgtggacttcacaatgtaatctttacagtttgaattgctgaaatccaagtggactgacgatggaacttgctcccctcacctccccccacccccccgcccacaaaattctcttccccactaagtttccttaatgaaatcattgagactctggcttgctggtaaggaccagttcttacaacaagtgtatccaatttcctgctagtggtaactttaattcttcctggaatagcaggaaacattaatttcacatcagacccataggtctcagaaagctggaattataggtgccattgtcccactctttttttcctccaaaataaaataaaataaaaagcagcagatgaacagtgaggcttgagggatgggtagtgacagagtaaggaaaagaacattaatttcaggtggggacagctgcccggcactatctccctttggattttcgttcttatagcatcacggtgagttattaatatgtatgacccgtactttattcaaacattataaatctatgcagaagtctggtgtttgggttttcctttatagctttcattcttcttcccagaattatctcattttgatcaggaaacttttgcataaaaagcacacactgagaactcacatttccataccataaatattaaaagagggttaaactttacagtttcttctcccatcccaataggaggaaagttagccttctaatcagggggcccttactaatgttctttttattcacaacccaaaaaggaaacttaaaattagagttgaaatatgaaattatactatctggttcctttaatgtatgtcaattatggaatgtttgactatgccatgtctttagtatgaagcatatactaaaaatctagtagttatctaagttgttaagaatagttggttagattatgttttgaggaccaaactaggtacagaccttctcttaaggatcgtgattaaagagctttttactggataaatataaagtgtggattcattaccctgtggattcatcacaatgaatacatagcatacagaagagggaaatggaactagaaaacttaatgtctttttagcaacgttttagctacttagcagcttcctatttcccgttattgtcatttttgttagcataaagtagtagtcataaattccagttcacatggaaatgtaaaggaatttgcgagctatttcatttgggtgagctgtctgctaatcacacagtctcggctgttgtactttgtgatgggaaatgaacgtgctaattggtgctcttttttcttatttcaggaaacctgccatatgaatataaaatagtgattgctgggaatcatgaactgacatttgataaggaattcatggcagaccttgttaaacaggactactaccgtttcccctctgtgtccaaattgaaaccagaggactttgacaatgttcagtccctcctgacaaacagtatttacttacaagattcggaggtaacagtgaagggattcaggatatacggtgcaccttggtaagtgatgattcaaacagttttccacattgctttttagctcagtaccaagaaaacacagctcagatttagatgctttaaatgaaaatgattaggatgaaaggaaaccttattgctgtatttccaacaaaatacatactgtactgctgcaaaatgcaacacttgttgttttcattgtgatagagatccctttaggcaagatcaataggagttaaagctttcctagatatatacagtcatgcctccctcagtgtccatggggtattggtccaggacctcccactgataaaattccatcatgctcaagtcttttatataaaatggtgtagtatttgcatataacctatgcacatcctcgtgaagactttaaatcatctctagattacttataatacataatacaatgtaaatatgatataaatcattgttatgttttatggtttaaggattaatgacaaaaaatatccaacatagaggcaatcctttttccaatattttcttttcttttcttctcttttctttctttctttctttctttttttttttttttttttttttgaggtggagtatctctctgttgcccaggctggaatgcagtggtgtgatctcagctcactgcaacctccgcctcccgggttcgagcaattctcctgcctcagcctccaaagtacctgggattacaggcacatgccactgtacccggctaattttcatatttttagtagagacggggtttcaccatgttggccaggctggtcttgaactcctgacctcaggtgattggcccgccttggcctcccaaagtgctgggattacaggtataagccaccgctcctggccctttttctaatattttctatccttggttggttaaatccctggatgcggaacctctgattatggagggctggctgtatatgtttatgttactggggctgggtgtatgtctgtgtgacacagaaggatttgagaggaggtcaccatgctacccttcacatagattcagctgctctgaacattccatcagccttaggtaactcatttccctctcattttgtactggaagcagtcataaaatatcttgcttagattagggtttctcaaacctccctacacatcagaattaccgtctctgtagaaatatagattttgaagcccttcctccagagactctgattgtccttcctgagatgaagcccagcagtttgtattttttaaagttacctgggcaagactgatgcacaggtggtttgaaagttactggttgagagctggcactagaattctcagaactaagctctggaaaacttgaaacaggtacatgtatccttggaggccagacaagaagcgtgtcaatcttgattgtatcagttgacagttgtcaggttttaaaggagttacttcacagtgtctgagcctcagttttcacatctctaagatggtgaagatgatacctattttagagggttatgataaggataaaataggtaaagtttgcagtggactgaagagaatatcggatagtttgcttagggtatgaattataatttttctggccttgggctctcccactaagtatttatgtgaacttaggcaagtcatttaggccctagagccagtttttttttttatctttaaaatgagaatgttagactaaatgattgtcaatatcagcaggttctaggacttttttttttttgagggtgtatatagagcaaaactaacctgtgtgtgtgtatgtagagcagaagaactcacctttactcacttaatacagaaaagtaccccagtccttcactaggagttgtggataggactggaaaaagacaagcagactgaattcagattggtcactttactcaacagtttggcttgtcctctgtaagttaaaaggttgagatattttctttttttttttttttttgagacggagtctcgttctgtcgcccaggcgggagtgctgtggcgcgatctccgctcactgcaagctccgccttccgggttcacgccattctcctgcctcagcctcccgagtagctgggactacaggcgcccgccactgcgcccggctaattttttgtatttttagtagagacggggtttcaccgtggtctcgatctcctgacctcgtgatccgcccgcctcggcctcccaaagtgcgagatattttctataattttttttctagctttacgagttggtatccagaaggactggtgagtgggtacaggaagtacatatctgtttaaaatcaaccccgacaatgattttgaactcttaattaagtacttcctatatgccaggcattgtcctacattttttgtatacgtgtcatctcatttaatcctcaaaatacctttaggagatgggcactattatgattctcatttggcagataagaaaatccaggtgcagaaaagttaagtaattgctcaagaatcgccacagataataagaggtctgatttgaacctgacaagtctgattccagggtgtacagcatgactgaggggtggcaggggttgggatgtggtaattggtggttataatcctcagatccagtttatacctagctttatttagtaaggtacgtcaatttatttttttaatgtgtgagaacgtggtaaagggcaagagaataaacagcagaaatcagtcctgtcaaactgtaatctggggtcatgtaggatgttgatattagcatttctgggtaaagggcaggagacagagcatttccagcttcacagcccagttcttaatgtcagtacagtagttgaggaatgacctctgattggcagaggtgctctacatgcaagttaagatcattgtttaaaaataatttaagattacttttgaaaaaatccttaaaaggcacaggacatttaaggctattcctgagcaagcagatgttcagaaatccctggactgatagttgctgaaatgatgacagcaacaaacttcctccattatctgagctgattcaaatctgtttaggacagggttcagctaaactagattgtagctgtgatgaatgagggaatgattttggtcctcaggcagatcttgcagcatctcaagcaatcgaacaaacagactaattcagatatgtgatgtggcagggcatgatctgtttttggtggtgctgcaaactgcagacaaagtttatatctgaactggattgatatcatttaaaatgttttaattttaatactggcaaggtagcaaagtcaagaaaataagcactaatcagtcttctgaaatgttctcctaaaggtgtccttagacttaagtctgttgagatttccacaaagcttcaaccatttcctattgagcatctctttacaatgagggagatctttaaatgatttttgccccatccattggaattgttgatactttgtattttgaccaagaatacagaggttgacaaaaatgatatttcagtttcatcatctgtttttgggaggcatcagtagtttggatctcactgtgaagatatttcatcaaaattaatattcccagagctactgataatctgaacatcgatttagaaatgtctgcattagcatttctgtgctagggaggagagtatttgccatctttaccacttgctcagtgggaccttgggtgagtttcttaacatctgcctgcctctgtttcatctctaaaatgggagaaaacattacggtttcatggttgttatgaagatagaattaatgcatccacagtgcatagaagactttttagcatggagtaagcatttgataaatgttagctattactactaatagtgatgtgttaatgtttccaaactactttatacctctgtcaaccttcataaggagactatgggactaggagtgagattagataagttttagccctagttcaccttctgcccattgggtgacactaggcaagtcccttaacttcttcatttagttgtaaaacatgaggaatgaggtctgcccttgtttctctcatatgccacccacttaaatggtcatcaaagttagaattttcaaaaacaatacatatttgtgagcatgcttgaattcctttaatgtcttgtacaatttttaacctcttttattattaagaagcaacgtttgggagaacttataccataggtaccacttttctcccctcggaaattagattttttccatctctgagatttacacataggtgagtccctgcttagtaacccaacagatatttcaacccaaaataatgtaaattgattgtttgatttccctgttttcacagtgacttttttggaggaagtattaagttctgcattgctgataccgctagtggttttaaaaatagaaatcaaaataagaaccctgatattaaggattcacaggtttctcaaaagtaatcgccatcagactaggaaaatagctataattcatgtatttagaagatatggattgtggcttggtctagctacagaaaaagaatattagtctgtatttgttacatgttgataacttgcaacacagctgaaagctacctcaagactagggagaattaaagtagtgttttctaatttacagtttaacaggaattggtatgtagaaaataacttacaacacaccagagcatttatatatgtttgcaaccgtaatgttctgtagtacttactagatccccaaggaagaggctttgaatgtggtttgataggtctgggaaaatccagtggcctaaactgaagatgttataagtgggatgccaggtctggaaggaaaggggctccctcaaatgggaaggcaatagttgatgaattctttaggggcacccttacctcaggaggccttaaggcaggttttatggcatctgtatgtattccttcaccatctcattcttccaagaatctggaagaaaggcatcaggcatctttttaacagttcagccacagatttgcttcacttctcctattgttgtttttttctcattcttttttgggagtgcagaagaagaaggttttttgttgtcaggcaggtgggtcagcctcatacatacttcgtaccatgggagagcttgtggattgcttgcatacctaaaattgattctctgccaccagtggtgcccaattttgtctttgtgactcactctcagctctgtaacatctttctcaaaggctgagtatggttagaaagggaacaaaattctaatctgtcaaatactagcccctgtggtaactaatggcatgtctggctgggtagaggtaaggtagagttttgaaatcatctttgtatttttgattactgaatctgtagccagctttttaacacaagcaatttggggtaaacttactcgtgggactaggctcttcttttgctgttttgatactaagatactgtgcagaaaaaaaaaaaatccacatactaattgatcagcagccaagctgcagaaagtgaaaggtctatattgcaccgactggagcagagcagttgtattgttcagcgaaagcctgcaccttgttcttctcttgaacagaaatacagagctggtctcccgtggcttttaatgaatatgagtggggctttccaatgtccaggaatttgatctctaggctgaccaaagggtcaggaacaaagaacacattttttcacgttagagtggacccaggtgtaatttgtcagatttagtaactgtggaggaagtgccttaacttctccagcaggaaaattagatcaggcctaggcagtgcaattctaaaatggctgaaataggaagagaaagtctgttgagttgcattttcaaaggaagtgtgagcaggatttgttttcccttcctctcttcccctcatttcctatcataaccatgttgaattcattcattcatttagatgtaattttctcagcatttttcaaagtgggagttgatttcactctctgcagcatttctaattgtgtttgcacacaaatagctacaaggttgctcacatttcccttgttctgatcagtgcaatagtactttatgtttactctgtcaggaaagcgtcagatgtttttatttccaattataagttttgtaatgcatcatgtattttgctgacagtcttcaagttcttgaaatagtgaacaaattaacagcagatattgagtgagaggattagaaaaccaactggcaactcatatgatagaattcagatacagggatgggtggaatgggctcatttattttattttctcagtcatactttgtaattaacttaggcaaaaaaaaaaaaggagaagaagaagaagaaaaaagaaaagaaagaaacagctccttgttcagcagaaaaatcctttggcactaaagaatgagactatgcaaacaatattggttctgtacgacgttttcagggatttcagcttttattcaggagggttcagaaaggtgttggcacagaaaaaggtcttgtgtgtgtgtgtgtgtgttaaacaaatatgcactctgctcttacatgattctgtttaaaggcccagggtaacatttcatttttcttggcacagggcccatagactctcccattatgaaacctatggctgttctgccctagtctagagttacagggctctgtttacatttttgcctgtttcagaatgcagctgactgctcttaaagcccggatcagattcacttctggtttaacaactgccctgtttatttgaaaaaggagaaagcaaaaccgatcactttgcttcctacctcgccattgatgaccaaatcagtaaataccatttccaaagccagtttatgcagaactggtcatgtgggatctcactcgtccctttctgccagctctgtccaattcagccttcaaagcctgccgggtgcctttatctgatgtgttggtggtggttgtatggaagaatgtggaggtgctaaagaagtatttgtctgcattcaattatgcttcatagcaaccgttggcataatttatatttttgcctgcacattctgagagagccatttggcaaacaacaataataaatttacatttggatggtgtatttcactcagagaactttcatatgtattatctcatttggggctcacaacaattctttaaccagggtatgtattactaataataattaacaatagccagcatttacagtgtttatatgtcaactgctgttcattattgcctccttttgacagagaccaacatagagagtttttgacagagaaagtgacttgcccaaagctacagacttaatttgagggcaaaataggactagaatccaggcttcctttgcggagtttgctagactaaaccaggatatcctagatgtctgtctactccgtggcctgagcaactcaggaagtagctgcttttcatcttagaagacctggacgttttcatctagttgcaaaaagggtgtacagaaatccaggccagcacccttcaggggctctcaggattaagtggtgaggtgtgcttctaggggaaaataggatcattgagggaagagaaaaaacaagtgactcagacactagggtttaaaaagaaaaattggccaggtgcagtgacttgtgcatgtaatcccaacactttgggaggttgaggttggaggatcacttgagctcaggagtttgagaccagacagggcaacatagtgaggccccatctctacaaaattaaaaaattagccaggcgtggtatgtgcttgtagtcccagctacttgggaggttgaggcaggaggattgctgagtctgggaggtcgatgttgcaatgagccgtgagcacacccctgcactcagcctgggtgacagagggaaaccctgtctctcacacacacagatttatgtcttaatgtgttataaggcatgagtcagctcctgctgttcctgcaccacagaggcaacttcctccacaacacatatcaggaggcaagtataggttgcatgtggctttttccctctgaagaaccatgcagtggagagagacagcagccctgggcatatgcaccaagagggaagtgctggcagtgtacttcggctgcagtcagacctgccatgggcccacactgtgctccacagaagacctggacctccactttgggacatggctggctggctgctgggtgttctttcattttctcctattacactaataggctccttttaatccagagttgctgctggtggatagaaagagagtataaagtgattacaagctccatcagagcaaggacctgtactttgtcctctatgcataccctaggcaagctcagtgcctggcacatagtagatgcttggtccctgtcttctgaacgaatgaatgagtgaatcagggtggtggtggtagagatatgtctctggctggtgaactgagaatttacacagattagacacccagtgacaaaaggaaagaaagtatttccaatacaagatcaggcacagtcatggacatacaaaacggaaagactagagatgatagagcaaaatggaaccaagcaaagccctaaatgatgtccatgggctttaataacatgtgttaacaaggtacatgtacctagattcttcctgaacactcagaaatctagcatctcttcaggtgagcatcgttcaataaaagtgagaaatgggagtaggacaaatcttacattaaacctcacagtacggcagtgagagttttcaaagaaagcctccaccagcaattttaggctttttggtatcatttcttcagctcagacaccttattcccgtactgtgagcagctctagaaatcactcttagttacagagaccgtcgcttcaaggctgcagtcaaagtagttggtgtcaagtttgagattggtcggaagctagaccaggtgggccctcagaacgtcctatggacattaaaaccaattgtcaaatatacagtattcccttttctcagtggctgaattctcagtgattgagttcttagcgtcgtgtagattctgtaccagttatattcaggctacttgacaaacactgattacttattttgtactctgaactgtaagtgaagagtgaacttctccaggtcttgccagacagtgagcccactagagtcccattgacagtcttaacctgtatttatttggttccagccttagctgcttctgtcttcctgtgatgcatttctcctctgtggctcagatgtgttcacaagttagtttaggtaaccacactggatactttcatccttctcctaatctctgatgaaggtgagatgggttttggagcacacatatatttggagagatgaggttgctccttccactgggtgctcctcttttgccagcaccacatctgcagagccgcaggacatccttccgccccttctgatgagcctgcatgctgccaaagttgtttcacaataaagccttaataatcagagccatgttgtgttatgtgcttcatacaggagaagccccctgccttctaggctgttttgtgagagcaatgtcaaggcatgatgtcacccaccctctcaagggttcatctataagcccatgggaggcttggtcgggcttgtagagccaccatgtgcctagggacatcccctctgatggcgaaggctttgttgaaactgttctccaaaaaaattattgctaattctctcttcccttaaacaagcagttccttaggctacaaaacttctggcagggcctccccagcaggaaggcatgtgctccccacattgggcatagctcaaacatctacaactctgttttacttacagaaggagggaggcagtggtatagagctccgcggggtttggccttagaaacaggctgttcccaataagcttggctctcactttgattatttagaacttatttaccttgttacacatgttatgtgtaacatgtgtaaatgttacacatgttatttaccttgttacacatgttatgcaatctctctgaaccagtttcatctgtcaaatgtgtatataagtaataataataactactatttattgagcatcattcacatacaggtaccagacgtaaaattgttttaaagcctcaaagcaaccctataaaggagataaatattaccctcatttgggagatgagaaaattaaaggttagagaagttaaataattcactcaaggacacttattttgcaaagaactgtaaatcagtcccaaatcggtttgcttccaaagcctttatgttcttcactacttctgtatatttttcatgggattaaaataagatcatgtatgttaagttcctggcactcggtgaatgctcaattaatattatttttttccccgaaaggtaacagttgttagttttgtaatggctattattttttggttttgttttgtttgcttcgtttctatggtggtattaccatggtagaagagaagaagcaaaaaagagtagaaatgagataaataggaaacttagtctaggaaaatgcttacccctgtttgtgtattggtgggggaagggggataaaggaagagagaaactgtttaaagtgaatattgtacagtttctttgcatggcaggttgcttatgatctggatacgtagaaaccatttaagaaaggaaccccatattccgctgcatttggtcaaaaggcatggaagagtggatagacgtctgttaaatgaagacatatgggcattttgaaggtcacttatatggagtatcattttcagtgtatgagtaatgttggcagtgtgtttccacccaggaaaaataaaagtaatcttggatggtgactataaattaaatgtggactgttccatgagggctgctccaacaccaagtgagtgtcaaactttgaagtttctgggtttagcagaatgcatatgcattctgcaaagagctgcaaaggtgagctacaaatctgcattaattcaggagaggatatgggaagactgttttgcttaaatataaaaaatcagcttggttaaagtgtaaatacagttactataactaataatgtccaagtataaaatttgtagcaagaaaagaaataaacaggcaatgagaagtacctggtatagaagggcatactagaagaagtggttaagacctagcttaaataatagtcttcctaggatgaaatttcctaagacagcatctgaaggtgccagtgatatttaatgattaatttagatattttcaggcccaatgtcttggtgtggtgggtttacaggatggatcacattaaataaaaaatggtgctaaaatttcatgtaaatcaacattgaagactaagtgaaaccaatgctatatttgtaaaggaaagaaaaagaagagcagagtcaacatattgatttttcattctttcctaaacttggtaatgaacttcttttatacattatgtacaaaatgattgcatatagaactacgtgcctctgatggctgcctggtttaataaactgtgattattgtttttctctctacatttcaagctaccatatgtactgaatttctgggatatatcaatctcaaagctaaacctaataggatatactgactttccatgccacacaaggcttcatgagccatgggaagtagctttggagcgccatggttctagaaagaggattgtcaaagacagacactcaggaaaaaaaaatgttttattgtcttaatgatttaaaagttcaactcttaaatcactagccataattcaggcctcttattgagtcagtcatcagtagaaaaacctttcttgctttgatctttgaagaacaaaataaaagatgctagactaaaacctaatcagaaattattgatggcaaaactaactagttggaataggctattggcagaagtctctctcccacttttcttcttttcctttggtgttatgatttaaggggaaaaattatggaagacaagtttgttttaaaaactcatagggttcatttgtgggttttgcatttgtatatatatatttttaaataataataagaaagcacttgagaatgaggattttagcctatgctgatgctactgcttctgttgctaaacattacttaatgcttcctgtttttcagaagaaatagccaagactagttccttttcttatccacattcagccatttcccttaaaaagataagttctgaaaaaagtacttacctgttgggcagtagaataagtagaaaaatggaaaacccaaatgtgtgtgtacaatgctgggtctgacctttatgcttttaaataattcttactggaggcaaattctgtgtggttgccggctttcatagcagcttcagaggcaggcccatgagagacgagcgaattttcagggtattgagtgccttgctacattcacactgtatgtgccgttcaagattactattgaagggaaaatcacaaggtattggtttttaaggagggtattcgtatttaaggctatttgctgtaggaattaccttctacagagtttgaactctgttctgaaaagtctgagagaaatagaaacagttcataggaaattttgaagtttggctagcctgtaaaccacaggcttaacagtgctctaaagtcagttctgagactttgtaactcttgatacataattatgaatgcatttttgctttgttgattgttccaataaacagaatcagtggattattggttaagcagaatacaaatatgccagagaaaattcattctctttgtctcactctgaaaatattgcatcaaataatctgaacgagaccaaaaaagctttttgtctgagtttctacaagtaacagtagaaaaaacaatgaaagggaaatagttaaatatagaaaatcatcaaaaatagaaatcatgcaaaaagtagacatctcgattcttaaaaattatgtttcccaagctgtgcaaactttcctcagttaaccacatactcacatgaatgaagatttcacaattccagtaaaagcattcttacattcaccttgaatggttttgtcccttgaagaactagcatcagtcatcagacagcaatagtatgtttttcttcttatatttagcagtaagcattttaaaagccatatcctcaccaaaaatgtacagatggatcattgcattataaaaacatatactaatatagtcagaaaacaaaaactgaaagataatacaccacaagttataacagcgattttctcttatgaatgttctttttttctttctcttattctgcttttcctgggattttgtacattcttacagtgggtaagttttatttttacagtcaggaagaaaggccacattctgtagccgtaaaatgtgtgtctatgagtaattggaaattaaccctgtccttcaaacttggtgccgtcatcacgtatatgatccgggtgtgtgtgtgggttggcacatatgtacatatttcacagattatcccattcaaagatgggaaggtggaagtgtctgtcctcaacaagtactgtggtttgcctggctgaaatgcaaggaaacccccaaaagcaccagagccctgcatttattcagctgaaaaaatgtgttttcttttttaaatcagagtctcctaagatagaagaacttagatggctcatccagtgctgggttgaatgataaaacccagacctttttggtgctgcgttttgattcatccctgaatgtgacaccctggtacttgggttcctgggtctggctttacaggatgtgacttcagtcaaggaaagcctggtgcctacctttgcttatttgtattctagtgctgtaagctcccctcctctcatgtgtctttgttctattaatctgcaaaacagggctcgacttgtgattagtccttggagcttgtttctattaatcagtctgcaaaacaggtcgacttggatgcttttgttcaagagcttaatgtgttctccttgtcaggctgtggttcaggctgctcggtttgctttaaacgggaccagatggtgaaatttggtttttatacgctgattgcactgtcaagaaggaaaatactgtttgaaaagacaacaggaaaatgctagtgtggagttgtagagtgatgtttcaggaggaggaaaagtttatggaaaatataacttatgtaacctggctgtggtgtataataaactgcacggtgcagttgactggaacagaaaataaggcattattcatattatagtctagaagcatggtgtcaaggaaaggtcgcctattaataaaattttatgtggatttgaaatgtaattcttttgattcttaaagtgggaatatcattcttttagctacagtattagctactgtaagaagacccaatacaattttgtgcatttcctcactttttcctttccaccctcccttgtgccaaatgaccttgccacagattaaaattattctacctgttatgtagggaaaactctgtatctcaattttcttatcttcattatcaagggacaaaaactgacctacctgtggagatagagtgtgggctaactgagtgatagttataaattgctttgtaaaatgctcattatcaccatttaaaaaattctcctaactctaatgtgcaaaggatagcgtcactggaaaggaattgaaatgcataacttttttctagtgatagcgacactctaggaagaacacagtttttattggaagttgtcttttacatctctaaaaatttcaagtaaatttagcattcattacttgtgaaatagctgccccctccaaaaaatctgttgaagtatatgcaaggagcaaagtctcaaaactccaaattaaatttgtcatcagtgataaatttagtcctgtgagatagtttaataagtgcttcagcttgatttattggctttgttagttaacaagagtgtattatgtcttgtacagaacttagcagagcaatttctgactagaccttccttgattaaaataaaaaactgaaagtctcattttagtcacggcgatggtaattattttaacatgaaattggaaggtaagcacactgcagtcctgtcattaatatttaaaaaaaagaaagaaaagaaaatgtcagaatgtgaagggaaaggcatttaaaaggttctagttctttatgtttgtacgtactttatttcttttgtgtgtatgcagagcgtctaggctgtttcactggttggggctgaagatgcagcccttgcatatataatcactaatgagtgtcaggattcagctgctaatttgaaaggctttgtggctctttcaccccaaacacgagaagcttcattaggcgctgttttgtccagcctgacctttgctgatctctagatcacagctaaacaccaacattacaccaacaccctcccagttgaaacagtccagacatgattcctttggtgcatatcttatcagaatctgctactgacataaacttgggtgtccctgtagcttgccacataattaggattaccttcccccaaagaggccctatttacttacaattgtgttcagttgattggagatttgaatttgagagcaattagcaaatttctcagtctctctctcttttttttattttctaaaaaaggcacttttataaggcatagcttttaaaatatgttcttatggctgtttcagtgtaagcaacagacagctactaataaggtatttctctctttgacttaggaaaaatacataaaatttattattagtgatatcagattttaaaaatggaaagaaaatcaaatggtatttttttttcctttagaggtatgtctttgggagtacactatcctcagaatcaaaccttgtagcaagcaggtggaagagacttttctgcttacactattttaaatatcctgagcaatgaaacaacaggcatgatttatttgtcaagcttttggttgctggggagggaagccttacttttcagtgttattgtttgtagattctccccctactcttctcaattgctagagattattctgctttagtttaaaattttactgtatatttgatatgaagcagtagctaagtggagatatcttttgacattatatgtaattatcaaccagaaaaatgcatctttataaacttatttttcaacagatccagtcctctacgtcaggtctccggtgaccttattttgaagtggtttgaattctctttcctttttagagtcataaaattagagatgggaaagagctctctgattgcatcactttttccacccttttggccagtgtgatctccctccctccagcatattccctggtgttccattcagcctagtttaggataagaagaccagggaggcttcttgtccaggccctctgggaaaatgtcccacggcccttgacatgtggataagcttttaggcatgcaagctgaagttttctcctgctttgagactgcttcaatattcttgagttcaatgtcttttcttgttgttcctttcttctaaagcatcaagaacttttttctctgtcaaacagcctgctcatattgtgaacagcaacaaaaaacccacaacactacacacaggcatggttttcctccttcttccgttcaaaacgacaacgttatttaaggtgtttcgttgttattaaccacgtgtctaagacatgcctaaatttgaatggttcataaattttacctataaatgaatctcataaatccttagccatttcatagaccctgtgactacagcgtctcagaatcttgttggtttagagccttttcaggagtccaggaacaagatggggatactgacaacatttgtttttagatggatagaagtaaattaatcaaaatcctttgtttatgatgcattgccatcattggtctgtgcctagcctttgttatcatcatgttatttttccatttatgagtaatgtagtgaacatccattaacccacagagagcctgattactagaacattgacaataatttgtgtttatctatgtgctttctcgtttcttatctcctgccttctttttccaggtatacattaatctgaattttgtttttttcattcttttgcttatttagatgcttcttataatacacacatctaaacaatatatagttattggtttcgaacttaatacaaaagttactgtgggtttctcttttagttatggaggaataagctcctaacaaactaagtctcctgcaaataactataaataacaaataaaataactacccaagggctttggaggtgcacagaagcaagtaggtttttggaggggagttgaaacttagaggaagcaactccaataaagtttttcatttctgttggtttctggagggtagccacagtttagtaaaacggtttcatgatatggctaaaattctgacagacagcccatactcttttgggcaggagaaaccatttgaaaacgctcagagtaaccagagccaccacagagtgagggggaatcctaggggaaaaaaagagagagctaaataagagaaacaccaaattctttgtgtatattctacaaagtctctggaccctgagtcatgcatgtaggggcagattgaaagtgtctaaactgagatccgagctaccgtccaccgtagatatcaacatttaaacattcaaagaagaagtaatgaaatcttacagaaaatctttccgaaatttgaagacgaaatgcttcccaacatgttttatagccagcatgacattaataccaaaacctaacaaaaatgtgttaccaaaaaaattacagaataacatgcctcatgagcagaaactaaaatactttccggaaggttagcaaatcaaatccaacaacatatagaaaggttaatagattatgatcaatgtggatttataccaggaatacaagatgggtgtaaagtgaaaaaaaaatctatctaattcatcctattaacaggataaaagaggaaaactatgtgaccattttaatagatacagaaaaagcattcaaaaagactcaatattattcataataaaaactttcagcaaccaggagtagaaagcttcatcagtttaataaaagactacagtcctacacttaacatcacaactgatggcaaatattgaatgctttcacactaagatcagaaacaagataaggattcttggattgatactgctatttaccattgttatgaaggtcctccatggtgtaataaacacacacacacacaaaagaaataaaaggagtgaagattggagacaaagaagtaaaattgtccatttctgcagatgacagggttgtcattgtagaaaattctaaggaatttacaaaacaactgctagaagtaataagtgaataagaatgaggttatgggatgcaggattaagatacaaaaaccaattgtatgttttcataattgcagcataaaatttaaaatgaattttttaaaatgttaattacagtagcaccaaaaccttaaaatatttaggagcaaatataacaaaagatatgtagaatctcttcactgaaaaaccaaacaacattgctgaaaaaattaaagaagacctaaacaaatgaagatatattatgtttgcgaactgctcagttctccctaaattgatctgtagattcagctcaatctactgattgggtaaaaatctcagcaggcttttgggctttgaaaataaacaagctgattgtaatattttttgaaaataaaaaaagatttcgaatagtcaaagtgagtataaaaaaataaaagttgatggactgtactatctgatttcaggcttactatgaagctttgattattcaaaacaaagtaatatgaaaggtggacacatagatcaatgtcaaagaaaagtaaatccagaaacagacccatatatatacagccaaatgaatttggcacagtttcaaggcaatttaatgaggaaacagtagtcttcgataaatggtacctggacagataaatatcaatatggaaaaccgtgacctttacctcataccacatacaaaaataattacaaaacagatcttacacttaaatttttttaaaaaatgaaatctataaaacttctagaagaaaacttaatctttgcaaccttggaatgggcaaaatttcttagattcggacacaaaaaacataaacaacataaaccactgaagaaaataatgacaaaattttaaaattttcagtctttgaaagacatcattacaaaaatcaaaatgtggtccatagtcttggggaacatagtctaggggaacatattttcaacctataaatctggatattatgtaaatctctatccagaatacataaaggagtcttacaacccactaataaaaaagacaaacaccccaataaaaaatgctcagaagtttgaattgactcttcataaagggatatatccaaatggccaacaagtatatgaaaagatgttaaaaaacattagtcatggctgaaatgcaaattaaaaccatagcaagataccactgcacacacaatagaatggctaaaatttaaaaagctaacaataccaagaatgacaaatatatggatccacagatagaggcagatatgaatgtaaaatggaacaccctctttggaaaactttttggcagtttcttaaaaagtcaacccacatctactgtacaacctagccattctgctcctagatatgtactcaagacaaataaaaatgtatgtccacataaagacttgtacacaaatattcttaatagctttattcacaataaccaacaccaggaaacaacctgtacattggaatactactcagcaaataaaaggaatgaactatactaaaacatgggataacatgaatgaatttgaagatcattatattgaatgaaagacgccagacacaaaagagtacatttactgtgattccatttgtatacaattttagagaacacaaactaatttaaagtgacgaaaagatcaatggtcgcttggactggggacagagggaaagacacagactgcaaagggtatgaggaatatactgggggtgaaaaaaatgattggtatcttaattatggccttgtgtcttcgttatagtatgtatatatctgcaacattttataaagttgtacaatttgaatagatacagcttatcatacataaattttatcccaataaaatttttttgagaaggatattcggctgaatgtcatcttctggggcttatttcattaaacatttattcgatatgatttaacaaatatttgaagaatgtaagaaggaaggaagatagataaatttatatcagtcacttctgtagtgggagagaaaaaagatgaaaataaatccaagtcttcttaaacaaaacaacccaattctagatttcatatctatccatcttagatatcaaagaataacctttctagaaccatgctcaccataacttacattcaaggctattattgctttcagtattaagggaaaacttcagtttgtatcagcaacattctctaatctgtcaagttatgcagttttttgttttgttgtgcttgaaatcttggagcagcaaagcaagaggggcatattagttaaaacacttttggctgcaagtaataagacatcaactcaaaatgactcaaaacattggaaattactggcttacataacttagaagtcctcagggatgaccaacaccgagaatagcttgatccagataccaatgttattattggaattcacttcttatttcttattattggctgggtctttaagtgttggcttcatctgtagacagactcctcttgtggtggctgctggcagtttgagctttacattcagtcaagagactctcattgttttagcttgatttgcatgtttttctttggaccaatcagtgtgggaaggaggatggaatgcactgattggcaaggtatagtcatgtgctccttcccaagccaggcagggtggaccccatcggtaccacacaaattaacagtggaataggagtgagttttcaaaggaaaattggtgtgctattaccagaataaggtggtttaaatgttccacaggcaaaaatcacagttaccctctctctcaaagataaacacatgaggtaagtgacgtcactaagaggaacctcactagtggaaaaaattttaagttcctggtcctagttgtcttccaacctctttttccaaggaccatggccatctgttcatggcacaggaagctagaacactctcaaccgtggtggtggtgatgatgaattgaaaatcctggaatggtaaatgccttcttaaacttccattaagcccagcaatctgacagtgtggctgtattggttagctatagctatgtaaaaaattcaccacaaaatgcagcttcttaaataacaaacatttattatcttacagcttctgtgggtcaggaaccaaggtgcagcttagctgggtcctctagctcagtctttctcacaagacagtaatgaagatgtcgtccagaatagtggtctcatttcaaggcatgacttgggtggaatccacttccaacattactcaggtggttgttgataggaatcagttgctcacaggttgttggactgaaggcctcagtttctcatggttttctgggttttctgtttactattggccagtgcccttcctctatgccttgccatatggacctctccacagggcagctcacaacatggtaactgtcttgaatcagaaggagcagaaagatgcaggaagatggaaagcagggtcttttggtaatctaatctcagaagtaatactccatcactttggctgaactttttttttttattagaagcaagtcactaggtccagctcatatccacacccaagggaggaacaattacatatgggcatgaataccagacagggagatcgctgggaacatcttagaggctacccatcatcttagaggctgcccatcatagtggcagtggcaacagaggaaatactttgctaatatctcttgccattgaagttttctgttgagagccttaaatcatggactggatacatgaggcggacagaggcatttccagaagctaggtaggacctttggcaagatggagtttatgttcatggttactaatgcaaaccagataaaaagacaaaaccgaaactgttagagagtttgattgtgaggtacagaaatgattacagaaacaagctgagaaaataaatgcgtgacgagaggtgaaatagagatacatgccaaggcttgtatttaaagtgttcaccacagagagaatcagccaaaaaatgtccaaaaccaagggaatggtttacaaattgcagtgtgtccatacgatagaataccatgtagctgctaaagatacttttttggaacagtggcttttaaactttttttaaccacaactcacagtaagaaatctgttttacaccaaaaataagtatatataactatttgaactgaaataaaaatttcatagaggatgtttatccattgtacataatatgcactttgatatttttgattctattctacaacattttttatagtggtaaaatgtgtatattgtagaatttaccattttaaccattttaagtggcattaagtacatgtacattgttgtgcaattgtcaccactatctccagaacttttccagcttctccaactgaaactcagttctctagctcccatttccttcttacccagccccgagtaaccaccattccattttgtgtctcaatgaatatgactactctaggtaactcacataagtggaattacacatttgtccttttgtgaccagcttatttcacttagcatgatgctttcaaagttcatccatgttgtagcatgtgttagaatttcctttctttgtaaggctgaataatatttcattgtatgtatacatcacatgctgtttatccatttatttgttgatggacacttgggttgtgaaggtacttggagcaaaagtgtgaaacctctctgtgagcatcaggttgaaaatctctgttgagtcacagtatcctaaactgcaactaaggtcctcttctcccttcattttcatgcttaattattattattattattattattcgagacaggcccttgttctgttgcctaggctggagcgctatggcaccaccacggctcactgcagcctcaagcttccaggttcaagcaatcctcccacctcagacccccaagtagttgagaccacaagcatgcaccacaacctctggctggttttttagttttttgtagagatgggatcttatgttgcccaggctggtctcaaattgttagactgaaactgtcctccagccttgcccccgcaaagtgctgggattgcaggcaggagccactgcgcctagccttaccgcttaatttgagagacatattctgtagatatacccaaatgttgtgcacaaatggcgtgcactgtagctgggattgacaagaatcacgctttgactttagcaaccctgaaaaatgttttttttttgtcatttggttgcatgtggtttatagagattattctgagtctgggcattaaattgattagttgtccttcaaaaatccatgggttatggttctaagagaaaaagatagcaaatcaggacacatgtgcacccctgcatcaatggtagaaacttattcctgtgtcttctcaagtttcatttgttcattaacttaactaccatttatcgaacgcctgctcactgtaatgtcaggcacagtcctaggtgctgggaatatgggaatggacaaattaaaatactgtccccagaaaaccttattagcctcttagtaaaagagagagagaagtagatcatttaacagactgtcacaagtgctacagcaattttgtaagatgacttgggagacagacatgatgagcacccaattcagcttgggtaaggacaagcttcaggaagactgagacgaatctggaagaggatatttaaggcagaaagggcagcatgcccaatgagtagaagcaagttagaatgcaggacatgtgtggtaagatgagaaggtcataagggcctcatgtgccgggtgagagagtttggatggtatcctgtggttttggtgaaccatggaaaggttttaagcaggacaattatttggctatatttatcttttggaaagaactctagcagcaatgtggactaagatgaagggaatgggaaggaagtgagaccaggaatgttataattgtccaggaacaagatgttgaggatcttactttgaagcatcatcacgtgaggtgaacaggaaagaaagacccaagacaagcggagaagacagaattgaaaggtttagaactaatgggctgagggcaagggagaagttaagattaaatttctggcttgctggctaatattaaatgattctctagtaatctgataatgaaccactaattgagtctttttccaaggagccctattgtgagaaacgtttgatgattttctcaggatatagctgggcaccctttctaggtggcacatcctgcaagcttctttcttccattatctgtggaggtatatttatggagagaatcttagaggttaaaaattggtctatgcaggatggctagaggcagaggaggtgggaaagaagcaaggaaagaagcggccattgaaactagaacatggtactaagggttaggataaagaatgtagcaacatgagtctggaagtagaaataagccaccaggcccttagctgggaagagtgggagatttgggggatatagataaaaatagctcagggcacagatgatttagataagactgtaagtgatatgaaggcagttggcttttagaaaaagttttgtagagatataattcatgtatcgtacaaatcacccatttaaagtgtataatttagtggttcttggtatgttcagagttaggcagtcattaccacggtcaattttaggatgttttcatcacataaaaaagaaacttcataactatgagtagataatttctctaattctactaatggccatttctctgccctctaccccctgtctccagacgattactcatctcctttttgtctctatatgtttgagtattctggacacatttaaaaaaaattcctcccatctaactataatttatatattcttcaatcaacttttaagtggtgcttgctgcttattatgggggcttgtttgcttgactgaccatactgggccagtagggtaggggacaagtgaagggaggttttccaaaacctcttacattagaatcatgagctgactctccagctgtccacctcatgatggaccatcctatgtgtaccttaaaaatgaaaatgaataataaattttcataaaagaaagtgctaaaatcaaagtggataaagtgattaacatggacagataaaaaattcagtcaccaagcacttgtacaaccactcacaagttgaagttgcagcaaataatttagatattgctggtcgaatgacatgattctagctgggctgaagctactctccatggagttctctgggtaccttccatgacacagtgataatgagccataagtgctttccttgaagaattcttaagaatcagaccatgctcctttagggaaatttacttgttttatattatcagattaataagtgtagagagggaaaccatttgcctgctaatcaatgggggatatggaaggagtgatcatgataatgataatgatggtgaagatgataatgataatgataataacacattgcatttgagggcttactcctgggggaggcactctctgaagggctttacacacctctctatttagttctctacctgctccttgagtacctttaactatagaaaaggaggctaggttcaagagatattaacattatagtaatgtacttaataggagaatatacttaattggagaagtaggactgaacttggctctttctgctatgctgctgctacatctccgattctgagatttttcatctataaaaaggagtaacagtaggcatgcatccttattaggttgtttgctgctatgggaactaggtgagttaatacatgtaaactttctaggaccatgtctgtcatctagtaagtgcttaatgaatattagccattattttgtattattgttgtcattactattcaatactacttttgatattaaaaaaagatagtccatattttaagaaaaaagtagatggtaagaaaacagaaatgcacacacataaagtcagtgaaaactacacttcttttccacttccatcaaagactattaaatgtagggcctgctattgtatatttattcagacatcaatcttaatcagctcctttgctactttggcggtaagggcattgtaattctatttttatcggttccttcctgtgcaccagacattcaaaatagcatgagtaaggatcaaaaatatcttaatggatttggttcccagagatatcagtgaccaggggaagagttttgcagaaatttcttcctgaactgataaggaaggtaagtggggaaggtgtagggagggctggctatgcagcttgctgttaagtctgcatggtgtgaaaggcaaagatccagtggtggagtgaattacaagggtccctggaagaatctgggggatcagagcataaatgcctcctattttcaggtttatgattgggaccagtgttgtgtaatcattgaagataatactgacccctcatgaggtagccatggttttggtgaacagagttcctggtgtgattgtgttacacacacacacagacacaatatggaggttcctatatgattaatatttttatttgtatatcttgcctgggcatcttttctttcttttctctctcctttcttctttctgcttctctcctaattattttacctcttctcctccttttaccctctttttccccttggcctctctttcactctcccttaatgccattttatattcagactagtcatcatcaaaaagttatcaaagtttgtaaactgagattgatgggaagagaaaatgagattagaatatccagaacaactatagttcttacagcaatgcatacagtggtaggctatgccacatggtgaagtgtgacacaatcttaggtggtgcagaggtgcacatttgttctttagtaattatgtatttattgcatgcatattgaaagagagagagagagagagagagagtgtgtgtgtgtgtgtgtgtgtgtgtgtatagtatgccatatttgtgatttcatggatattcttgtttaggatgaggataaatttatttaagtaataaaagtgataccatatgtagagaaatacttagtaaatattagtacaggtggtacacagatgtagctaatgaatcatgactctagtacatgaggactgaagcttgggatacactgttgtaatacatggcatcttttacttgcatcgggggcctctggggagagctgtaggatgtggttgttggtccattccaagtgatctccaaggagcctccatgttgttttgccttggttctgccatagcatcagtaagcacatcttggagctaaggattctgaataaaaccagccccctcctacccccaacagttccacagctgcatctcttgatgaaagcccaaggcgtgagcaataactctgcaccagcaactcgagtttttaaacatttaaacatgtgtagcaggtgtgaatgttattctatgatatgcagatgcaagaaatttcacatcaatatatttgtttgtttgtttttagagtagaagtaaatctaaatctgagtcttgtctcttggagtgggaaagaattagatcgcacttgtaatgggggttcactcgaccttggctcccagcccagggcctgggggagatccaggccatttggtgggagccctctggactgtggtccacactggccactgctgatgggtcctctgttagtatccatcaggtactgggcccttaaaatcaggcaatgtctctgttttcactgacttgggcttggggatcccttcccaagctgggagtgatggcatgatttgggacatcacacagctgtgccagctgagagcttgtcactcccccactaagcctgcccccttgccaggaattccagctgagtcctcactactccagacaatccctcccttttcattctagaggaatccccctcctgcttaatcttgactgtgtctggaagcccttcaccctcacccctgtctccaaaggcactcacctggctctcctcccatatgtgttgatctagccttgtgccctcagtgacagcaaaagccagaaagtgtgggggtggggtgtttttgcaacttctgtttaaaccatcacatacaaacacccctgaggcaaaggggcacgaggtcttcttagaataagggagagaaaatcaaacacagattaatatctctatcaacaattctgtcatgtgaaggaaaaattcgaaatttttgtatatgcataaagggtatgttataatatgacacatacatacacacacgtattcaattcagaggctcagaagtgtgttcaaataggcatatgtattaagcatggtttcccgttgttaccagagttggcatggaattatagaatctaaatgttatgcttgtataggccttaacaattatctcttccaaatgcattttatccaaaaatgcagtaggtatttggggccacaaagcactgtttcagttgaatttgcaaaagcattcaaactgggagaaaataatagaatcagcccagtttctggtctaacctttggttcatttgcatcactgccccttcagtattgatgttttaaaactcaatggctaccctgatcctttgctctttgcattcagccccattcctcattgccctgctcccctctgcatcaaagggcagattgacctctgccatctagggtccagcgatccctgaagggccctttcctcaatggatccagctggacagcccaccattggaccggatgtcagggtgctcctggcctccagctgagcagcacctcttcctttcatcactccagccccatggcagggtgcagcatctttcggttgctaaatccacattcctcttctaacacttttgaaagtaatgctccaatttaatattaattcctagattgaattacctgactctatcataccttgctctcttagctgaatcctgattcaaagggggaagataagtctattaagtttcagagactaaaatttgtaggtcagaagcttagattctatatagaaatccacaggaacaaataataatacctttcatttttgtcattcaatagttatagatctattcttcttttgcaggcttaagagcaaagagtgtgcactcatggagttacattctagcaaggaacaggccaactgaaaagaaaagtaaaagaatatcaggcactgagaagtgctgtgcacaggagtaaaataggatggtattttaatatttggggaaggccttgtaattactataagcttggatgtagctttcaaagacactgaagccctatacagtcatccctcagtatatgtggaggattggttgcaggacccccatgtatactcaaatcagcacatatatacaaaaagtctgccctccatatacatgagtttcacatcctgcaaatgtattctcagtctgtgtgtggttgaaaaaaatccgtgtataagtggacccacacagttcaaacctgtgttgttcaagggtcaactgtactgtttttgctgctgcttcagattctacttaccaaaggtcacaaattagggctacatttggaatctaaatatgttgttttccatgtgcagtattttatttaaacaaagcagaaaaggctaggctgggcatggtggctcacacctgtagtcccagcactttgggaggcccacccaggtgagcggattgtttgagaccaggagttcaagaccagactatgcaacatggtgaaagcccatctctaccaaaaataaaagcaaaatttagccaggcatgatgccgtgggcctgtaatcccagctattcaggaagctgagttgggagggttgcttgagccagggaggctgatgttgcagtgagctgagatcatgccacagcattccagcctgggagacagagtgagaccctatctccaaagaaaaaaaacacacaaaaaccaaacaagtttaaaggtcttcttgtggaacatttactgtccagtgtgtggtagttcccataactatttccaattgttttatattacagcctcaccagcttaccatatctacatgaactccaaatgcagttccaatgtgaatttgagatcattttaatttgcttagcatcacttccgtttgagaacttaccatataccagatactgctgaacagttcatcttcacaacatactttgtgaagaaagtatactaactctaattttcagaccacattgcttagacctagagattacatgcctaaaactatatagctagtgagtagtagaaataggactgtttgcttactactaaagcctatctcttaactgagttgaattgaacgagcctgtgatagatatccgtggtgtcttatttgtgttagcaatgcctccccaacctgataagttccttgaagacgagttagttactcgtctaaatccccacattatcacaatagaaactaaacacaaattatgaaattataattttataaaattataaaccataaaagtgaattgattagagataaaacaacaaatcatagctttgaatattcccaggtttgtctctgaagttgatcagagattcttctgataagcaaaataacttagcaggtttctgcccaatggcacaaaacagacacatgaaatgccaactgtttatccagatgattagaaaacagccagtttgaagaagtgaaaagcctgagtttcaaagtggcttattaaaatcaagtacaacaagaaactaaaggtaaactttttgacattaccatggcaaagtgagaaagaaaggatgacatgtgtaagtaggttgtgttttcaatgtagtgttatcaatttctctttcttgggaaggatgatccctcattgtgaaattatgtccatcctactttttaggcttaaattttttaaaattgaaatgtagacgatagtcaagtggtatgtgtgtgtgtgtgtgtgtgtgtgtgtgtgtgttagtatcctttcatggtagaataaaaattaacaacttattagtacctaaacattccttgaaattttactagtccatgagatccaagtctgataacctctgcctctgataaaagatcaacttaaacaagctgatgtatttatcatatcacttacttgttaggataatatttacattgttattaaggtatcatagatatatgtcgatataactaatcaaatttatattgaacacttgctatataccagtttttagtcaaatagtttaaatgtctctttgaattttgttttttaggtattgcgtgggtaaatttcaacctagctcttccctgacctatattttctaaaattcaccattgtagggttcaaattatgtgttatttcatttaagtgtgtgtgtgtgtgtatatatatatatataaaataacagtttagacataatcccatatcagttaggatttttatgttccatgcaattttatgttaagaaaagtcaacccaaacaatcttgtacaaatgcaatctattgtctccatattttaaaacttcaaaggtagatatggctttagagattttgatgtggccttaacatgtaacccagatactgtttcttcctttacacttctgagctccatttctcacaggttggctccatcctcaggcatgctgtctccttaggctttcaaaatgatggccagccacttcgcagaactaagctgggaggaaagagcaaaatccagagactgagcctgctggctgatttggctcctatgctcatgcctgcaccaacctccagggctaaaggggtggaatgcacaaatggccttagcctgggtcacaagtgccatcttgctgggcctgaagtgcagccacttcactgtggatccccaaatggaagttggggctgttggggagaggaaatggaggaatgagtataggaaaccaactaacaaatgtccactacgagctgtttactgggggtaggaaataaacagcttgtctttgaagctcattttctttacacaattacaatcatttggtgtttattttcttcagttgttatcaggattacattgcaattgatatttcaaaattgccctgagtggatagccgagaaaaccttcgtagtgagataaatctgtacaaagacaaggtggtagagatttctcacttcttatacccctgttgtaagtttaccatttgaataaaaatggacagattcaattgcaaagtcattgaactattgctgactcttgtttccttttaggaaaaccacaggttctttaggaaagtcaacttttctccctccaatagttaatgctgttttcccaactgttccccttctgtatgacccttttctttccagatttaaaatctcttcatatgtgccttttaaaacatcttgttaaactttccattcatcaaataaataccagatgatagggactgtgcccttttccatactttttgccatgtggataataaatacatctatttacttcattttccatcaattaaaaatactacagtggctttttatttaatcgattatatggaagttagaggggatgggaatggaacattattagacttcttgtttgcgagtacttggacattagtaaacttctcttggagatccagtccaggaaaatagattgctggccagaaatagaaacagcattttttccccttaataaaggaagtcattgtttaaaataatacttaaaaattttaaaaagactaattgtccctttcctttttaagagtatttttgaacatacttttaaaagactcttggtatcttcatattattttacaattatgcagtgattttttaatgcagagcgtgtattgaagtctattattccttcccgcccaagttgagtgtataagttgtgggtgatttttgctctctttccagctgtgtcatagaatcacacaaatgagttcatactggggcttagtgcttgtagattttccattttgtttgctttttgctgttttcagtgtattgttaggttaaaggaatgcttctatctttgattactccctggtaatggggacatctttaccctggaaagcaggaggtaatgaagaacaggtgttcaatgtgaactttcagttttgttttctcagaaatgtgcccaaaagtagggcaaagctttccaagttttttaacgcagattattgtattgatagctgcagtatttcccctggtctccctccagcacccatatcccaggcctctgagtttgacagcacttgaaggagccatgaaaacttgctaacttacaattgataagttgatcaaatgaatttatgcaagacagtgagtgcccagcatctctgcctcaatgtttacacaggataatctcctagaacgtagcaaagttttcatttgtggtaagaaatagatgttgcttcccttcagaatctgaaataagattagacaaaaaattctagagataaaattgtcaggatgaattttgcttaaatatctgagggccggaggaacatttactcttcataaataagatttagcccccatagtcaacttccagggaacatctctattttttcaaggtcttttttttcatcatatgcctgcctcagggtgctgaactttggactgtaaggtcaggcaagtctccatctttttatcctgcaacaggcctgacagtctttgggactccttttcctaatgcagacgttgtagtttgagtcacagcagctacggagtgctttccactcgagcaagggtagacttgctggctctcaacttcgctgtggcacaaatgcagtactcaccgaggccagttctgtagcatctctggtgcagcgtcacccttttcctaatatattcttttcatttttttattggtaaaatatacataacataaaatttaccatttttaactattttttaagtgtacagttcagtggcattaagtacattcacattgttgtgcaaccatcaccaccatccatctccagagcttttttcgttatttcaaactgaaactcggtatccattaaatgataactaccattcctccttcacccgagcccctagcaaccaccattctaccttccgtctatacgaacttgactattttaggtgcctcatataaatggaaatcattcaatctttacccttttgtgtctggcttatttcacttagtctaatgccctcaagattcatccacgtgtcagaatttccttcctttttgaagctgaatagcattcccctgtgtttatatatcacattttgtttatccattcgtcaatggacacatgggttgcttccacctattgactattgtgaataatgctgccatgattgtggttgtacaaatacctgttcagattcctgctttcacttcctttgggtatatacttagaagtggaattgctgggttacatggtaattctgtgcttagtatttttagggattgtcataccactgtacacagtgactgccctattttacattcccaccagcaatctgtaagctactttttagcagacataattcccatcacaccctactctcaacaatataaaaccagtattcatctgattcttttcttaatttaaaattaaaaattttaaaaatatttatttgtttatttaatgtctttattttttagagacaagctcttgctctgttgcccaggctggagtgcagtggcactatcatagttcactgcagcctggaactcctgcgatcaagcagtcctccctcctcagcctccagagtagctgggactacaggtgcaccaccattcctggctaactttttaaaaaaattttgtagagacaggaatctcactctcttgcccaggctggttttgaaactcctggcctcaagtgatccttccacctcagccttccaaagtactgggattacaggcatgagctaccacgcccagcctgattcttgtcagtaaaggtttttctccatttttggggtgagggggaaagttggacactgcacttatattgtcgccacgggaagcagaaatgtatcaaaagaagacaagaagaaaaaagcaaaaactatggcataatgcagaagaaaagccagcattcacaaaggatacaggaccctctggatttaaacagaaaatgctataagcagggtgtgaaactcccatctgtccattgctgcttccttttagggtgtacctgatcttgtgtgtgccaagtacaaaatgccccgtgtgcctttgtaacggccaagctcccagtgctttctcattcccacagtggccatgtggtctacaaagtgaagcagacgccaggctgactctcaaataaagcctccttgctgctgtttgcctccagatagttcaagccatttcctttcatttttggaaaaaaagagtgtcagtttggctttctgaaaacagttgccacctttgggcaaagctaattaactacaatacacatgttcagttcaggatttccaaagagaaagaaatgtttgatactggtgtatgttacccaacctgaccacacatatggcaggtttgggccaagaggagggagcaggaggacattagttctgatttcaggtaactgttaactcgttctacttcttggaataatatgataccagagagagagagcttctatgtgaagctttgtggatttgaaaactgctatactgaatattttatgatcttgtcaaggcctccccttatcatgtgacctcaaggcgctaccatggctttcatcttgtgaagtcttgaacatttgtagttgcagaaaaacctcaagagactcagtatttcaaaagccatagtttaggttttattttctaggctgggatgtttgtgggttttcttattataaaattagagttgtcatagtgatgttgtgtatttcaaaccagatattctgtggtcgcagcaaagtctcactttaggaaatggatttctttatgaatgtgctaacattgtgcacagaaagtagcacaatacagataaacaggcatctttggtaggtggggtgtttgggtaaatttaaatttctgaggattgaacaaaaactcctttaccttaagaactgtgcaagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaactgtgcaaaattgtcctaaaaaaatttaagtagtctagtctctagatgtccgtagttaacataattttattgttctcactcatccagctttagaacacatggttcctgaatacaagtctcagctttgacctcagtgcttgttaacccagtgcctcagcccttcttagacatgaatcagaacctttggtggtagagcaggaaattggcactttagcacccagggtgatttttatgcctactaaagtgtgagaacaactgactttgaagctgtaggtgtttgggttggtggcgtatttatccctagaattgctccgtgtaatttgatgatgaggacatctttctgtttctttcctccaaaatggaaggcaaactaaattaaaatccagttaattcaggttctgagttgattgggacatggataattgtgatctttttgctgatttctaaaatattttcccttcattatctgttggatttcaagtgcattctgctctgtgttatagaatgagggttgatgtgaaacttagggagactccaattatatacatggttcaattactggttccataatttagggtgtcctcttttcccattgactttcactttcttcgtacttaaatggcaaggttgtactctctgatctcagtgtttctttccatctctagcatcttatgatttccttctttattttctaactttttctcttccaccctcaaaacattttctccatgcatagaactagaaaggccctttgagatcatttcatcttaatctctcattaggcacgagagaaaataagctgaggaacaaattggagatgctgctttgaaagagcccacatgagagcctggggcttcagctctcacagtagagctccttgcactgtggcatgaattgcttatcgtatgtggggctccatttcttacattccagccctgcccgataagtatttggtacggcagcagcagaggttgctctcaacatttggacattaggaatttaatgtgttaggattgattcatatgtgtcatcaaattgtatctggggacagagattctggggagactcacgtatgagtttggctggccacaagtaaaccccagatgactcttgttactaattctagaatacccaaacagcatatattgtgaacttttttgcagtgtacttgaaagggcatgacctttgcactccgaactatgttcaaatcctggtttgggaatttattaactgtggaaccctaggcaggttaccttacctctctgagccttatcaacataaaggttgtgaaataactagtttgtggattaaatacgatcttacatgtaacgattcctggaatttaatgggcaccaagtaaataccagctcatggatctttctttacttgttggtattattagagtttgaaactttgcaaacttgggacacataccaacaatttgaaaatacaaagggggtaattttaagcttcttgcgatatcagctttcagcaatttaaaaagaaggaactgttttttttttttttttggaaaattaggaagtcaaaatgccagactcatctataaatgcgaagctctttttgagcttttatagtacgggcttatgacatcagtaaggatccagccccttcattattggaacctgtcacagaccagggcaggaaacctctcccttattgtgtctccactttttcttgttctcagagttcctttagaacatgtccagggaacattgctggatgtgcattctcaaagcatgttgctgtactccataaatgctgataagctttttccccagaccaacagaagtcatataagtgaaaggacagagaagaaaatttatcaaagaaagagtgagaagaagattgacccccaccaggaatggaattttctctctatagcttactcctcttgatgaagtattaatttttaacaggaatacggatcacttttttccaggtgtgaattagttcctattgtgaagtatttgtcattccaaaccatttttgttcttattgctagctgtatgattgcatgaataattagtgcccatggagtgctttaagagcctaaccttcctggaaagacagtgctagtgtaaagggtcttatatatgaaaccattatggcactgtttaaggcattggaaaggtccagaatattctgtacccatgagaaaaaactgggctaaaaaacagaaagtgagtgctaggctacttctttttagtcctctttctatttgattcttagggttacagaatatcaggattgtaatattgcttaaagtttatctaaccatcaagtacatggattcctctacaacagtcctgtactacacacacacagacacacacacacacgcacacacacaggattggggagaaacacagagaaagagagaaagaaaatgagaatgaatgaatttatcaactctgctttaccgcccaagtgatgtatggaatgtgaccccaacatctgttaccccatatatggtcaagattgatttttgttggttgggtaccagtccctcttctgctcattgccatgtgtttattcccctcaactgaaccattcatcagttaaggatatgtgtcctactcaaaccccttttctttgaacccacatccatctaatgtctttgttcacatgtcagacagctcctcaaatagtcaaagggaacttggcattttccttaatcgtctcttctccagttgaattttcccagattcttcattcattccttatttttgagaatgaccagcaaaactaaaggaatggctgtaggttccttccattatttatataatgcagcttttccatagagaagcaatatttataaaggacaaataaagacatgtctgcagagacagtgaaattcttagaaagtatgctgtacttgaaaggcaagacacagaggttttgaatgcaagctgtgatgaaacattacccagggcagcgtcctgtctgtgttagagtggagaaacagagtcatggagcctcttggtcaaagcgtcactatgtcaatcttgcagagcagaacggctgtcaggttaacgagtgctgcatgtgcccagaggcagttctgagcatggtaggactacccaggtgagggctctttacctttgtgagtggggagctcccatacctcatcatgttaagccaagctgatctggaaagggacacattccaggggagaatcgggatgcttaattgatttacaccgttgatgaagcgcacaggcatgaattctggttgcctaccatcccatatggggaggaaagcgtaagttgtagaagccaccttttggcattaaaaaacaaagggcgctggagtaacataaggatatatacttagctttttctttttaatgtatgaatggaaaacaccttttatgcttcaaatgtatattttaataataaaaatagaactattgccaaaattcactccagaaggcagccttttttcttaaagcacaaagagaaagagaggagagatcaagtgtcttctcttttccatgataattgcttgtagtccctgctaactggccttttgacagggtcactggcagagcttgtgggcccccttggcgatgttggttggtgggacagagtatgggccagtgcctcagcaggaatggggcagaaaacagtaggctggttcccaggcctgtttgctctgagcaccagccaagccagggttggtttttgctcacctgtcattgcagcaatatgtagtgacgtttcaaactgctagcatggaaacaaggtaaaaacttcttgggacaactgggaaatttcatttagacagaatgtcagaccttagcctccagtgtaaatactagaggctttgctctgtccagttatgcagtagcatttggtgtggaattaaatcagaggctagtgaaaatccaggcaggatctaaatgtgttgagtacatttaagtttcttctctaatttaggaaaccttatgcttctccaccctttggcactgacaactacctggaagaggccctaacagtcttgaataggaatatgatcgctagattctctatcacagaataaaaaatgaagagcttataggctctctgattttttttaagtgctttggtcttcagaatctggcccagcactagttgttttgatttgcccagcaacctaacccatattcttgaataagcaagcaggatttcagctctagaagggtgagctgcatatattcacacaccattctattcatttttcagatacaggattttttaaaaaggagagagaacagggtcattttcattctattgcaaacgctttttatgtttcagggatcaaattatcaaatttcaggcaactttttttttaaactaggtcatgactttcaaaggccatctttattatcctcagcagaaacattaaacttgtaaaaaaaaatttataattttttttcctctggtgattttttttcttttatttccacccccacacatacaaaaaatgctcggggaaaatgtttgccttcacttcctgctattcagcactgtgtattgttaaactgatgtagtgtttatacacatcgtggttatggctgtagcccggctattgttgaaggatgttagacagccatttatcacagtacgccagtaaacccattgtaaaaatgtcctactagttaaatgaggcttagatttaatgaggctgtaagagcagaacgggattttgacatactgtaaataaggttcctatagaaatgtcatcaggattaaggtgcagattccttttgttttcaagcaacaatagtctccttgccaaggtaaaaagaagccccctcccttttaaatgaatcttttgaggaagttgttgtttgctcagaggaatgcatgaaacaagggtgtgtggccaggagatgacaagatcagagatgacttctttgggaaagagacgacactccccagaactcctttgtatatcacagccacacctggagccctcaaagcctccttgttcatacctgctgctgcatgtgaatgccattcaaatgtggtcccagtcccctcctcaaggagggcaaagccagcctcagaaagacttagtctgagattcctggccagcctttgaagagagtaatcaagttagacatagcaggagggcatttgccctttcaagccaagtggggaaacagagccagtcttctttgcttgatcttatcagtgttcaatgagatctaccattttgaaatcacagaacaaactgtagaaaatgaccagaaattcttgtgcattcaattttccccatgggaaggaaaaatcagttatttccccaatgtctaaggaaatgaattcagagagaacgtctccatacgcagccagaagtaggtacgtagggcttggcgttaaccactggggttgcagtacactatttacaaaaacaggcagtcttgaaattgccctattggagagaaatttgattgtcccagaaataaaataaagtggtctccgtcttcattttgctagggctcctggaaagcctcaattcaaagagatcagtgttgaaaaagactaaattgaaggatagcttgagagccaatagatgatctagaggcaacccatccacatctgcagtttccttagtatctttctgaacctggaacgctttagaggtgtggagtcttcttcgactgagtcttcaatttgacataacagtgtatccctttaggcttgaaccccgaactcacaaggtcttagggaatctgttgcttctattttggtggtcaccagaggcttaattttagctgctgagagattagtcttttatatttatttaatgttctcagtgggggaagaaaagttcaagggttgtgtttgccttcaatgctcactgcacataactcattttgcatccttgcagcaaatgcctgctaacttcatcaggaagtcacatttgggcaaggtgcagtatgtgctgggcattcttagctagaagggccctttctgcaatgtctccatctttagctgcccccaccaaggctcttttttttttcccagatccctcttttgctgtaagtttccaccatcctttttgcagagccacgtagaataatgttggcagagaaacttagcgatgctctcttagctcttttatcctaatagtggtttctgtatcctcacactgctagacagaatatctttctcaagacaaccaaaggcagctttttcaagaaaaggatacagatctggatgcacaacagtgaatcaggcataatcctgccactccagagctcatgaaccagtgcagtcattctcaagctttagcgtgtgcagtacataccttacccccagaggtgtgacttagtaagttcgagttggaccccaaaatcttcatttctcacaaacactgcagtgattttgatgcgaaaaacctcaagagaaatactgatgtagtgaggcagagggaacacagaaacatcatgaattacaaaactgcaggaaccgcctgaaggaaagtcagagtgctgtgggaatggagaaggtatgggtgccacaggatgggcctgggcagggcccacagacacgatcgtgtttaagccagatcttgaaggatgactcaactgtggacccttggcagtgctagagggaaggccttctgaacaggaaacaagatcaaggtgactgaggtgaaaggggaaagggcacataggggtcagtgcagccagagtgctgggtgcagggaggattctgtttggagctcaagaatttggagtttagtcttaggcagtgagaagcccttgaagatttttaagtagagaagagaaataatctgctttctgctttctttccacagtgaccacaagtgaagctgaggtggctttgggcagcattaagtgaacaaaaagggcaaaatgagaagaggcaggaaatgggaatcgttttacggctccctcctacttcccacatttctttgaggccgaattaattggtgtgattccattctcaatttaagaaatcaaggttaaatgacttgcccacaattgcattgagctggaactagggcataggtctgctgtctccagatctccagctgacttcccaccgcagcctgtcagtcagtgaaattaatctgcagtcattcgcagacacctgaaaatgtcccctcccacccctcaaattgcataataatgagtcctacagcagaaaacagttgtattctttcaaaagtttctctaatgtttttgaaatacacaaggaaatagtaaaagttaagtgaacatttgaaatacaggcttcttttatcattaaaataacgtctcccatggagtgagagtgagggtggtagtggtggggttcctgagattccaaatagattgtacttctggccctaaagattccttattagcaaaatctttgaatcagccaggtttgaatgataaataagaggacactgggcatttggaatcttcattatctatcataacaaatattgcctctggcaaagaccacatccctcagtctgagctctcacttcaaactgcaggggggccaggttagcagtgggaattgcatttctaagtcttgacagccaaggtccttagacaagaggggcctaagctttgtgacatctaatcctcgaatgtaacaaaagcagctaaaaggtgaagaagggaagcccaaaaggagaaaaaaataagggggtgagatacagcttcacattgagtttcaaagctggaagacagcttatagatcatgtagtcaaagtccccatcctcatctttacagagaaagaagtctagtcccagagaggggaaccgatttgcccagacccctacagctagttaggggtgacgctagcatgaagaagccacgtggctcttgtcaccacaccaagctgttgctctcatgtctcatgatacaattgtgctcacagattatttcccatggatccactgggatagtttatgaatcctttaaatgcaaaaattaaataatactgggaagccagagagcctatgagatcgggttcagtatttttactgtttactggctgtgtggccctgagccagatctcctctgagcttattacttcttctgaaaaagggggctaataatctatctgtacccgatacagagtttctctgaggttaaaatgtgtcatttaatgtggaaatgctgtacaaactggaaaactccactaaaacatatgctgttaaactcttaaatataaaacttgggtgctgaacaggcccctaggaagttcacatatgcagctattatttttctgtgaatttgtttatagggtgtttagaagcacctaggagtggccatattgcttatcctatgaatgcaggttttggaaccagagtcagctattgtcaaaaatcccagttcccccatttgctcaattctggttatcagtggtttacttcacttctccaagttgagatcttcatctgtaaaatgagaccaataactgcatctaatttataggagagttgtgagaatcaatgagataatatatacaaattactctgtgtcacacctgaaataaaggaataacttatacacaatgtctatttttactcattttgctttagttgttgtctttattattctgatatagacaaggagtaggactcttggaaccccatgagggcgggttttaggctctttgattaaccactgcatcttcaggtctgacaaggcctggcagtagcagatgctcaattaatattttggaaaaaagtaatgagttcatattgtaggggaataaagaagggggaaaaaagaccctttcctctaccctcttatgttttgtggctggcgcctgtgaattcaaaagacactagaaaggttagtaggagaaaaaacatacagatttaattgatatttttaattttacatgcacaggggctccacagaaaattgaaaaccaaaaaaagtggttttggggggcttataccattgaacaaatggcagtaaattgtggagatatgactagacagaggaaagggggtttgggcatctagggcagatgaattgtgagaacatgacttggaaattttgggggaaactaatggaagagaagggtaattttagtaaggtctgtttaagcagacttatcttggtgctggctcctcacttctcatgatagggtatctctctttatcttggtttaggaggaagggaaatttataccaccatcacaaatggaagtttatgccctgtttttaggcagaaaaggggagaacagagaacttttcctgtatctgctgattctttctttttttattgaaacaaggttttcctctgtctcaggctggagtgcagtggcatgatcatagctcactgcagcctctacttcccgggctcaggtagtcctcccacttcagccttccaggtagctgggactcaggcgcacgccaccacaccctaatttttgtgtagagacagggttttgccatgttgtctcagctggtctctggtcttcaactcctgggctcaagtaatctgtttacctcagcctcccaaagggctgggattccaggtgtgagccactgcacctgtcctatctgttgattctccgttgctttcagctcaaaaatactccttatgacaaagcggcatagttgggggtggcatatcctggactccttcaatatataaacacagcagaactttaacatttatgacatcctgattaatgtaatttttagctatacataggggcattcattcattcattcattcattctcttaacatttactgagcaactaccatgttccaggcactgtgtttgatagtggatatagattaaggaataaaatagacacaatccctgctgtggtaaacttaaaatctagtagaagagactaaaaaacaggcaagtaaacagatgactaaaacaaaataatccagagttatgaattatggtaagtactatgaaggaaacatacagcatgtggttaaaaatagtggggagtggccgggggtggtggctcacgcctgtaatcccagcactttgggaggccgaggcaggcagatcacctgaggtcgggagttcgagatcctgaccaacatggagaaaccccgtctctactaaaaatacaaaattagccaggcgtggtggtgctactcaggaggctggggcaggagaatcacttgaacccgggaggcggaggttgcggtgagccaagatcatgccattgcactctagcctgggtgacagagtgagactgtctcaaaaaaaaaaaatagtggggagtgcttctctgagatttcaagaaaggccttctaaacataaaaatgttaatcctttgcctttcatccttgtagaataaagttatcataaaaagcccatttccttgtaggtcaaaatagacttatagcagtaacctcctgaatggcagttgtaaggatagatgtgataaagccgtaacactttagtgtgtagcaggataatctgtggaacccgtgtaacaatcagaagcctgggcttcagaccatagatagggagtgaggcttctaggtgggaccctggcaagggtgtgtttgtggaactcatcaggtgctcctgctgcaggctcaagtctgagcgcccagttcaatccagggagctgttgatttcttggctggttgactttgctgaacatcatggctccctccccacaacagggatgttgctgttgaaagcatgacatgcgtagggtttgatgtgagtgacatcaagatgtcctttagtattccattgcaaaccctttcccctcttaggaaaatgatgcccttgtgatttgactcattctcccccaagaaatgatgctcattcacgtctgaaaaaataccccctgtatagtaaatggtgacaacagacagggatttccctcatcttaagccagggcttctctctgaaaacatctcagagtgggcttcagttttgtaaactccctgaaattgtaggtaaattgtgtgtccttggtgtaaatatgaattttatctttcgagggtctatagctttcttcacattcttaaggggatctgctccctaagatcataaatgtagtactggatggtagggtgacgtctcgtggatccttgtatctccagcacctagggcagggactcacgaaacctctcaggaaataccggttgattgaagtaaagattcattctgaagcagacccctctagctatcagcaaaggacaaaatccacactcggcctttcttacttgcccctgtttaactgcgcaaactcttgtttgctgtgccactctctttcgtatgcccgtttgcacctggcttcctatttatcagctatcaatatccagcgagtgctggctcttgtcagtctaatttctggttgctgccgcttcttgacaccccacactttatcacccacacactgctcggctcctattacaactggtctcagcattgctaataaacagcaacaccaaagccatattttctggtccctgtcaggccactgctttcctgggtgaaataaaagtcctattaacatgctcctcctcattgcctctgacagattgattaattaggcctcctctttagatgacctctgcactgacacgacaaggaggtggatataaaatgaatagtttgcccatataatgggctactgtgggtttggggtttttatcaaatcagactgtcggaagttacgaacttgtatgaaattccatggcttgcagcagcagcagcctaggatggcttttggtccagtggaatctgtcacatacagataggacttgaatgccaggcactgcggggcaggggagaacccacctgacaaacagccgcctgtctacctgaatgatctctcgtttatgcagcccagttcatagagtgcaaatctaatgttcttttaatgttatcaaataaaatcaccttttgttttccacagcttttctttccctccatccctccttccctgctagaacacccaatacgttaactttgtggttgctttgcctctcagaacgctaatgcaaaaccattacaaaagagcacttgagttaaatgtccacatttccattataagttgttgttttcagagaaatcggtaacttggacataaaaagtcattttagactgggacttggcgtcggggggggctccgacagtcttggcaaacaaattaggctgcttgctttccattaagagagtgtggattccgaggggtgctcgttggctgcctttgctgttatgcacttctttagtgagggaatggcttgggaagccattaaccagattgaaatatacaaggagctctctaattgctttactgagcaggctctgtagatatttaaaatcctgcctacaaagaagaataaaacagccttgcagagcatggaggctgcagcaagcgaacacacatggacaaagatgcccagagatggaaggctgtttcttctgcttacttgtattgttttttttttccctttggagtgagttaatttattattttaaagcatgcctactaacatctggcacttttagaaacatgccattctattacagtgtcttcctccaaagaaaaataatttcagtgatgccaagatcaagccggtgaattcttagcagagcttggtacttgctaggtgctcaataagtggtaggcaggctgagctgaatgatgagtcttttcaggagaaattctcaatgggtgaaaccctagaaagagagtaggagaggggacttgccagtctcctctaaccgcacacagaattcccagggcctggaaggaactcatagcctttgactttgcctgcaaagctattcattttatattggtctaaatttgggctgagtttgcagctatctgcaaccaagtgagtgaaatactgggtggtccatggagaaatgatggtattagaaacaggaccctcaagaacgtacacatgtacacatgccactgtcaccactttagagatggtaatagtgacactagggaagagagtagttgcttaaagactgcatgaacttgaacggatatttgtatagccaggttcatagcagcattattcccaatagccaaaaggtggaagcacctcaagtgtccactgacaggtgaatgaataaacaaaacatagatacctaaaatggaatattaatcagccttaaaacagaaggaaatcctaacacatactactacatggatgagccttgaagacattatgctaagtgaggtaagccagacacaaaagaacgtatattgtattattccacttgtatgaggtacttagagtggtcaaattcataaagatggaaagtagaatggcagttgccaggggctaggggtgaagggggttatcatttaatgcgtagtttcggtttgggaagatgaacaaattttgaagatggttggtagtgatagttgcacaataatgtgagtatacttaatgccactgaactacactaaaaatggttaaaatgataaattatttgttatgcatattttaccataattaagaaaaaaggttacactaattagtgacaactagactggaatgcaaatcccttgaataccagtctaacaatagaatggaaagatgtttggtctgggagtcagcaggcatggaatttagttcctttgtattagtcgaaggtcttcaacaaatcatgttagccctttgagccttgttttccatttataagagagggttgaacaacattccagctctgccagtcttacatacccagagcccttcctcagccggggagtctcctagtggacattgtcctgaagccagcctggattttgctctctttatttttttttctttgtcacaggtcattcaggcaatgactgcatacctagactaggtgttgtcaggggaaaggagtgaaagagaagatggaagctttaaaggaactgttcatctctcccaaacttaatttcacaattcccaaagaggaaaagaaattaatgtatttgctgttaagaaattgccatatgtcctgttcttttatcccaatgtggatgatcattgactcccagaaatccctgagaaataaatcggagaatatgctgaaatttatttaattaaggtagtgcaggggctggttccatattaaacatggtgatggggatttaagataataatgctaccatcagtacatctaaaattgtttaatgttttactgcaaatattttttagctagaagaaattaaacaagtggggaagattctcagaaaccaacacagcccaaaatgtgcagataaagaaccaaaaaataacgtagaaaggagcaagattataataaatatttttaatgagttaatttatttcctctttttaagtcttaacttgtaacattatttgaaatcacagtaaatgtacattttatttcttgtttcagccctgaggtgagtttatttggaatgtttgttttaaatggatttagccatcatggaattaggtcatcttggaaaaatgtgttttttctaaaaaaaaaaaaaaaaaatagaatgatgttctgtgtgtttgagagtaatttagaaaccactgttaatttccagtcctgttatggactccttcttcaggaaggtaagtgcttttgatgtgtttgaagcattttgtgagacaagcaaaacaatttggagcaattgaaagtgacaaccctgccccgagcacatggcttcattttcattacgttataacgcaggtggaatgcagatcatgccgggtcagttctctctctcagtatcatttattctacctttctgtgccttaagagcaaacttttcacttaacacaaggatgctatccatttggcttcttttttgcttttccagtgaatagccatttgcttatcgacttgtttttgaacttactataataagctttagtcaattttcttttaaaataattttttggctttaactcttgtgagatagcaataacacaaaaaagacatttattttgctttgaaactagtgctttttccagaaggtcttgtatcccttaacaatttgcattcatccattcatcaaatgtggattgagggcaatgtactgttccaagcctcggattactatggagaagcataaggtgggttcatctctgcttaagatgagtttgttgtttcgttatgcagtcattcgtatggtgagaactgtcagtaattcatactatcttcaagtaaacacaaaaatccatcacgctagttactggtcatcctcttaggatagaagatggtgggggagatgagtatttattatctccacctgcctacaaagtgtttctcattccctgagttcattctacagagccatgatttgaacccaggtccttactactgcaatctggatactttccaattaccatgacatcttttggattatttagtctatcacttgtctgctttcactccccaccctcccacctgcaatccctgccccgtcttctctctttctctccctcccctcctacaatgagaaagtgatatataaggaagacaatgagacaaaagcctgaccctgaagtcagacagaccagagcttgactcccatctgtgctgggtgaccttggataagttatctaactttactaaaccccaggtgcctccactgaaaacagaagatactgatacttcagtaataataataagctctgacacttaaagaattctgtccaatgcctgacgtggagcaagcagtaagcctcagttagtgttaactgctattatgtttacgatcttcccatcataaatgctttatttatttattatttttttaaagtagcatttcccactaggttcccagcagagtggatggagaagcaggtgtggaggattggtttcaggagtctgtgtgtctatgagcagagaaagtataaatttatattgtgtctgaagaatttcttatgtgacttgattaaaaaaagataaggatgaaagcttaatgacaatatttttttttccttgagacaggattttgctgtcgaccaggctggcgtgcagtggtgtgatcatagctcgctactgcctcaaactcctggcccaagcaggagtagctggagctacaggctcaagccaccatacccagttaattttttaaaacaatttttgtagaattgggatctgtttatgttccccagcttggcctccaactcccgagctcaagctatcctcctccttcagcctcccaaagtattgggattataggtgtgagtcaccgtgcctggcttaatggtgataacttttttttgaaaagagccccaactgatacctagttgaaatgttacctataatgtgatattttctgggactctcccaggtggagttggtcactctagcctctgtgtcactgtagccactgttcgatagctatacacagtgaatgctcagtaatatttgttatgtggctgaatgagtgaaataataagtgaatgacaacacatcactttattttaaaatattttcacatttggttccctgatcagaccttgatatggttggatctggaaaggagtcttgtctctcccgttttccctgctgtcctgacatactttttcacacatagtgggcaatcagcaaagcttcccctattgctttttgtagactctttcctattagagacatgtctccaaacattcacagattttatttgactaaatactcacatgtagatctaattagttgggctctatttctctgttctctaaaagactccctgagtatttcagtctggagaccactcttctatctttttctccttccggagtttcagaattttcttcttaaactgccatctttgggagttcttctctgttcttcttcacattcttcccaccttctttccaacagtttttgcattttatcttaaacgatgtgtcttgaaaagatacaaaatgctccttctggccatctctgagccagttttactatgagccagagatcaacaaactgaactttttattttacatcttctgcatgccaggcactgagttaggctgtaaggatacagtggtaaacaagacagggttctgccgcatggaacttacactcctgtgaaggagcagtttcatgggttgtgaataagagtttcagagggataaatcaggaataagaagcagcctaacctagcctggggaatgggctgtgacaactgtgatgaggcctcagcacttgttcccactgggaatcaggaatggggaaacctatgcaaaaaaaaaggggcaagagaatgaaggctgtcatgctggaaaagctgaggccgaagctttagaaatgtttcctactttcagagttgggattgaattaaaggacaaagtgggagagaaatatgagcctaaaccacagaatcacagatcttttgccaggctcctggaataggggggcatcttttggatccataattaagtcactaccacaagattattgtcaattgttagtatttcatacattacagatgtttctaagtgattggtttcatggaaggggattgtggcagacgttgtttaaaaatatgacctctcacttgttccatttctgattttccacatagaacagatgatcttgattgtgtcatggtcaacccagaattatgacagtctgggaagattaggaggagaataaactgctacttaaaccttttctcagcagcattggaaagcatgtgtttccagcaataactcctgggaactatttggtcagtatatgcttcagctgtaattaaaagggcatttccttggttttaatttcttttaattaattaaaaaatatgccgtctgtgtagggggagttatagtcccttcctagatgtggaaaaatgtgatttctgagaccaaaaagcagtatttccaaaagagtgttctgaagaccactagttctgctcggtaacccagagaatggattggtttgagatttgctgctcactctgtcctcttggagattcacgagtttgtcaatgtactaaaggctctgagaagtcctgcagtaaagacacctctttaactcagcatttcacatatatgtttgagcaaagcacccgtttttaagcccagacatattacgattccacagaacacactttgggaaacatggtagtaatggtatttcttagcgtcctctgcatgcatcattgtggtaactctgagctgataggacttagaagcagtcatgcctcatgcagaagtcaaaggagaggcctcagccagatttagtggcagctccgattgtttattgagtgaaatgaacgtgtcagcagtagactgcagtggaaaaaacactgggcttggagtcagatggtcagaacctattcttggcctggcactaccagttttgctgccttgagtaaagaggttaacctcattgagcttctcttttctctgtaaaatggctattacctgccctacagctgccctaataaccatcattcattcagtgctccagagtccagaacaggggtcagcaaatgttttctgtaaaggactagaaggtgtaataaatatcttagactttacggcccatatggtctctgtcatggctactcacctctgccattgcggtgtggaagcagttgtagatgatatgcaaatgaataggtatagctgtgtcccagtaaaactttttttttttttttggagacggagtctcacgctgtcacccaggctggagtgcagtggcgcgacctcggctcactgcaacctccgcctcccggattcaagcaattctcctgcccgagcctcctgagtagctgggattacaggcatctgccaccacgcccggctagtttttgtatttttagtagagacggggtttcaccatgttggccaggctggtcttgaactcctgacctcaggtaatccccccgcctcagcctcccaaagtgctggaattataggtgtgagccaccatacccagccccagtaaaagtttatttataaaaacaacaagagagatttggcccacgggccatagcttgctaattcctgatctaacgtatgtcaaggtctttacctatattactgctaattctgcctgtaggattaacagaacacctagatttataccagagaaaactgagacacagagatgttaagtaacttgcttaaggcaatatagttaataagtaggtctaagaattgtgctcttagctaccatactgaactcccttctcttatgacatcaaaaaacaggttacaaattacaaaggtaaataaatgtagataggatgtagtattatctgaggaagttctcgtttacttgggctataggaggcaattcatgagaagaagcatgtattatatagtatgcttactatgcccttttgtctccactgccacttctgtactatgctttaccttctcctcactcagcaatgactggggtttctagggcaccgtaattcaaagaaattgcctttttctgaaaattaccaaaatccactagcagcctattgaacataatagtgacactgcaaatgtgcccgaaccttcagacattaaggtgccaggatgctgtagacttgagtgtgtaataggaaacatctgagtctacagttccagcaaatgtagactatttcttaataaaaaataaccctgtgtacatccacttaggttttacttcctaagtggagtaaaactagccctagagtcaagtttgaaattattttcataattttgggtaattaagacacttcccagatctcattagcaaatgcctaaaatagaataattgccatataattagtgactggcaaacttttagaggtttgaaggttttgttcttttctgaatttggaagtacaagggcctaatcttgaatttatcagaacccaggaaacttcgtaactagactccattcctttcccaattcatttgttttagtcctacctgtcttcttccaccaaattccacatctttctatgagtttcttgtaagcattttgtcttcttctatttagatatttctccttggctggagtcttgtactttaacaactatttagcatgttccttctctgagtctgacactgagccaaatgctaaggggaagatggtatctctgcctgctaggagcttatagtctagttaagatatgatttcatgataacagccaaagaagagatagggtggcagatgattcacttaagtctgctgtgctctgagatttagagttagggcatcctactcttctctagcactttaattgctttttagggctgcccttattatcttcattgatctcaaaataattctggcaggtagtacagataggatcgagaatagtaatgtctttcacctaaagaagctgaagctcagaagagtttggcaatttgtctaaggttatgcagttatgtatgggtttaaaaaataatagcaggtcttctgccccctggccccgcctattttttaccgtgatgcatcagcacatggcacatagattcccaagtgtctcaccccattatcttgtcaagggaaagagtgtaaatgttgaagttggacaactttgcatccaaaacctagctcagccactttggtttgaccgttaggtcagtaatttaacttaaaccttcttattcctattcttcataggtaatttgagactgcaataagtcaattgcaggactgtggcagggattaactagaggacaaatgtgaaagtacctaataggataaatgaaataataaatggaagctcttataaatgagtatatcactccatgctcactcaccacacttcttctcaagtctctctcctttactggatcatgaactccttgagaaaaagagtcatttcttggtcatctctgacacatagtagggctcaatatactttgttcatttaataaacacctagcgcttatggtgtgtcaggcaccattctaagtgctttgcgtattttaactgagctttattataatcccttgaagtggaagaactactattatacccattatgcagattaggaaactgaggcccaggaagatatgccagagttcacccaactattaagtggtggaattaggactcaaacccaattgtctggctccagagtctatgctgttactcatcctgggctgctatcagttggactgggttaggttgttcaggccccatcagctttgcttcccccgagattcctgctccttggctctggaggcacattttgttaacaagtcgggattctttggtgaggtcagatttcttctatctgcctcccttttactgctcttgattttccagggttaataattcaagatgatagctgaaccataggactaaatttcaaagcacagagtctagaggtgttttaaatgaagagggaaggttgtgcaaaagtcaactgggtagaggaaggctggcgactagatttaggctagtattcagataagtgtggatccagaagagccccagctcagagtcatgcctaggtgacaagccaggtttttattctcctaaaaggaaaggacttacttagaaacagagagtagccccttccaagtcttctttgccattctagggttgaaatttgatggggaaaatagaagctttcaggtctcacttaagagtcaatgacaacacaaggaaatctgtctcccagtccctttttcagcttctagttcagttaacatacttttacgtatttgcaaagatgtgtaagctgtttaatagaatcatagaaaaacctaaatgaacagggaatgggatgtattaaaacaaacacaagggagttaaaagaaaattcattctgagttgtgggtaggtaacttagtgtttaggtcccagttttttattgcatcctaatgcttgagcccagcgatgctgaggtaggcctggtgatgacaatattcattaaagttaatttcctgatagaggccacttaaatctgattgttgttttaatttgtttcactgctaatttccttcgcttaaatagaggaagctctctgcccctcccacagccagcccaggcagtttcagggaggtgacagccatcacggcattcaccaaccagagaatgccatcatgtcacactctttaggcaggagatgatgtctttatttatctctagaacctagaagttgcctgatttggaaaatataggtgctcactttcaaagtctaaaagtatattgctttattgaatatgaaatctcctccattactcagctagacctaaatccatctaggacttaatgggaaaaatgtgagtcccagcagtgtccaggatttttgaattatacatactcattttgttgtttgaagaacaaatataaatacagcacaggctaaaacatcaaagcaggagagaaaactcccacagtaataataatagcaaacaaaatgtttattaaattccaggctgttcaaagtctttttcatcatggaccttgtgcggtaggtgcttttgttatctgcatttttacagatgaggaagctgatgcctggagaggtaaatgaagctaacaacgaggatttgaattcaggagggttgccttagactctggctcttaaccccggcaacagtgcttcttaaactctggtcccaagactgcagcatctgcatctcttgagaccttgttagaagtgcaagttctttggctccatcctatagccacagaaccttggagtggcttcaagtgactgatgctctctaaagtttgagaaacattgcattacaggatgctacttttccagacttggttcttacattccataaatatttatcaagtactcaataagtggcagggactattggagatacagcaaaagcaaaaatgcctcccctctggcggtttacagtttagagagtttacagactctaaagaaaattaagtaattcaaatactaaaatactaagctctcttatctcaggttggcagattacattctcagttagtaaaaaaaaaaaaaaaaaaaaaaaagatgctaaactttaacactaatagccagaggaaggaacaccgcataaaggagtttagaagcttacttcaggtgacactactgaggttgcaaacccaggtctcttggttcctgatcttagcatctctcctatgctatgctgagcatgttttcctcatctcctttgccctgtagcttgttagggggaaaaaaacatgaggtttatagacaggctgacctgagaccaaatcccagctctgccacttactgatttcattgcacacagattgacatgaggttggggtttgggggcagagttgacagtggttggtagaggcagagctggaaattccagtccacagttcctgccagctcacaaaactgggagagattccagtctagggaagggatgtgaatgatgggtggtcaggctttgttggtccagtgtctgtcactgctcttggactcacaaaacttcctgctcttcaactttgtgagattttgaaacacagttttctctccttctcactgcagtatgcttagccagagtcctcagaaggagcatagattttgtgtgtgtattagatatgcttccaaatgtatagccactgtgatcgagtgtcactgccactggttcagagttttctgtttcagggaaagccagtaaaaacctgacttttggaaatttccgtttattgaaaaaggcagacagcaccacttttgatagtgtgcttgttaaaaggctttaagaagaagatatttgactggctagcagacatttcacataagagatggtgtgtcaccagataaagagtagaggggactggggagaatgggataccatgcagttataacccactttccagagaacagaattctggtccctcgccttctaaaacactggcaaaataaggaagtaagaaatgtgttctttgcagaactaataactcagaaagcatacaaacaagggcctgttaggaatgcactcgcaaactatgctaattctggtttaactcatgattctgacacattgtcctggccccagagaaacttgggtagcaaatttgaaggagaagaagaaatattgaaactggggattctgaaggcaaccaaatctgagtttggatctcaactttaccagtcagatgcatgaccctaatcgagtgattaaacactgtggacctttcctcattcgatcgtctgtaaaactgaaaaaaaaaaattagcactttatatcttccagagttcttgtgaagctaatgcattgaaagtacccagcagataactgtacaattgtttcagtgatggtgaatagcaacaaaacggaaaggtatcacttactgagagcttcttatgtgccaggttgatctaagcatttcataggtatcaatttatttaaatatcactattattattggagttagactgtgttatctccgtgtactctggcaactaggaagagcttttaaatgtttttatgcagaactggaaatgcacaagcttgtattaatatgaaaattgtgatttaaattagaaaattctcaatatcttaaatgaaaattattgctccaggatgataaaccaggatgatctgtggatccagttgttacttcctgggggtaaacacaccatggtttgagaattacagccctgcactcctctttttatctcacctctgctgttcaggggctattgtggatgagctggtgatggtaagaggggcaagtgaggaagggatatgccccatgaccttgtctcttcccccttcccctgcgaattctggatccctgcccacctcctcttcagctcatcagtagtgacatgccaatgtggtaggcagcataatgaccctgccctaaagatgtccacatcctaatcccagaaatatgtgaatgttaccttacatggaagagaggattttgcaggtgtgattaaattaagggtcatgagatgggaagattatcttggattagtggagagggctcagtgtaatcacatgggtccccacaaccgggaggctggagggtcagagtgagagttgtggccacagaagcagaagtcagagtaatttagggccaggagccaaggaatgtgggaagcctctagaagctgtaaaaggcaaggaattagattctccctcagagcttccaaaagaaaccagccctgccaataccttggttttagtacagtgagactaattttggactcctgactttcagaactataagataataaatgtgggttgttttgttacagcagccataggaaaccaatatactaggatagagtaagcctagatttcctctgaaatgtgaacgaattttctatctatctctgttgcaaaagagagaaacttttatccctttgaaaatttcccactacagcttcagaataatcatgggcttgagacatgatagcgagggaccaatgtgagaaaagaaagcagtgacggggtggacctgccctttggataatgtttcctaaagtgacattcaaggagatcggcttccagggtttattctggcatggtagttaagcacatctccctgtgactttggaaatctttagcctctttttgcctcagtttcctcatctgtaaaataaggttaatcacagcattcacctcaaagagatgctgtgtgtaatgtttcatatagtacatgctacatggcaagctttatgtaaatgttagctcttatgaatagccattattttaaaaaagtgaaacagaatttatagggggtccaatatgtttagaacaggatccattacatcaaacaggcttcttttctgcagggtatctcagaatctttactatggtaatgttcactttataccttaaaattggagggaaaatgcaggaacatttctcaaacttatttaaccatagaaccctttctgatctgtaacaatctcagcaaatcagatttattggtcatagtatgagaaacactacccttaaaagttacaccaggaaaccttggttcacctctctccaactcatagtccctgtacccagcttctagagccatcaccgaactggagattggggacccccatcagaacagtgcaaggagaaacatgtgcctagtatcaaaagctgaagattagaggcttttttccacgttcacattgttctaacattgtatgttatcatatcagttagcttggctcctggggacttgcctgggaacctagcattgtttccataccatgacactttagttccaaccaggcaacctagaaatagtttagaatgtaattcacaagttggggacctgtactttagcttcaaagtaatgctgttgatttgtgagcagataacctagaaatatatacatcaaaatgtttattttactcttcaaataagcaattttcaaaaaagaattgtgtattttatagggtggaagtatagcatcactaagttgtattcattctagggcgtatgtttttaaaaaaaaactagtgtcattactttgcacaggcatgccttgtgtaaatataggaaatctaacttctggggaatttcatttcaagaaatcagacctggctcacataaagatacctttcaaaaatgaaatatagcaaatttagtcaagcttaggctgttttgttttgaaagctataaagaagtaaactataacctgctttatttttagcagacacctctagaaaaccttgcacaatgttctatttataaaacagagtctgttttcatgcaaagttgcttagtaataagagaaaagagcaagactgagtatcggaaaaatgaaatgtttctgttttcaagattccttgaattcatcagcatctctttaagacacaacaaagcaattgacctggttttagttttgactatgagaggttacctggagattgataaattggatttttttttttttttgagacagaatcctgctctatcccccatgctggagggcagtggcgcgatctcggctccttgaaacctctgcctcctgggttcaagcaattctcatgcttcagcctcccaagtagccaggattacaagtgcctgccaccacacagtttttgtatttttagtagaaatggggttttgccatactggccggactggtcttaaactcctgacctcaggtgatccacccaccttggcctcccaaagtgctggaattacaggcgtgagccaccgtgcccggctgaaaaaaagtggaatttgaaatgaaagtgcagtctgtcttttatgagttatgccactgagtaagcgacagaggacctaaataattatcaggtcatttcaatatcacattatatagaacatttataatttcatcatcctttaaggcattaacaaaaaaacaaaacaaaacagaaaacaacacagaagaaaacgtggttgagtaaattcaatggctatagaagattctagaaagtgaaagtaatgacccaatacaactagaatgtagtgtaggaaacaggcagtttccaccatctgctttatcattctgatcaattttgtatcatgctgtttcctaatctttacaataacaataaaaccaacatttatttaggggttattatgtgccatgcactctgctaggagctttatgtggattatttcatttaatgttcccaacaatgtgtcattgccatagataatataattatctccatcttacagattgggaaacagattcagagaggtgcagcagcttactcaagttcacacctttggaggtgttaaagctggttcagacacaggtctgacttcagagctgcactgttaagtgctacctagtgttaagtggagccaacagtgaaccaacagagaatacacacacgctgtgtgccagaggctcaatgtagagacagaggctggtctctagtctgcctttttatcgtaataatccaggaaagcttaggaatcccccccaacccgctgcaaaaaaagccccacatcatccatgacaaaaagaatagctttcctgtttttcttcacatttttcgcagccatttcttagcttcggaaaacttaggtgtgttcatctcaccttgcatatatatattgcatatattttatacacaattgtctgtttacctggctgcctcctcatcctctttcatctctaattctgatttttcctgaatacagaacctggtgggaagtcatagttctgcacatgtatgatgggtgaatggaagagcatgcccagatgcagattgaacatagacatggtgtgcagtgtatgctgtgggctggtttttctcaagcaacatgatgtcttaaggattttctgtgttgccacctagtcttcagaattaacatttgcataatatgtattttactggatattccaatcatggcaaattttttaaccattcttttttctgcagaatttagaaataattgttcccaatattttgttgttacgaattacactgtgtgaacaactctgtgcatagcatttttacttacttttggattatttcattaggatgtaatttctagacagggattactgaatcatagtataagcattatatatggcctgtgacagcattttccgatatgaatataacgtgaactacataggtaattttacattttctggtagccacattaaaaagtaaaaacataaaataaaatttggtttaatgatatattctatttgacccagttatcagaaagcaatcatttaaacatgtattcaatataaaagctattaaagtattttcacattcttttttttaatatgaagcatccaaaatatgatgtgtgtttcgcactcacagcacatctccgttttcagactagctacatctcgggtgctcagtaaatacggctatcatattgggcagcacaggcctgtgatatgtctaatccagtatttttaaatgacctttgctttttaaaagcccaatcttaatttgccttgccctttcctaacctcctccagttacacgtagtatctggctcattcccttgggcacttattttaagctgtcttgactttttcattgttatgaatattttcttgacctctattttgtgtcaggcactgtgctagatcttgggggacaccaagataaataggacatggtttgcaacccactgggagaagatagacatacccataacacaacgtggattcaaatgcttgtcggaatgagataggaaataattttgagaaaaaaagacacacacaagcaagttataatgcagagcatgacaaattccagaaatgaggattaaacaaagggctgaggggattggggaaagcttcttggggaaaatctaattatgaattgagccttgagggctcagtgaaattttaatgggcagagatatgggagaacagttttgcctgtgatgatcttgttatcccaaccagatggcaggttggtgaagagtggggcattgcctcacattgcatttagatctccccagagcgccctgccagagttttgcagtagaaggtgctcaataatgtttgttgagcccaattaataatatatggttggctggcacacagtgagggagacaccgggtctgtgtgcttgctttaacctctgaattgaagggcagtctaagctttttactcattcctctgattgtgtgtactgccagtttgcagtcacagttttctcactttactaaatcggtctggactgaaactagtcgtttagagccaaaatggtagataaatgggggctaacactttaacttacatctgacctccttgtcacttattccaattcccccgagctttcaaacagcacaaacaggccacagggacaagaaatgacatgggaattagaagacacttatcagaaggtgctttccttttatttgcaactcacacatataggcctttgtttgacaatcttgctagagccttaggaatttttgtcttcattccacaggtaaggagacaggaattcagagagggtacttattcaaggttatatagcaagtaaattggaaaagtcatgactagaacttctcttttctatctcccaagtgaacgtcttctttttattcgcagttggcccacccatatcaaatgtcatcttccattgctttgtgacagatctactcaattctttggtatccacatcctacatctgaaaagtagagaaaaggtaaacttggaggtcatatgaagtatggagaagataagttagggaacaaaaaccaaagggttggtgatattaatatctataatgatattaacattcataatgatgatgataagagtcaccatttaatttttaatctatataggcaggctgtctgctaaatgtattacatatattatcacatttaatctgcacaacatacgtgtatggttgctatttttatctccgttttatagatgagaaaactgagatcaaacagatgaacttgtccaaggtcatattgctaagtagaaagcagctggaatttgaatccagacctaacttctaaccctcttaacttaatcattgcactacaaagttctggttcatgccaacttagcttagatgaccttagacaagtcgctacaacttctatttattttttatttttagagacagccaaggctggagtgcagtggtgtatcagagctcactgcatcttcaaactcctgggctcaagggatcctcccacctcagcctctcaagtagctgggactacaatcatgagccaccatgcctggcccccaaaatcctatttatgtagactgtttttcccaaaattaatactttgctcacctcttggtaaactgataaatgtgagaattatttgtaagcagcaaagtggtatacagatatataatgttgtgtgcatttaaactgaaatttctcagtcagatgagagatatataccagcaacagagtgatgtctggcactaagcaggtgctcaataatgtggcttatattcattccatgaatgaatttaagacttcctttgctgaagatgcttttttattgccacatatggaaatgggtggtaaagagaaagaaggcaggccgtatgtcagcttcctgagcaaaagtccccacacccactaatttccctacccccttaatattctagggcattaatgggatgtagctagggaagaaaccaccttagaaaaagtagagtcgaagtagatgttgaattctccaaattcttccatccatgctccacttgcatttagccatctggagagttttacattgaataatttttcttccaaatgatatatagtcattatagaaaaagttaaataaaaaaagaaatagaaagggaaaaaaattcacatcacccataatctttcccctctcccttcacccccagagataacctaaccattaggcatgtccgtctgtttctttttcttcaaagcattttttacatgtttgaattcatactgatacacgaaaggtaatactttacttttccactgaccatcaaggaatacacattttctcatgaacttacaaactcttcatgaacattcattcttaattcagctgacaaatacacatcttctctgtgccaggtgatggggacacagtagtgagccagactcattgagtttccaattgaccttatgtttaatggctgtatggtattttattgtccacttatcaattgtcccctttgggtctattttgcaggtagcaggctttcttgctagtaaaatgctccccaactgtatatccccttgataatgccctagaatattaaatagcatacaaaagaaaccagtattagcaacataaatgtgtgacaacacacacactcattgtaaatgaaatcaaacgtaataaaattgtgaattctcctgtatttgggggcagagatttcatcagttcctacttgtttattaacatcaattcttgagagttcgctatgtaacaagacaaaatccagctactcccgaacctacctttcctctttttcttattttgttgggaaatctaagttagaaaaacaatctacctgcctggttgccgtgacatgtctaaagggtaggatggggaagaggaggcacaggtattctctgtgagtttcctgagtacttggcagtcttcctacctcctcccctgtcctgttcgtcctgtgctctggagccagccaggcatgtgacacacgccacccttgcaggctcagtctctggtaggatgtgggtttttgtgtgttgtggtcctggtttcagctgcagggccttattatggaatgtataggaggaaacggaaggacctccctcccgctcacaccagtcctgtcacagatgccccaggtcacctcctggcctcagggcctgtctgcatttggaactgctggattaattttcacatcattctgatgttccccaagctcctctgaaattaggttatttaaaaaagaaggccaaagtttaaagacttctgtccagggcactgctacctatgaactggctggctatggatttgttctggaaactgtattcaatttcattttctcagcacctgccatgctagagcctggctcattataggcatccaggtgatgtctgttgaatgagtgtataccctgggaggtaccttactgagcccatcctcactgggctttcaatccagtaactgtgcacttcacaaagaaagggactgggacttattatccgggtctccctgtggtcaagcttagtgcctggcacctactgagcattcagaaaccttcttagataaaaaaaatgaattctgcatacccacacaatggcatatcattcagctgtaaaaaggaatgaatttctaacacatgctacagtatggaagaaccttgacaacattatgcagggtgaaataagccagacacaaaaggactattactatctgattccacttacatgaagtacctagaatcgttgaattcatagagacaaagtataatagtggttactagggactgggggagaaggaatggaggagttagtgttaaatgtgtatagaccttctatttaggatgatgaaaagaatttggagatggatagtggtggtgaaagtaatcggaagtaatggcaaaaaccgcagttacttttgcaccaacctaatacttactgctactgaattatagcttaaaagtggttaaaatggtaaattttgtgttatgtatattttaccacaataaaaagactgccatgaaaaaaggaaaagagaagacaaatatcccttttctttacgtctacttctctccatctgttaagcctccctttttctttcaaacctggatgatgggaactgtgagattcctctttgaagaattctcactgctgaggattggacattagtgcaggtcccactgggggctgctaagttcaccgcgtttcctctcctcagggtcccagggctgagcaggaccagcccttgttttaactgaaggcaccctggtaccttgtcctttgatttctgcagcagcaaaacaaagagccacttatgtaagcaccaagtcatgtccaaaatctgcctcacctgtccaccaagacagaagtcctgccatgatctttcctctgcctcgtcaggctctctttgcatgatggatgggcgtcatgtttcttacagccatgtagaaggaaacagattgaaaatattccccttcctgctatgaacttgtttacaagattaaaggcaggtatgcttgagagggctgggcggacactataagattatttttaataattcagagcacgccaagttcgaaaactggtcatgttgtcttttgtttcttggtttctacagtaaactctgcttacaccacctcctttccagcagaggaaaagaaaatcggtaacagaggcttaatgctgacacttgttctttattagttacaaaaaagggacacagcgggtgtgtttgtaaagatgtccacgtgtgctgcctgggtttaagaagcccccatgagtagctcatggggctcaggtgaccacctcaggcacaatttgttcctttcctgtccatgacacacagaccacattattcacccaggcctgccctttatcaaaacaatatctcttttcatcccaaggatctcataacgaaagaccaagctacaaagtcgtagtgaagagatgggatcagacagctggtgagagagaagccagcactaccctttggaggcagctgggctggtggtttgggctagccaggcttcccaagcagctgcaaaggggtggaaatcttgccctgatgttaagttttccttccctctcctagcgatgtcaattggtgtgtgtgtgtctctttgctgcacaaggtgtgaagttgctctgtgggctaatgcaagacatcttttgaattgtgcagaagaggaacttccaggctgcccagaggagggacttgggagttgggggtggggtggtacatggccttcctaaacaaaatccagagctaagaagggaaaacgaggcagggaggggagggagcaggggccaggtgtctgcctttcatctggatattcaagatgacacatctggtgccaggaaaactgctatttctaactgacggggaagctttgcagtcaagggagggctgagctgtcaggtgagctagagatcaagaattatcatgacagcttcatggcatgtgaaaggcgctgtgaagtgcagtatgattttaaccagcggtggttaaattagcttctcttggacctggtgtgatgtgcagtcggagaggggccgatggcggctgggagtgccaggcgtgaagaaggttgcaattcagaagggctaccatttagaaaagaaagcgtatgtgaaaattggctcccggtttctgagttttgcttaatagaggtgccaggcagcagtgatggcattaattagtagcttgtcaattccttcggtgaacctctcttcaccccctattataaatattccaaggacccaaagtaaccgcttgtctgaacttccccaatttaagatcttgtcaaaatctgaccacctgtactagctggctaagcagccttgactaaccgttttgccctgtgctcttgcattccacaggattgtccatgcaagactgagccagtgagggagcgagcaagtgagcgagtgagcgaatggctttctgaaaaacttccactcaaaagtgaactgaggaagtaccttttaataagtaatcagccagaggaaatcaggctctgtctagccatctagaaatgcttgcctatgcattggggactttcaaaagtctggagcaggagggtctatgatttgatggaccatggcttgggaaattctaggaagaaaaaaataatgtgagcaattctctctgtgtatgtatatatgtacacacacatacatgtatgtgttaatatatatcatatgtaaattaaaagctgtacattaaccctctgtgccaaaaattttacaaaagttcattcactttatccacataggcaaacattctgtttttatttgtaaaaactgaagtccagagaagccaataattggccagtctggaacttgaacttgggtctgtttgactccataatccatgctcttaaccgttgccttcaaaataagaatggctaacttttaaagagcctgcaggtgctcgttacgctaactggcacagccaacctgccagctcctaaagtctgggtgctatgtgatctttgcactttccccttcacagcttctgtgccaaatccgagcacagctgccccaaggcttccaagctgtaatccctgcagaaggtgcccagaagactatagtaataagaacccaagtctttttgatgcagccagctcaggacctgtctgtgcattgaaaatttgtggacgttgatttgtaacaccagggctgtgaccctgagtagcccacctgaggataacaggcaccaacttcctgtttccaaatcctgctttcctaggacgcacccagcccccactgaagtttgtgggggagtaaattgctattcacctgtccaagcctccctggatttatggcttggcagctcccttctgcctgcaccaccgtactgtgtactgcaaacacagatgaccttttcagcgatttcgtcctaacttgcttccataaagaaaacctgttttgtattgacattgtttggagtaagttctgcctatgttaactcccttagcccctgcccctggaatttcagcccagggaggccaagtgcttacaatttcaagagcaagggggagggtgctttgaaagcatccccagcttccatccatctgagtctttggtccagtggcttcaggcagatggagttgctctccttccttctagttttctaatctctccctagaaggggagaggttgcaggctcaaattggcccactggcaatagggtgctttgtgggacatttttttacaagttggttcccatgtggtatttgttagtcacagctaattattaagtcctttggctgaagcaatagacattgttcccttggattccctcctcctcctttcccccctcacccccattgctacacaacaaaacccattgtggggctctggaggttggctgtgcacgtattttccagtgaacccctgatgggctcactgctggggtttcatgtttcaggttgaaactcaactggataaagcattattcattggcactgacacattcagtgttctgctctgtgtagatatttctctcacactagacttggtccctcacaagcagtttaggtaattcactgagagcaattcactgcagttactcagaacatggataatctgcacagaactataaaatattaggatttttagatatggaaagatcatcaagtgccagctttggccagctgtgttcagaggtgcaggttggaaaggaggagggagctgagtgagtaagcaggctccaagttccttcttcccagtccccacctttgcatttgcctgctttgtgcattgcatttctgcgtaagatttctacaacctaaaagcaatcttgaaatccagtaattgagtccactctcattcattgctcaggtgaggaaactgaaccagtgaggaccttttgctaacctaaggttcaggtgagccagtgaattaatttcagcatgagaattagcacacacatctccccacttctgtatgccccatttgttatgccacgctgagataattctggaatccatcagtgggctgctttttccattgcctgccactgtcttgtggaaagaccttacctagaggatttagaggactggaaagcccccagaacagccatatcatactatgtttttactaaaggccacctcggttgcacaattccatggcacctcttggagctgtacagtacacagactaagattctgtatggagcagccttacttttactttacatatatgagagcaaaaactgaaattgtgctagtaggttttggtcagcattgtgcaagggaagaacccaggctttggagccagcagatctgggttcagatcttggctctactacttactggtcctgggaacatggacaagttacttgatatccctgatattcaggtttttaactaaaaatagagctgataatacctaccttaaaaattgctgtgaagaactaaatccaataacttacgtaaaagctctaggtaaaagcacatcaaggccatgataaatgtttttttttttttcctggaatataactgctcttcttctcatacacatatggatctgagttgaaataaaagacagacattgttaaacttcatccttaacttggaaacttctggattttgtcacagcttaacattaaccaaatgaaattttgggtctctataaatatagaccataggtttgtcttatcttttacagagcacttataaaactgaggatttcctgggggaatatggctgtggggttttaagagaaaattctgcaagggaaaacaggaaagactgaaaaatttaagccctgttcctttgcctctggaagcccctgggtgtcctgtgggttcagagattcactatcctcgctgacagcaaaatcagatctcctcgttgtaacaactacctgagtgtgcttgagacttgttaaaatccttctttattagacgtccagatgagaaccataggcccagaagcttgttttcaaaatctagcaaaacagatgcttttgcttgtttttctctgtctctctttgtccaaaatgctcactgagttttcattgggtttcgaagttgcctttttgttttgtttttacttttaaaacaaaccttagaagagggtcactgtaaaatgaaggggaaggatgggcatcccaaatgagaaaagctgtattttagactctaataaaaatgtttaagaacctgaaggtgaggaatcttaaaggacaagagagagaaagactgattctttgaactctagaagggtctacctggcattatccccaggcctccaatgccaggtgcctcccaagcaaattgaggtaggaaagagagcactaccttctcctctctaaaagcactgcatctagctgagcaaggcggtgtggctgtgttgactgaccatgtgccatatgtcagctgaggcccagggccactcccaggtccctgcattttataggcagctcagacgttgtaggtactgtaccaattttctatttctgctctatcaagtcacagcaactttagtagcttctaacaacacatatttatcttacaagtacgttggtcagaagtctgacatgggtctcactggactaaaatccaggtgtcagcagggctgcatttttttggaggctctataggaagatctgggtttttcgtaacttttccagcttctacaggttgcccacgtttgttgcctcctagtctccttcttctgtgttcaaagccatcaatagcaggttgagtccttctcacattgcatcactctgatcttcttttctacctccctcttccagttttagggacccttggggttacactgggccgacctagataatccaggataatcttactattttcaggtcatctgaattccatcagtgactttaatttccccttgccgtgtacagtaacattcacaggttccaggtattaggatgtagacatcttggagtggaggagacattattgcttaccccaggtacatacaatgattgtatatattaggactttttaagtttcaagaaacaggatctaactaaagttaataaaaagaacaagattttattggcccttagaaggaaaagttcagttggcttcaggtacagctggatgcacatgttcaacaacatcattacagtcctctcttttttgtcttgggtttctttgtggtggtttctcaagcaggggctatctataggacagataaaatagctccctggcaattccaggctcatataagtcttaagattcaggatcccagagagaaaaccctgacctcttcttagatagcaccagccaaatcctgagggtgactctcattgacacaacttgggtcatatgtacatccctaagactcattctagaacagggatggaatcagtcttaccagaagcacatgtactgagtgggaaagggagtggttctccaaaagaaactcagatgttgtcaccaaaagacggaggaaagatctgaacagacaaaagcaacaggtatccactccactatgttattactggatttcagaaccatgaaattgatatattattccagttcagagctcactaggcttcaagcaacaagatactcaagcttgaaagagtacagaagagtctcacccagagcaaggagtaaattaattcagatagtatataagaagaggaattatatggtggcaaacattgtttttggaaccagactgcctgggtttatatccaagttattaattgtgtttacctaacctctctgtgcctcagtttcctcattgtaaagtagagatgataatagtgcccacctcatgagtttgctgcgaggcttaaatgagttaatacaaataaagtgcttagaatagtaccttgacacagaaaaagcattaaataacacaatataattattctcctcatattcttatttctattataagcaagcaccccgggcatggcttaaggacttggaaagtggttaggaagcaagtctgatactttcctagtttctccttttctggctagggctacacagtctcttctctctggaactttctccaccatatcagcgtgaactgaggtttgcacgtatgccacagatttttgcatggctttcaatgaccattcttctcgctctggtcttgactatacatgtccaccaccaaatgaaagctgtgtcagtgtttctaaattcaaattcttgaaagaatctgattagtctggccagtgactggctttaagtaagtgtgcactccatttgattagctgtgattgacaaggttagggtcactttatacacaggtttacctctttcatttggcatggaaggggcaggttaaactgaaagggtaagttgggcttggccagaaaattgaccgacttgtctgttacatgtatgccttagcaaattagaatttacccacagaacaaaatagaacagttttaaagaatactgataagatctagatgtttgggaataggataacactgggaactacttagttctaatgtgatttagcctgtagtatttgcagagagaaattgatcagtctcccattacttgtatcttaaatggtagagacattttcagcaccgatcagaaatgctcaatggatggacaaagactcattcccttctacatggaacatcaatctcaaaaactcattcttggagcagaagttcctgggatggaaaaaggctcatgttcattgtcaggagagtggattccagagtgaccagggatgtccccaaatcttccctttggtggcagaagaaaagttctgtgtttactttctgtttactgtgttccttctcacttttcagagcccccgtattttttcagaaatctcactccagggtattcaaaccatcttaatggacagagtgcctgtgtcagagccctcatccttttctccaaggactttagtgagaatctttctggaaaagtagaaagattttctcctccctcctcactcctcccctcacagtgattgtgagggagaaggagtactgcagaatttcttagctgtgagatgctacaggaagggtggaaatgctttggatcggggctgggtatcttaggaagcactgagatttaggggaagacaaagcattgtcaagattttgatagaggcctgctgggaaagtctccactgtaaaggctcttgtgcccctttctagtggaacaattcgtaggctccacgcttactttcaaatggattggttttgaagcagtcaacaaaaaagcatcctgctgccagggccaaccatcaaaaagagaaaagagagcaatgcaaaccgtgggggaatgtgcgagagagaaatattgcagagcggagccgtggctctgctggcctgataccatgtgcattatctcccccaaaggaccccgtggtttaatggatggggctttaacctacccagaggtcagtctctgctggacaagtggaacctcatccctgagggcattgacatactcatgacacatggacctcctctaggtaagtgaagcaaaggttgtcctttgtcatccagatgcctttttttccaggcataatgaataatgcttcagggacataatcattttcctccaaaaaaaaaaaaaagtgaatacgaaaagaaaagtcaatgtctttaaagaaactcagtatgataattaaactcagcagttctgctgggcttacaggtgttcttgaaattaaattttttgatttagtcaagtcagggaaaaatcaaatgagtatggtgtgccacagtcttctgagcttgataatttattttaagaactgtattcactttggagtaagggggtggggtggagaaaggaaggaagattcggacctcccaatcacagggcttttgaatggcaatgaaatgatggaaatttttattcaaaggagctcattttccttttccatataatgctggaacctggaagacctttaaagtttaacatttgagctgataattttagaaaagaatcctttttataagctgaggtatttcagtaagaacttacactgaaagttacttaaggatacttaccctacaggcacatggaggctgcatccagatttatattgtctgtgtgcttcaaagcctacccactagtgagccacattatgggccaaagaatgatcagttgacttattaccttttaatttttcacgaacttgttatctgttggtttagctacagaacattcttcaacaaggactaccgccctgatcccacatctactcagtacccattatgccaggaccctttctaaatgactaaggtgtgctcaagaaattcagatgtttcacttttaatagaagactgttcgattttttctttctttttaaaattgtggctaaacacacacacatacacacatataacatgaaatctacccttttaacacatttttcagtgtacaatgctaaaagagtttcttaatcatcttggtttggagagagggaaaaaacactttatacaaatataaataatttccacaaattttcctgtggtttggagtttttatccatgttacccccctcctttgccatccctaaaaataaaaagaaaaaaaaataacattcatttcctaatgcaagtttaatttttgtagatattttctcctccaaggcacttggtgctgctctccttctcttacaagggaagtggcccatgtttcacaaagaaacagtggaagtgagcaccatggcggaggccatagtggcacattttagtgatgggggaagcaagaaaagaagagccagctctgttgcagacatgggaattatatagatttgcacaggatcagcagttcctgacttcttttaacacttcagaatcaccattcccatgctttttcatcatccccagaccacctcaacccatgttttaaaatattacacttgtcaacaacctttatcaagtcataattaactaagttccctattttacaaccattagagtagctacatcattaaattgctagctaaatattgtgatcagcatgagttacccagtgagagcatcctacagagttatcatttcagctaccttcatccttttgcctgagcagcctaattgggtgcaggcatgatttccctttggctatttatttcaagggacttggacatcttcagcagagaaacatttacatgactcgagtattatttggaatacaactttgaacagaacaaacttatcaagtcattgattttggtataaaagcaaatggcaataagagtaagtctgaattgtagactccaaggatttcagacatcccaggaactcttaatagggaagctagcatccctctctttatggtaaaggtggagtaaatgagagagtggctgtgagtagagcagagtgacagctacatcaaggagttcccaaataaaaggtcaggcaaagtcttcctaaggtattgttaaaccttagttaatatagctattgggattcttgtgaaaacgtgacattggagaggggagtggagagactggccttgaatttcttcctgctggtgagggatgccacagtgccgtgagacttcactgttatggtataagcaagatgctttctcagatgtttgcatatgaaatggaatattttcccccttcaggaaaaacacatgcatgaggtaatatgccaatcaatgtagcttaagaattctgccccactattaaaaaagttttgaaaacgctggatagatttttgctggggaccccactttcatctattttcagactctctagtcactccttaaaccccagcgaatatgtctttacagagacactaaacgttcatgtctgcagtttggcccgaaaaagcagaaagctgttccttactgcccagttatttctaaataatagaaataacctaatggcgctgtggaatgggtttccagagattacgatttagcctttcatcctacctgccttctttatgccctatcctgctgaggcgtatggattccattccaggccataatcatccagatagctgacttttgctataattgatgtcagtttttatggattttctgcattaagtgtagaactaagtggcttttactttaaaagtagtcaattagccccagcttgctggatgccactgtgaggtcacatttttgcctgtcgctggagaggacaggaccacaggagcaacctagctttccaaagctttggtcatccggaaccacaaggggtaagacttagtgtatctaaagagagctgggtatcttgtgaccagtttacaggcagctcctctcagtccttctttgaatcatcttagaagtaaactgctataagaaagatataataaaatagcgaaagtaactgaattgagggagaaagagatattatgggactgccgggaataaatgtcattgagctcatgaagaagatttgaaacccatggctgaataaatcaaatctcctacagaaaaaaaaatgttaattaacaggaagaaaaaaaaatggaaaccaaaaaaaaatttcaagaacctaaagaagacaaagtgacgagtgaaaagtttcttaaaagccattgtgagctttaatggagaggctaggattacagataatgtaataaaccttctgtgagttatggcttcctgaaagtctaaatgaaaccttacctgaagaaagaaaattaagtgtattgattgcattttgcccttaggttttcgagactgggttccaaaggagcttcaaagagtgggctgtgtggagctgttaaacacggttcagaggcgagtccggcccaagctccatgtgtttggtggaatccatgaaggtaagaacagcggaaaagaattcaaaacattttgtgcccctgtccactatctcagtctacaactaggaataagtggagtagttgttttcaaactttttagcagcgggacccttttataagatgaagtcttatgagaaacatctgaatataaagctgataaatattttatatggaccttctctcttgtaaacagagtggaaagtaggaagcacgtctggtctactaactgcaaaccctgcactccccctggcagcttctggaatctcagggctttaacgaggaatgtttgataaccactgctttagagcaaccccaaggtatacaaggagtcattttctccttaagagagttagaagaaatggtctggatattagaagctattttaagcctctatagtcccctcctacctgtaaatattgtgtttcatatggaattaacacaaagacccaggaagacaaggcattctctgaaaaatagcttaggacatgcaatgaaagatatgtaacagaagtggcgggaacctgcacatttgcaggtagacttttccttactaacctcagaaaactatttcagacttctcagaaatcatcggagctattagctcaggctgaggttaagcagaataattaaatctctcttaaataggaactggtccagttgccatttttctgcctttcaaggtaagctgagtcaggttcacagaaccgaaagcctaacaggaatcttcaagggatctgggttttctccgacctgcctttttcaaatcatgggtaactgggctttgagacagacacaaagccctctttcagcaagcctaaggatttctgtccctagcagattttcccagttacacacgcttgtgtgcaatggccgtgtttacgtgggcagccgctatattctctctagctcctgcttatggcagctctctggagttacttatgaatatgcagtcaagttgaggtgtttaaggctgtgtgcctgaggaagcaaaaaacaaagtttgctttttcaaagcccacaaattcagtggcttcctggttaggtgggtaataaagagcatattgaaaatcatcctactgaggccagagaaaattcagtttgctccaagggcaggtaccagctgagtgggtggaaagcagggtgcagctcccagagagtggatatcggcctgccctggctttgagctatgctccctgaaaaggagggtactgccctaaggtatgatggagggaacaccagtgatgggggaatgcctggaggggagactagggaggtgggacctcatatctaaactaagcaacatttctggaggactgttattctgaaaacaggtctgaattcgtgcagcatgcctatgagtttgcattttatctttgaaaaaaatcattaattacctttaaactagccagacaattggggaattccactgaagccccaaaataataaacttgcctaaaagggaggagatcatattcatataaacttgtctcacttttattcacttaagacagctgaagagggcaggaagagggcaaataccaacctcttgatggagagagataacaagactttatgaccccagaactaaacagcgcagattttaaatgcctcttttcttttcttaagagatttttccattgaccctcattaagttctccacaggctttacttggagaaattttagccaatgtggaaaaaagccttttcagttacttctctatatcttggtaattttatttttttcacagctatgtttttatatgcgataagagcctgataccaacatagaatcttagttgaagaggctataaggcaaatataaggtattcagggaaatgtgccaacttgcaaacatgctaaacattttatcatattgaaaattatcaaaggaacatatataccaaagacctagggaaacaactttctcccaataaatcacaaaaggtttatattgcatatgggaagtgtttttgcttgatctagtatccaggtaagcttaggaaacagtgacctagggtgatgtttctacacatcacttcgacatgtgattagctgacacttttgaatgaaatggaacttagtattaaagccacacaattcaaaaatcatatatggttgactttcgtaaaggcagttaagagattatttcataaataagtaaattgagtgtctacatttcttaactctcaatgcagtatcctttcccccctcacctgccccatatcccacttggaatttagttgtgtttgcccctgaggagtaatccttatattactcattttattccctagaactcaatagttaacacaaggctttgaaatgaaaatcctattttaaaaggaggaaaaaagtttttctttattctccctagtaaagaaatcacagcccttcttcaacaagtttagcatttaaataaagaaaaaaaaattgctcttagttgaaggagaagattctaccatttaaagaaaatagagtaaaattgggcagtagcttctgaaagtcattatatctgaggaggctcaactgaatttcatctcactgcccactgacaaaaattttttgttttccttgcctgacagccctacattccatcactctcatttgtatatattacagtaaatgtgacacgctctccccacaggttatggcatcatgaccgacggttacacaacgtacatcaatgcctcgacgtgtacagtcagctttcaaccgaccaaccctccaattatatttgaccttccaaacccacagggttcctgaagctctaaatgccctattggaatgtgagggaaggtctataaactgccatttttctaattataaacttacattctcttacttatttacaaaccctgtgagttctttttgtaaattgttggaacacaaatgatgctagaggttgtgcttcttattttattttattttaaatggggcatccatttgaaatcagaggaacattgtgaatttgtaaaatgacttctgttttctcaaaggccatgccattgtaaattgttagtgttcgccaaaggacagccaagctttcttttaaaaagtgataaaagtcttattttaatatgctttaagctgaaagaaaaaaaaataagaaacaggcagtgttttaaaaaccaacacagatttgcacaactgtttaagagtattgtttgaaatattttaattttcaatgttttgttgttgttgttttcttggtaatgcttcttttttgcagatgtggtcccaatttatagcaatcttctcaacagaagtaggcatggaaaagacttcttttcatactctcactataaagaaagctgcattgagaagaaaatggctgtcatttaaaggatggtttaactagtgagattcctattgtggttatacaaggtctcattgtttgtttgtttcttttaaattatttcagctttaaaaatacagaaatggaatctgtcaagagcaggtatttcatacggttaaaaaaatgaacatgcagactccttttcaatatgggtttatatatataagtattttttgtgtattatgactacgttaggagtttattattgtcaaggacagtacaactgcaaagggatgctgtatagcagcacatcagaagtcggaaggaactgacacattctctcagagctcaaggtcttaaagagcttgagttaaatctaggtacagttacaggcatgtatagacttaaatggatgcaatggaagctaactaaaataaggcttagttgtcctttctatttaaataccccaagttgtcttcttacttcctctcccctctcccattttgcactgtgtgtcgatgcaatcttcgctagcacaaaatattgtcgctaatagtcatttctgttttcccattgtaaatgctgttgagctttattctattttatgttactttgttaatgaaatttaggaaagcagttgtttctttaaatttattgtgatattctatatctagcggcctttatatgcaaataaaattgcaagatttttaaattcgtgctgtttagagggttggatggtggaggatggtagtttcgtcctggggaaggagggatttattcatatgcaacatcagtaatgcctttcagaagaattagaataagtgatttttttccctaattttcaataaatttttattacccaccattcacaggctggcagatagatcgataaggcactcagtgtactctttccttccatcatgctgtcatctgtcttgccttaggtttcatctttggctgttgtaatttctacaggaacagagagactggagttaaggctgtggatttattttgggcaagtttgtgatagtgagtttggggaaaccgttgatgacagagtaatcactgcacattctcattttccccaagagcagtcaccatctcctcctcacttttgtaatgatgcccacccacaaaatgctgtggcaaccaagaggggatagcagaagggtggcgaaaaccagagaaaataaaaaagacatcacccagaagaaccactgaagcaaaacagcataatcttggatctgcagtgcaccctcaaagtcttatgtgtcagggctcattggattgtattctggatatatgttccttcctccctacctattgtggatcctttggtgcaatttctgaaaggtgttcttgatttcagtaccagcagaattgagagaatgttctaagccagaattcctgctcagagtcacatgtaaccatcttggtctgttgtagttgttaatagttattaagtatcttggatgtcaccataggctgtgttggacatttgggtccaagcttgcagagcagatgcttgagcttcccatgggcttcccagagggagctcatgactgttgcagctaacatggaccgaaagaggtgctatgacaagtggacaacacttccttgaccttctacatcagtagaagagggtgttcacttcaagccccatcctagggggttggagtgagaggtacactactgaatggaaatttcacctggttagtgtactagaagccagagactcaggcctctggcttctggaaaaacaagcctcccagagataggtgggtaatcacgatcacaagtatgtatgcccagcccttgagagtacgtctgggcacaaactaattgagctaagcacttactaaaattgctttccattttgtggaggcaggaagctacccagtgtactaaaactagaaggcagactcatttgtggataaagctttcttcagccagtccaccatttcatatgcacgagctgcctctgagggatttgtaagcactgtccagatgcccagagctttctacactgggccttacaacaacaaaatattcaaaacagctcttacaaattgggcacttcctatccgtccatcaccaggcaccctgttgaacaggttgtgtattttgtttctaatcttcacagaatcctgcgtaaggtcacataagcctcgctttacagataggaaagtaagatgtaccaaaattaaataactttccctaggaaaaatggaaggttcaaaagcagatctgtccatagcccatgcccttttaatcattctttgtctggactggataagttgatggatgccctctgagagctgatataagacaggcacggtggctcacacctgtaatcccagcactttgggaggctgaggcgggcggatcacaaggtcaagagattgagaccatcctgaccaacatggtgaaaccccgtctctactaaaaatacaaaaattagctgggcgtggtggcacatgcctgtaatcccagctactcctaaggctgaggtaggagaatcacttgaacccaggaggcagaggttgcagtgagcgccgagagagtgccattgcactccagcctgggagatgagcaaaactctgtcagaaaaaaaagagagactggcacaagcctggggatatatcctatccctcaagtagcagctcgctgaaacaccctgcaatgtggctctttgacagccgtacatgg

SEQ ID NO: 11969 - DNA, 47787 bp, Human
taccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtacgtatcggattgttttaatgttatatattggattgtattcgttgttacaaaaccaatattctatggagaatgaaaaaaataaaggactaaattaactggagatttttggtactcttataaagcaaaattgtttgttatacatacagatgaaataagaaaataatgtaatctttctgtaagatatatacatctttgtttaccaaaccaatagcttgcctctcacataagccaattttgtttgttttcagagaagaggtcttataatgtagactgagtttaaattcatgatactaaagaaaatgttgccagaggacccttttttttaaatggcaaaataagcagctcttcagtagagagttcacctcttttgagcgtatccttgctgtacagatattatctggctgatatgtatgcctgtgctttatagtgttacttttagaaaatgtatattattgcactttttactcagtggtacactgtagcctaaggctataggaaatttcaacttatcttctccccattatcctctacatcattttagaaatctaggtattagtccctttttttttttcctttgtcattcagcaacatgtagtgagtggtcgctatgtccaaagtgctgtggacgctgagccaccatgcaaacatgaataagaacagctccttgtttaaatgtgcgcccattcaggtgtcttttctattcatcacagaaagattgagtagaaagctaccgaggtcacccctataaagaaatatttctttacatccattagaatgataacagtaagcgctgacatctcttgagctcctaccatgtgctagccatgattctagactcttgacacatattaactcacaacagccctatgagggaggtgctctttgttatctcatttcataggcaaggacactgaggcatagaggtgttagataagatgcttattcatagatggcagaaatggaactcaaactccagcagtcttgctgatgaaggccctcctagatttattcttttgggtctaagtcttgtttatcttcaggagccttccagtaaaataccaccaccaactagtcctttattcattaataattcttcatgaatgagtttcagatactttgaggcagagaaactagctgagaatgggaccttcgagacgaacgggtgtggtggaaacgtgtgtttggagagaagacctggcagagtaggtaaagcaatgggaagatgcagttagaaggatgagaaaagcactgaaaagaaaactaaggaaataccaaataatctcactctagagttttgcctgggatttgctatgtgccatgtttgattcttgatcttaaaaagataaaaataagtaatttcttgagcccaggaaatttgagaccagcctgggcaatgtggcaagaccccttttctacacaaaaacacaaaaattagccaggcatggtagcacatacctgtagccgctgctactcggaggctgaggtgagaggatcgcctgagtctgggaagttgaggttacatttaggtgtaattgcattccagcctgggagacagagtgagatcctgtctcaagaaaaaaagaaaaagaaaggaaaaaaaaaaaagtaaagactcaaagttaccctagggtggggagaatgacaaaaaatcatgatagaaatctgagtggtggctacgcaattatttatacagatagctcacaatataaggaaaaaaccttattttttttaaaagaaatcaaggtaagtagaaaataagacgggaagataggcaaacatagtattatttgtagttgcaaatgggttaaactcagatgttcagatggtgcaaacgaaaaatttaaatcccagctacataaagttagaaacacctaaaacaaaacagcacaataaagttgaaataaagagatggaaaaaggccatacaaatgctacaaaaaggaaagcatgaatagcaatgttgatatctaacaaaacggaattaaaggcaaaaataattttaaaggatatgtcataaaaaggaagagttcaccaaaaaagtccagcagtcacaaactttatgtccctaacaacataactgggaactacatagagcaaagcgaatagaaatacaatgaaaaaaattgacaaagccataatcatagttgctgacttagaaatcaccaagtcaagtggaaggtaagaacagatgtagaggatttgggtggcgtaattaacaggtttgatagaacttttttgtttcttttcaaatgcaaatgaatgatcattagaattttgtctcaaaatttctacaaattccaaaaagataaattttacaggcggcactcactgtacacaatgataagtaaatatataaacaaaaaagataggatataaaaaagctaaccacgccgggcatggtggctcatgcctgtaatcccagcactttgggaggctgaggtgggcggatcgcctgaggtcaggagttcgagaccagtctgaccaacatggtgaaaccccgtccctactaaaaatacaaaaattagctgggcgtggtggcgtgcccctgtaatcccgctagctactcgggaggctaaggcaggagaacctggaggcggaggttgcagtgagccaagattgcaccactgcattccagcctgggcgaccaaacgagactccatctcaaaaacaaacaaaaaactaaccctagactttaaataacctggattaattaataaataaaaatataaaatacaaattgttggccgagcatggtggcttacgcctgtaatccaagcactttgggaggccaatgcgggtggatcttttgagatcatgagttcgagaccagcctgggtggcgaaaccctgcctctactaagtaaaatacaaaaattagccaggcgtggtggctcgtgcctgtaatccaagctactcaggaggctgacgcaggaggattgcttgaccctgggaggcaaaggttgcagtgagttgagatcacagcactgcactccagcctgagtgaaagagcaagactccatctcaaaaacaaacaaacaaacaaacaaaaaacaaatattgacaatgatgtgacaagcccaggtctcttgaatcttcagtgcttctgggagggggtgcaagaaggcatgtcagggacatccagggcagcatggtttgtagtagtgaaaagttagaaatggctgagtaggagaataaataggtaaatcatcgaaaacgcacacaaaagccgtttaaaaaaaataaggaagatccgtgtatggagatgaaatcatcaagtcatattgtttaaggagataataagtcacgcagtatttgtgcagaacaatacaaagctacatatatttctgtaaatacaaaggtgtataaattcttagaaaaaaaacttggaaattagccaggcacagtggtgcacacctgtagtcctagctactccagaggctaaggcgggaggatcacttgagccaaggagttcaaggctgcagtgagctatgatcatgccactacactctagcctgagcaagagagtgagacctcatctcttaaaatataataaaataaaatacagaaaaaagtggaaagtgtactgccacaccaataactgcatttaactctgggggcctgtgctggcactggaggtcattagcatcatctatactatttgaatttttatattaggaatatattcttgtattacttgtgtaataggaaatataaaattaaaacaacctactaggctactgatatcttttacttttgtgcatcattctccctttaactgatttttctacttttctcaaatagccacagtgaaatcggcagctctattcagcctcacgggagagtagactctgacatagagagcacagaaaagagatctgaaacctatgaaggtttgacctccctaggtaaatagcactgttcaggtttaaatgcttgtcctaagcaaagcaatgcatggcttgctttgccaagcagaacttcacagagagggctttttgctttcaggtacaaattgggccatttgcactggcttgggattgggatcttgtctttagttgtgatttgattttctatgatttgacccagagtattcaaatgtaatatttccttgaacatgaagcatttgcattaaggaaaaaggaaaaattcaaaacttctactcaagtcaaaggacacaggtcctttgtttaaattggatggacaaagtatggcccatgggccaaatccaagccactgcctattttcgttatggcctacaagctaagaatgtgtttttatgttttaaatgttatatagttatgtacagtatcctcaattttgccactttcccacaaagcctaaaatgtttactctctagcacctttaggaaaaagttttccaacccctgattaaatgattgcctctaaatcaaattttgactgaaaaggttggtcagtctgtcttgatgtcataccgaaagaagagaaagagagaagacttcccctaggaacttgagccattattctctcttgattttctttgtagactttctagccctatgggctccctgctacaacctacaaacatgattgtcttcccttacccgcagtttcagttacctgcatcaactgtgatctgaaaatattaaacaaaactccagaaacaaacaacatacaagttttaaattgcacgtcgttctgagtagcatgatgaaatcttgcacaattctgctccgtcccaataagaacgtgaatcatccctttgtccagcgtatccatgttgtctgctctacccccttcttggtcatcaacactgtctgctcttgacatcccgccatcttcattgtcatgcttggtgatctaggatcacacaaagcagaggctccatcttctgagacgttgtcagaaggtcgatagtggctgaatcactagtaggcacatcacagtgcctacgccattcacacaacttcatcctatcccacacacattttaccatctcacaccatcacaagaagggtgagtatgacaatgagacaatgagaaagagagagaccacgttcatataacttttctctttctctttagaaccaaaacaatgttctcaaaagccatctttttacctttaattggtggcctattatatttgtcccaatttatatagtttcagacacccctcatcttcctacaggctctgctcctttgacaaagcacctcctctttttcactgactcttcgttggcttctttggccttaaatggaaatttttttatcaagactctgctattgtgcctcttcattctctatacaattggttctaaacctcactgtgcttttagaataactccaagagacctcaaagtgcacactgtggaatactattcccagagtgttccagtcattggctatagtgtttatttttagatctatctagcaggctttggaaatttatatttatttatttatttacttttgagatggagtctcactctgtcgcccaggctggagtgcagtggtgcgatctcgactcactgcaacccccacctcccaggttcaagcaattctcctgcctcagcctcctgagtagctgggattacaggtgcccaccaccacgcctggctaatttttgtatttttagtagagatggagtttcaccatgttggtcaggctggtctcgaactcctgacctcatgatccatccgcctcagcctcccaaagtgctgggattacaggcgtgagccaccgcacctggctggctttggaaatttatgtctaaaatgcaggtgaaggatgagagtaggagacagagatcaggaagtcttacgtaagtctggtagtataaaggtcagatgaagtactcaggaaggactggtcatctcctgggctttctgcccccagatcacttgagatgtctgtagaaaggcacatttcctgacctatgagtcttatctttggggctggggcctaggaatctgcatgtttagtaacctgccaagggattttcatcgcacactaagacttgagtagttgctcaaaatgattccatccccaaagtccacgttcctttccaacttctccccagcaccccagtccagcaggaccaacgaggtaaaccccaagctccctagagacccacctgcttagtgaagaagcagaaggggagcaggcgagccccttccctccatcctcctgaggtcagaggtccttgcggatccccattcactctcccagtgtgaggcagagaagccaggcaccaactgttctccgagttcggtggaaccaaaagcaatttagggcaatgtgttcacagttctccaccccaaaataggagcctccatggggcttgctttaatgagattttactttattagttcaagagttaatgaagaaactgctgataagataaatcaccttaggtgcggtgttttgaaatctaaccatttctcttagaaatggattttttttccttttggatatgcaaactaatgatgaagtcatagtagggatgtaagttttggtgcctttggagggtcaggacgtctgaagggagaacatctggctgagtggacagctcttcgagccttaccttattttacattctgtctataacagaaacccatcgctgtaaaatgtacatacagttcctttacgcattaatactccattgtaccaaccctattgatttttccaagtagacaaaggctaaggatatgtttattgattgttgctcagtgcattttaagtgtattttgtaataaagagcattttgagactgaaacaaactttcccttaaccaatgggcaagttgaaattttaattaaatgttactaaatattttttgtaaaaaataagactattcacaattctacattcaatgtccatcagctaatgtagagaattacaatcacgtgccatgcatgttacaactagacctatggagttaatataatgtaggagtaatgggaattactaatattgcaaaatgttgctcaggcaccatgtgaaactgttggaaagacaagccaactcatggaacttctggaactgaccattggaacacaaagagacagaaggagggaagagaagccaaaccctgaagagctttggtggaattacctaatttggggtaaaatagaaagaaccttctctttccccagcccctttctggagcagcctccaaaaaggctgagagtaggtgctgagaaaacatatctgtcagacggatggccagataggaagccctgtttggttagtgctttttctttaaagagtagctgcataataatgatttctcttttcgtttactcgttgtctttattcgagtgggggcagctaagatttgcttggggacattaaaacatcatttggaaaatcaacctttggtatttgccagctcatattagtggatttgcagtttgataaaccacttggatagagggggtgccatccttgtctcaggtacctcacgtggcttgaaacggtgtccacactggaagaagacatgtcctccatcaagggcatccatgaaaattaatgagtggtccaaaacaattcgtaaggagggtgagtcggtttaactccaaatgtggtttcagagtggagtgtggcacctgggtcccagtcaccagtgggctgccaccactggttccacctccaaagtaatttttaaatctgtccagtctttattctccactaacaccatagtctgatctaagatatgacttctcactcagaacagcacaataagcctctcaactggcttccagcttccactattcccactgttcgatccactttctatctaacagcctgagacattctttcaaatgtaagctggattatactcctcttccatcatttctctagaaatgtgctgttcaatacaatggccaccagccagccatgtgtgtctatttaagttattttttggtcttttgctattttattcggaggattattgcatatatattcataatgagagtcatctattcttcttctttatgcttttaatcagatgttggttttgtattgtatttctttataaaacaatttgagaaattatctatatttttatgatttcaaatacctatctaaatttaaatgagttaaaatttttaaaaatgaacaatcctttccttggttatactagccatgtttcaagtgctcattagtcacatgtggccagtggcgaccatgttgggcagcacagacatctagcatttttgttttacctgaaagttctgtccatctgtactgctcttgaagatgcagcagtttctccctcaaagtagtaggtggtgcccagagctcctgaccaagcaagctgtatggtctctaagaactttgggctttgaaggagtatggcaagcttaatttggggagctactacttttttttcccttttctcttctccctattcaagcgggctccaacgattcttgcctccattgaggttggtggcagcacctcctgacttttgtctaaaagtctaaatccatagagaaggacaaggtttgaaaggaaaggaggaaattaagtcccatgtgaagaataaggcctgaggagagaagaattttccccaaattaaagagaaatttccctaggttggggaaagagagagagagatgatcaggtcccataagtagcctagactagcaccccaaggaagtgcatcagagggcaagagggaatggcatgggggacaccaggaagctgggtcctgggcagagccctccagcctcgcgaaagatgttggacctcaggcacatcccaaagaaagcagagaagctggcctgaagaaagcatctgggccaggagaagggacctctctctcaaggaggtaaggagcataggaggtgatggaggctcaagaggctcctttacaccatggccctgggcaaggccccagaacccagatagaactcctgggggaaagagccctcacagagttaggtattccatggaattattgggctgagggctcagagttggtgccacactgattgagggtgtaaaaggatgtagggtgtgaattttactctttcacagaactagagctagagttcagagctgcttatggatcaggcggccttagtcttagtatccttggacagtccccgcctgttattcttaagatttgcttgctaccctcttattttgtgtagaaggcatctgagcccagagaggcaaaggcccttgctcccaagttcccacagcagatgactaagagcttaggcattgacatcagactgctggagtttggctgtctgcgccaccacctcttaagtgtacaacctgcagtgggtgtctcatggctgccatgacaaaataccttatactgggcaacttacaagcaatagaaatgtattgctcacagttctggaggctgggaagtccaaggtgcagggagataggaatctatctggtgggggctcactccgcttcatagatgctactttttcactgcttcctcccatggcaaaggggcccacaagctccctcagacttcttttctaaagacaccagtcccattgatgagggtggattcctcactgaggctccacctcttactaccaccacattgggaattaggtttcaacatagggatttgggaggagggggacacaaacattctgaccaagattgtggttatttgacctctgtaaggttttgttttcttaagggtgaatgggacatgatcatgacactaatgcccactttgaaaggctgctgtaaggtataagttacacagtgtgtatgagcctcagcagactactgagtcgttccataaattaccagctggggccacaggctggctctcctggctcctcattcaacattcctgcctcataataaagtcaaagcaactgctaatgagcagatcagaaagtaaagttgtaaaacttctgaagtcccactttttctcaaattacagcaactcctttagccaagggtaaaataccctgacccacttggttagaggtttgccatcaaggccactgccgcgtctagctgtgcagccagcagaaaatgcgaaaccgtccaagcactttggcttccgctccaagatgatctgcatgacatttgggtcaatcaatctagagataatgattcctgctgcagagctgtgtgtgtccaatcacacacacaaaataagggttcccaattgatttttgtgaactggtttcattttctcggaaagcatttcaggtcaatggtgaagctagggtgctgagaggaggtggcgtgtctccacctaattttgcccaggaatgtctggctctcactgtgctctgtggaataaaattggaatcatcaagccctttgaggaattacaaggacattttaaagcaggacttttaatgcgggggaataagcatagagcatctgcctggaggagatacacacatacacacacacatacacacacatacacatacatacacacacatacacacacacatacacacacacatacatacacacacatacacacacacatacacacacatacacatacatacacatacacacacgtacacacacacgcatacacacacacatacacacatgcctacgtatacatatatattcacataggtttgtctttccagaataagtttctcacagcagcacagtgacagttaggaatctgtgggtactcttttcctgggctatttttccactttaatgtgtgaacttcatttataatatcctcaaaattaaagcacaaggaaacctaaatgaatagttaaaggggtaattaaaaataggcaactgtccttgtttctctcctaaactggttgatttatgccttgttgtggttttttttttttttgagaacacaaaactattaatttatgtgtgaaaagaacagtgaattaatcctaaagagccctgcagcctttaaagacctgaatcatatgttgagctcatttaaaacttgcataggaaattaaggtagaataaagccctttaatttgaaaagtgcatctatagttgccatccctaggatatctgcagggtcattattcagaaaggttaaggaggactttatttttttatattcactatgtatttcccagttacagctcaccatggtgcatttcaacttataaagagaaggagataaaaggggggaggggagctttttattcactttccacttaatttccttgccgccacgccagtcccagcttaatgaatgtaattgctacctttgatgaaaatactattatcaagatcacacattacattggaaaacagtttttctttaaacacagctactgcagtctctaattatgcatgtaacaagtgtctcccaaacaaaagagcatgttgtctacaattgctaggaattggagcaaggcaaattcgaacaaaggacagattagatttgctccccgctccacaaagcccgtccctctgattaatttcctgcaaaaactaaaacaattctcttaaaaggcgctcgcccccttcttcagaatgatccatatgccatttgggtctttctataggatgataatggcctctgatttgaacccgtgttagaaaataagaaagggcttttatgaacttcctctttcatatgcaaatggacagcacaagatcttgagggataataagccccccaaaaagtgactttttagtggctataaaagagctcatggtaggggaaagtctgcattgagcctgttcaacccagttattttatcagcttcaagaaatgaggcatctctgagaaaatacctctgtgcctgttgagacagtggcaacagcttttctggggtggcctttcctaaaagacagtttcttgacttaggaatagaattttaaaaatggattctgattaaacagcaagtatgcttgttaaagtcttgtcttaggagaccctaggttttaattgcgctttgctattcatttgggagactgcattgggcaagttatcaggcaagttgggcatgatgtcctgggtcttcatttctttcacttacccagtgtgagaggggagcgagatgatcctgaatgtgcaactgccacaatgtccccattctacccccagcactattcaaacccagaaggaaaaaaccagcttagtccccaaaacaatattagttatgaggatgaggtctagagtcagacagcctgggttcaaatctcagttcataatttacctcctgtgtgacctggaaaacaatcatctttctatgtctttatttccttgactttatttatttatttttggtgtttcctttattgtttgtatttatttatatgtatctcaacttttttttagattcatggagtacatatgcaggtttgtcacatgggtatgtcgtgtgatgctgaggtttggggtacaactgatcccatcacacaggaagtgagcagagtatccaagagttagcttttcaacccttgccccattgcccccattcccctctaatagtcctcagtttctactattatcatctttttttttttctttttttgagatggagtcttcctctgtcacccaggctggagtgtggtgatacaatcttggctcactgcaacctccgccttccagtttcaagcaattcttctgcctcagcctcccgagtagctgggactacaggtgtaagccaccacacctggttaattttcagtagagatggggtttcaccatattgaccaggctggtcttgaactcctgacctcatgatccacccacctcagcctcccaaagtgctgggattataggtgtgagccactgcacacggcctattgttatcatctctacctccatgtttacccaatatttagctcccacttgtaagtgaaaacatgtggtgtttgcttttctgttcccatgttaatttgattatatttcctcaactttaaaatgaaattaacaccaaaaggacagtgagaattaaataaaagcatacttgtaaaatgtttccaacaatacccagtacctaggaagtattcaaggaaggaagtattcaatcaattttacttgttactcttattatttaagacctggaagaccactggtgcttgatgaaatgaatttcccaaagtactgcccgctgtctccttgaggcctggggaaatggcaaaagggaagtgtcatcttggattgaaccttatgtctatccaataatgggaaggctaccagaactcaatttaaggaggtcgcagttaggtctggagctgttttggtaaagctctactgcattagacgtgagttgattcttttcagaggctcctgccagatatggtccagagagaatcagcagagcaaacgccaaatgaagcaggctacctgcactgctctttctcataggaaagaggctctggatgcataaaaagagaaacaccacactcctggctcctcattatcttaggattcattacctgcatccagatcatttccttagggcagtgaaagccatcataaagctatgctcactaaagaaccgagtacctatgaaagtagcacccactggaatgtccccttctgctgaactctagctgtctttgctcaaccctgatcatctttactatctgtctcactaattgtcagatgttccaacaatactttgcaaagcccatataaattgatggcaaaacgaaactgcaaattgtgccacagttgcaggatttcttggagttgtgaaaatgacgctggagagccattagaattctatgaaaagccattgacaaatgaggatctggccattcttgagttaaagaaaaaaatgggcaagagggatgacacagtcgacactcaaaagagaatgatttgagtgctgtgggtgaagatatgcccttgtgaaaatgcatgaagcctttggataattttgcaaaaatgacactctaagaccatgctgtgaaaatcaaccacaaagaatggcccacagagtgagccatcatacaattttgtactgaaaaacgtatgcccccctcccaattaacattcgattcattctttgttcagtctaagattataggtgcaattatagccttagtctaaaaatgagatacatcttttttcataaattttaaggcaaattgtaagtttcaagacgaactctacatcaaacctcttttgtttccaccatttattacgagagggtccatattttaaagagatttgtttaaagtggaatttttcctgcaccaatttgctagttcagcaaggacttcatgtaccgtaggtgatatcttgggagccgcaggagacagtgcacacccttttacattaaggcctcaatgctgcagagctccatcccttacatactttgatcagtgtgagcaggacacacacacgcgcgcgcgcacacacacacacacacacacttcacctgcagattccacacgaagtcaggctctccaggcctgtgttatcctggtagggagggctttcccagttcaggcggctttcccatagcacaggactctatgactagtgatcagaaggaaaggggccaggagcacatcacagaatatgaagaccaacctctgcaaatcccaccctcgcccactgccccatgagtcatagagagagtgatggggctgagagtcagcagagagtccagaaatgcccatttgcatccacaattctgttctctcaggagtcttctggccctcgaagctgtgtacctgccacctggtcccggccacagccctggaggaggccccggagcacagcaatctcaatttctcagaagcagaagtggaggtgctgggaccagcccaagggtacccagtgcatgcagagaaccagggcagcctgagcacagatggagggctcctcaaagtactccccggaaagccccacacatccatcactcttcccattcctcatgctgcctggaactctggaaattggctgctgagatcgctctaaggagcctcaatggggacacggcattacagacaagagagctttaaggcggcatctctgagtctcgatggtctcacaaatgaccggccatttcctggtccactggtcagagaattagcatactgtgcatgggagctgcctccatctgtcttctgtgctcctcattaccagtggcaaggtggaatcggcacctaacctttgaatccatgaagggtaatgccccaaacactcctgagtagatgcactcccctgtgacggccacatcgagggactctggaacgtcctccgtgggcccatgcaggccacatctgtgtctgaggcccagggagcaggtggactccacgaagagcaaggggttgaggaaggagccctggcctctgctggttccatgcactgtttgtgggggactcaggctgtttgcttgtcttacctggcctcatcagtaaatcaggggtcttcctggcaggtctgagaggtcttctgagctccagctccagggctgccttccctagaagccttttttaacccagtcctcaccttctcccagtcctggaaaaccagccacgactccatcaactcccctctggcctctcacaggctctgacccagctccccctgcccttagctgcattctctggctcagtttcagcagcttcccctgttcactcagtgggagaaagtgaccctggcttcttccctgtatttgcttctggccacagctgcagtctgggttggaggacagaatctccaggggaaggaaaggaagataaggctgagagaaggcagggtccctaggatgccctgtctgccagagggcaccttctgacattggctggctcctggagctgtggcctctatcctgcaaggtggctggtgtttgttgacaatgcaaactgagccacctgcggctcccaccctggacaggactggggtctgtgcaaaaggacatttgaccactgctgggtgccccaaacaattggttgcaaggtgctctttataaatctaccgggtatggttttttattgtagattgcacagaaaggccccatggtgggccaggaaggccagggctcaaacagagctgggctggaccacgctgtgggatgtcaccttggacaagttctttctagaattcaaagctcagttcattcatcggttaaatgggtggtggtaccagatcgtggctacgaaacttcccagccctgaccgtccagaggactccaaaaatgctggaagggactggagaatgtgccaactccggggctttccagccttgttttgcagagtggtaagttttggactaaagaaactgggccatgtgattcaaatgcccagcagcttggggctgtcacagtgagggtgtgactgcagcctgaccagaggccaggaaacgccatctggctcccaggcagctctgtccaccctgtggggatgctgaaggctccctacatctgaccttctctctatagggaggagaagggggcccatggttgaggcaggccaaggaaggggcagcctcattgcttagttaatttcatctacttgtccatccatccacggctgcattcacgtcttgagcgctcagggagctcctgtttttccctcaagactccactctgtttttgccctgctgtccccctgcccactcccaggaataatgaggcccacctccccctgcctgaaccaccatcgtcacacaggccatccctctacagtggcacttggaaggcttcacgaatgacagtgagtctgtagacccccggaggcagggctttccgtcccccagcacttggcatagcaggtgcttaatcaaggtttgctgaatgaattaatgaatgaggggaagaagtgagatgaggaggcatggagatgacattccagggggaggggcagtgtaggcaaaggccagtggagggaaaccagtgtccagggacctgggattaatcagcactgatgaacacggggacaccctaatgccccattttgttcctcatctcacaggtacttgggtatttgccttaatatctgtattattcattggactgcgagtcccataagcccatctgactatccccagggttttgcctgtgacctagcacatagtaggcacttaataagtgatccttaaatggattaattggataaggtaggagggcaaaaagatggaaactacagggcccgtatggcagctccacaaccatcagagaccccatggcacggcaggtgcttaaccaagttttgctgaatgaattaatgaatgagaggaagaagtgagataagcatatgtggtgagcaggtgtgatgagcagatgggccccttaaagggttgctataagaaaggcaggatgctcagttaaactagaatttcagataagcaataaaaagttgtgtttcttttttgtttttttttttgttttgttttcatttttgttttgagacagggtcttgctttgtcacccaggctggagtgcagtggcgcaatcttggctcactgcagcctcgacctcccaggttcaagcgatcctcccacctcagccccccaagtagctgggactataggcatgtaccaccactcctggctaatttttgtattttttgtaaagatggggttttgccatgttgcccaggctggtctggaactcctgggctcaagtgatccacccacctcagcatcccaaaatgctgggattacaggcatgagccaccgcatccaaccaataatgaataagtctttgataactatgtcccaaatattgcacaggacgtatttattaaaaaattattcattgtgttctgaaactcaaactcatgtttttggtgtttttatttatttgcatatttgttttttgtatcttatttttaaagtttgtttctttgtttattttttactaatctggcaacctaccattccctcttttcacttagccataatcatccctggcttttatcatcagtatgactgtgacctcagagtcacaagatggctgctggagcgccagccttcatgcttgcgatttaggaaagcagaaggataaaaggagaagggacgaaaggacacctctctcccatctgagtcagctctctgtaagagatttcctccactaaatatgggtttgtgctagatttgttctttgataataataagaaattattgtttattttgttagatgtaaaaggtattatggatatatgagaaaatgttctacctttttggagatgcatcctaaaatatttaaagataagatacgatgtctgtaatgtatttttaattattttccggaaaaaaggaagcaaatatggcaaaaagttaacaactattaaatctgtatgaggggtatatatgatgccaattacccttgtctctggaccttttttatgcttgaaaattttctttgtgggttttttgttttttgtttttttttagatgtagtctcactctgttgcccaggctggagtgcactggtgcgatcttggctcattgcaacctctgccacccggttcaagtgattctcctgcctcagcctccagagtagctgggattacagatgtccaccaccacgcctggctaatttttgtatctttttaagtagagacggggttttgccatgttagccaggctggtctcgaactcctgacctcaagcaatccgcccacctcagcctcccaaacattctctaatagaaagttttgagctgggcacagtggctcacatctgtaatccctgcactttgggaggacaaggtgggaggatcacttgagccccggaacttcaagctacagtgagctataatcgcaccactgcactccagcctgggagacaaaagaagactccaactcttaaaaaaacaaaaaacaaaaataaacaaaaaatagttttcgttttgttctttttaaaaattattttatttatttatttatttatttatttatttatttatttatttatgttttgagacagaggcttgctctgtcacccaggctggagtgcagtggtgcgatcttggctcactgcaacctccacctcctgggttcaagcgattctcccacctcagccccctgagtagctgggattacaggcacatgccaccatgaccagctaatttttgtatttttagtagagacggggtttcgtcctattggtcaggctggtcttgaactcctgtcctcaggtgatccacccacctcagcctcccaaagtgctgggattacagggttgagccacctcgcccagcctgttcttgttttttaaaagacagattacccataatcttgcccaacatttgatttcttctcattcccttacagaatgggaggctgggaaaggaagtctttgggctgggtatactgatgcctgatacaatcaacattcagtcagtgaggaggaagggcagaatggttgtcaggcaggagctcacagcctcggcccagggctcaatttctcaacccctctgcacagaggagcaggggccacggtgcctgaagcgctgccttgccttccttgttggaaccagcccctcctgatctcacccaaactcctagagaatttcttcccttagtacggtgactaaggcacaaccaacccctcaccccagggagaggagacttgctgagctcccagtctgtgcatggtacagcttgtatgatctctgtgtcatacaggtaccctgtatgatctttgccagggtaatttaacctccttggagccctgtgatcacctctctaaagaatacacagcccagccccttccttccctcattagatggagtttaatttcccagcttactggctggggctactgtcagggagaaaaatccttgaacagagatcctgagctgctgtgtcaggtgaggcagcctatgccacttgctttcctttctgccttgatgccctagttgtcacctgccggaaactgatagtacctggcgtagtgttcagtgtatagaggaagaccttgaagccatggatacatatacgtgttattgcactctacatatgtggcacgtagtaggcctgctatgaagatatgtggggagagcaggtccactggtctgtcaactgactgatgaacggatagatgaaatgtggcacatccatgcaatggtatattactcggccataaagaggaataaagtactgattcatgctacacaaagatgaaccttgaaaacagcgtgctaagtgataggagtcagtcacgaaggagcacatactgtttgattccatttagatgaaatgtccagaagggcaaatctatagagacagaaagtagattagcgcttgcctagagtcagttgcaggatggaggagaaatggggagtgattgctaatgggtatggggtttctttttggcgtgataaaaatattctgaaattgactgtggggatggttgcacatatctgcaaatatatgaaaaccaattgaattgtacaccttgcataggtgaattgtatggtatgtgaattagagctcaataaagctttttttttttttttttttttttttttttttttgagacagaatcttgctctgttgcccaggctggagtgcagtggtacgatcttggctcactgcaatctccaccttctgggttcaagcgattctcgtgcctcagcttcctgagtagctgggactacaggtgcacccaaaacactgggctaatttttgtatttttagtagagacaggatttcgccatgttggccaggctggtctccaactcctggccttcaagtgatccaccctcctcggcctcccaaagtgctgggattacaggtgtgagccaccaggcccagtcaataaagcagttttttaaaatgaaaaaatcctggcatggtggctcacaactctaatcccaacacgttaggaaggccaaggtgggcacattgcttgagcccaggagtttgagacagcttgggcaacatggtgaaacctcgtctctatagagaatatgaaaattagcctggtgtggtgacgcacacctgtagtctcaggtacttgggaggctgaggtaggaggatcaccagagcccaggaggcggaggctgcattgagccatggtcacactgctgcagtccagcctggacaacagagcaaaagcctgtctcaaataaataaataaataataaaagttaaaaaatgggagatgtttatatccatagcaacaatatgttgcccaggaggccctgtggccactagcgacctggaaaattcccagcggcagccggaattccagaagccaagtccagctagaaccatgggtagggagctgggggaagagccctgtgtggcttctgccagcggtgaatgactcgagctaatgtgcctccacttacatgtattgatcgtttacctccctctgttccccacgctagatctatgagcaaggagaaaggaaaaaggagttcaggtttaaactcttatcactaaagtgagtctccttctacattaaaaaactatccagaccctgtggcaggaatgggctctgttcttggggcataaatttgtgtgtgtggaaaaaagacttattggtgaacttagcagtatttttcgttgaactggcagttgctaaccattacaccagtatttatttgattcttaaagagtacaaaaccatggaccacaaataaagaagatggagtaatagtttgtggctgggccactagctttaaacttgaaatgaagtgtccagttttgagttactgtgtccaaccaccatttgtacagtttgaaaagtgggggcatttttccagcctgtcagtgtgactgtagttcattcccatgaatgatatcgctgaaggagcagttgttctgctatgagcacctcactcatgaccagaatatattaagtgtattaatctgtgcctcccggcgtaatttaggaaggccctctatttgacacattcctgtacatccttgttttattgcctgctcccgcaggtaacaatgtctcaaaagtcttgctcctgaatgaagttaaaattacatgtcacccaatagcatatgcagttttgtggcttattttgctgtcaaaattaccaccgtgcaacaacatgaggcgttaatggggacgtagcgtgatttacctctcgggctctgggctcggtggtgagggaggactccttcgtccacgtggccacatgcgaagggaagccctggtcacctctgcccttccaatctgccttcagtacccaaattgtgtctctgaccatggcaggtctttccagagatgaaaataagaggtacttgagattctctgccaaataattgctaagcttgttttaagtcatgaagggaaaactgcaaatttcaagcaggttagtcttccaccaacaaacagcattcataacttgtttcccagttagactggtgactactatccgttaagaatgtgcccaagacttaatgcagaaatgtcttaattttaaggctaatgggaacagctctgacttacaatttgacgcaatgtttttctaccctgccaagcctatgtctttggaatgtttattattttaggtaacaagaaagccacaaagccaggttgcatcttttagtgagattatggattccccatccaggaagagtatggaatgtagcttaagccagcctgcgagcctggactagaggctgcgctaggaggttaatgagtcctaggtacttttgcttgtgtgggtcccttcctccataagaaaaaatatatatattttataacttcttgggtatcaagacaaatataatcaattgggcatggtggctcatgcctaaaatcccagcactttaggaggtcaaggcaggaggatcacctgaggccaagagtttgaaaccactctggacaacatagcgagaccgtgtctctttaaaaaaataaaattattgtttaaaaacgatatattttccaagtgggagaacagaaaaaaataaaaaatacaaaaataaaaataaaacaaaaagatggatataatctaggctggacttattattatatagacattactattatattcatttttaatttctgattttaaaagaaatgaaaatgaaaacatttctgtgggccctaggcactgtgcctgctgtgcctgatgggtatggctgccctgacctgtgctgcaggattgaagtttccaatctttccccgggagtttatttcaaggccaggacaatctggccagggcacctcatggagggactcagccaaaaggcatcccacttccccaactcggcacacagtgtttgccaggcctcccccaggggcgaccccagggcctcttctttccctctctcgttgatttgtctttattttaaataaataggccaaggcctctgctatggattttcccatgcatttgagagctggggacaattcatgaatgtgagagcagaacgctccacctgcgggtgtggctggccacgatgatgggaagcgcgttagtaatgggccaccatggctgacccccgacctcatcgaccgccgcccctctccccagccaggttctgctgtccaggcagctgcagaggagtttaaagggcagccatggtccctggtcagccagcctgccattaataacgtttgcatctgtgacaatgacaaacctgcagtacttgaggagagtttattaaggtcagtctataaataagaattaaaaattttaaaaaatcggttgacacagatgaacagacagatgaagaaagtgattaggtgaaacaataaatataaaagtggataaggagctcccagagctggcctggaaatcagagcccagcccagtcttcctccgacctcgcctgaagtttagatttcatgaagacactcagaacttgtaggttttgtgaatctaggccctggctaatattttgtcatttaatgcctgttctctcagctaataaaaagaattgcagccatttctctatgtcaagcccataactgagagctggtaaaatttaaatgtctcatctgtcctccagcttgcatgcagatgcccttccccgggagcttggctccaggcctgtgggctagtgacagtcccccggcttgcccagctggctcttgctgtctcgggatggactgcctgagcaaactggccagggggattggaagcaagaagtgtgtcttcctgtagctttgtcccccatctcagagagtgggattctcccccgcagtccacaggtctttggggttttggtgcataccatcccagtccactttctcaacgaagtggctcctgctctgtaggccttttcaacgatcgtggtgatttttaatcgtatatttaagcaactcttttcaaagttattttgcctccgttagctcatttggccctcacaagaagcccaggagagactcagagcaaatttgattatctcatttggaagatatacggggcacagagaggtcaggttagtctgaggtcgctccgcgtgtaggtgcagaaccaggtcactgtccactaaatgtacgaagagagggaaagaaagcagtgggtaggaagtccaagtgctgcaaagaaatgaaacttagccagctttccacccaccaggaatgcatattagcatgaaagttaacttgtcctcacttcagtgacaaccagggagcactatggtagctctgcagggctgtcaggccagaaacaaccttcagaatcatcatattattaggatgtggtgctttattccaaataaaggagtaaatgtcactgtgtctcatccttcagaaaagacaattagatggaaatactcaactgattctcagttaagcagaattatcaacaagccagaatgtcacaataagaaagcaggcagtagacaggatggagagttctcctaaatgctctgccctctgttagtccttagattccccatgactcaattcaagcttgagggtcttaggggtgcaacacagattgggagctgtacagagctcagaaccacaggcaagaaagaaggaagacttcagagctggagtctaaaagagaggattctgccattcaattccgcttatcaaatgtctggtattatgtcccccaagccagaccccagaccaggagcaccagagtggggacagagtgaagtgaccccagtccctgagcttcaggtggaggacaggcaagtatgtgactaattgtgagatgcaatgtgagaactgtgtcagtagtgtagacaccattctgccatgaagatctctaccacaggaaaggaattctaggaaggcttcacagagcaggtgtcccaaaagaactaagcttgaaggaaaagtgggaaaatcccatatgggaaaggaaatggcatgccaggtgctataggctgtgtcccctcaaaattcatatgttgaagccgttacccccagaacctcagaatatgactgtattgggaggtagggtctttaaagaggtgataaaattaaaatgaggtcattagggtgggccccaagataatctgactgatgtccttatcaaaacagaagattagaacacagatgggtacataggaaagaccttgtgaagacccagagaagacggccacctacaagccaaggaaggaggcctcagaaggaacaaccctgctgacaccttgatcttggacttccagcctccagaactgtgagggaataaatttctgtcatttaggacacctagttggcagttatgttttacagccaccctagcaaactaataacaccaggaaagcaaagagccgggcacagttctgggagtgggaatgtgtctgagtgtttaaagcatggcggtgctttgaggagtccaggtggccagaaggggacagaacgtgcttgctggaggcaccaggacgccagagttcttgactcattaccaaccgttgtcctcatgggagtgccacggcagcctttcctggctgtgccctgctccactcctgtctcccaggggaaggtgggcactcatatcctttgctttgctttagtgcaaacctaaaggcagcttccagctcagaatctccaactccttccctggggtctccccagtggcaaccacgtgcctcccacatgtttgtggaggacagagccaacagacacctgtgtgagttcagggttgcctgctctcttccaacacccttggcttgctagctttccaccctaggagcttcccagatctcccctagtagatggctgctgagggaaaccactcaactcaaagccacggccagctggaagatgttttggaaactctcagctgacattgcagcctctgtggtgtgggagaatgtggtaggctgaataatggcccctcaaaaatatcaggccctaatccctggaacctataaaattttcatatacagagaatctttgcagatgtgatcttgacatgtgggattatcctggattctcacagtgggccctaaatgcaatcacatgtatccttataggagggagggagagggagattttatacacacagaggagaaggcactgggaagacagagccaagagatttgaagatgctggccttgaagacagtgtgatgcagccacaaaccgaggaaagccagcagctacgagaagctgggagcggcaaggaagacttctccccagagtctccgagggaacaaggccttacccacaccttgatttgatactcatttcaaacttctggccttggtaatggtgagagaataatcctgttttaagccaccacattcctggtcttctgttacagcagcacaggaagctcatgcagaatggcaggccagggatccaggtggggctctgacacctgctggttccaggcactttatgctttctccgatctcagtttcctcccctgagctcccattgtgtaatgcatcattgccattgtgacagccaatcctggcctgcctgcatatgcatccaggtcaaggggcacccacagcactctaaccaggcctggcaactgcagcgttgccccacacgcagcagaatatcatgaacttcggccttgctatctgagagtctgagcagcccagatcatggatgttcgcctcgacgttcccatttgttgcacccaatctgatgataaacgtggagaccccaggaacactggcctggaaaggccctgaaaactgagagatgtagctgaggcaagaggaaagaaaggaaatggcattttccctccaaaaggcctaggccttcttgaatgagccatagccagggagccccagtgtgtgcctgggaggtgtccaccagcagtaatcccagaggccattgcccctggtttcacccacagcaatgggcagcagtgatgggggccaagtcactgaaaaagaaagggaaagtggaagtggggctaggggtaggaaacgtgtacatctgggtgggtttgccaggagatggggaggcttcatgtttgaagggaacgtccagatgccacctgctcaggggagcaggctgctctggagcccttactgcaagcctgggaatgggtcctggccagaaaacatgcaggtgttgcaaccaggtgcagggaactcttcctacagacacacctgtgcttcctggcagcacatcctcttggggtcctcatctggctcgcagccaccctcctccttgatctcactaactgccaagtcaccctctatgatatcatcctcactctttcttcactgctcctaacccagtctgaaatcgtgtactttgtcgtgatttattgtcgatctctcctcataagaatttaagtgcctgggccaggcacggtggctcctgcctataatcccagcactttgggaggacgaggtaggcagatcatgaggtcaagagatcgagaccatcctggccaacatggtgaaaccctgtctctactaaaaatacaaaaattagctgagcatggtggtgcatgcctgtagtctcagctgcttgggaggctgaggcaggaaaatcacttgaaccatggaggcagaggttgcagtgtgccaagatcatgccattgcactccagcctgggtgacagagcgagactccgtctcaaaaaaaaaaaaaattttaagttcctggatagaccaggctgtgacttcagtgcctcgtctctgccacagagaactcactcaggaaatattgaatgaacgggtgaatgagtgagtgaatgagttgatgaatgagtgagtgaatgaatgaatgagagagtgacgcatgaatgagtgaatggatgagtgagcaaatggatgaatgagtgtatgatggatgaatgagcaaatgaatgaatgagtgactgagtgataaatgaataagtgaatgggtgaataagtgagtgaatggatgaattaatgaatggatgggtgaatgaccgaatgggtgaatgagcgaatggtgaatgagcgaatgggtgaatgagtgagtgaatggatgaattaatgagtgagagaatggatgagtgagtgagtgaagtgaatggatgaataaatgagtgggtgaatggatgaatgaatgagtgactgaataaatgaatgagagagtggatgaatgcgtgaatgaattaatgagtgatcaatgaatgagtgaatggatgaattagtgaatggatggatgaatgagtgaatgtgtgagtgagtgagtgaatgggtgagtgagtgagtgagtgagtgaacgggtgaatgagtgactgagtgaataaatgaatgagtgagcgaatggataaattagtgcatgagtgaatgagagggggcactcaagcccccacaccgatattcacagatattccagaagctccacggagcctctgggagctcagaggagtgagggaggttcctgtcctcctctctctgatctccagcctgaggtccagggccagggagactcatcagctgccatcgtaccacaggcaggttatggtgatggccgtgcctgggggccagacagggtcacggaggtggaggtgggagagatggccctgggggactggggttcagtggtttctcacagtgttcaaatcaaagcccaaaggcaaggacttgggcttctttcaaagaatgggagccttatttaatccataatcccaccatagctgatgatgcctgcagaccccactctcagctccacgtggctgcccccctctctctcgtggagccagatgtcccacggtcccacccacctcaggggcatgaaggtgcccctttcatttcttctctacattccactctctcagtgacgttttaatccattcaaactggaaggaaatctttgctaatcaccctctgaaaatctttagttgttaaaattctttttgttgttgttgttgctgcttaaagtttcattatttttaaacaatccaattttacgggcattgcatccttaatgtgccctaattatgggggatgttttggtaaagcagtgggatgcttcattctggaagtttcaccttctccaggaaggggctgctgagggtttttggggattcctacatcgtaatacatcataattgtgcatatttttactaggggctgtgaagatgctttgttacaaataattaaattcagcacaaccggaactgcacccagaaaacgcaaaccttgcataaaagcaataaaattagcagcttccgatgaatcttcagaactacctgtattagaatccaaccaatcccttctcttcagtcagtccccaagaaggagcagaagaatgcaactcccatggctccatgtgtgtgggatggagtcaggaaacctatgtttgacttctggctctgctttttaaccagaactgtggccttgggtgagttcttttctccctgagctttggatttcttatctgtaaaacggagaaaatagcaatgcaagctgtgagagtccaatgagataatagatctaaacatgccttagaaactatgaagggccagatatactactcagagacccagcctctcctgaagaatgaatcggaggaactggaggccttcttacccaaaactgctgcctgccagccaagccagattgttccatccaccacaggcactctgtcccgcccttggccctaaacaaacctaacattcctgctgctattttggggcccccactaccctcagggccccaaggtcaaacaagctggcatctctattttcactcctgttaggaattggagagccataaaatggatatttcagaaagcccagtgcatgggtcatggggccaataccagcactagcaagcttctttaattttacttaaaggtaaaattcagtcacataatgggtgattctttgaaatccaccactaatgtttttggtgaattcttttatgaaataatcgcataatttcagcaggttgcccagggtctagaaaataaataaataaataaataaatagtcatataagccttcgatccacatttcttaaataaaatgattgaccggaggcatttaaaaaacacagtttgagagtatccatggagatttggttggaaaatcttaaactacaaattctacaaatggctcctccttccttaaacctgagcctggtctctgttcaagcaagaaggcaggatctcagcgtctgcactgcaagcagtccgaatacccgagtggggactctgtcaactggcccattctccatgtgtcatggaattctcagcccgtgcggatttatcctcagcctcagacagggcgttttgggtttaaatatgcatatgcatattgacagggccactttccttaaagaaggggagggcacagaacaggccatagccatctttgccatctatgggtgcccatgtgcccgccatctggagtcatactggagccatggtcacctgggcatactggcagattgtagaaacacatgttccactgctttctttcgatagtacctgccgcttgtttattctttggtgtgaataaagataacttttgttcagagagtgagacaacttaccagagcccccttcagatgccatgagacgggcctggggccttctggaacaatgaggagacacaggccatcgtcctgttgaacactctggggagccactctggggaaatgctgctgttggaatatgaccagggcccaccgagagaagccttgatgctgaaagcaagagttactcctgccatcaggagggcagatggaatggacagggtgggctctggggtgggggttctgctgaggggtttcctgccctggctgctgcactcggccagtggatgccattgccagatctcctgctccagaagcagcagctttcccccatggtagagttggttcccaattccctcaagacaaaaggcactatggcaactagacatgattgttgcgattaatcactcctgacgtctaaagggttttgctcctgaggtcatctggcacagtggcaaagcacacagacccgagggacagcactgccaccttcttctagctgggggagattggggacatcactgtcatctctaaaacaggaacagcaataatgataattacaatggtaattatatcatagggtcatcatcaagattaaatgggatcatctgtgtcaattaccaagcaaacactaagtgttcaatatattttttttataacttgcacttatgttaatcacattttatcctcatggtaattttttaagtttgtaattattatgactattttactggtaaggaaattggtgctctgagaggtcccatgactttcttgtggtcactgagcagcaggaagtggaggtggagacagtcccaacatcctcacgtgaagcccccatcactagcggaaccaccttgaatctttcatgcataccagcacttcatttccccaccaaaccacccccagagcccagcaaaccaatcaacatgatcatctagaccagtgctgtcaatatgatgctgtcagtatactggatcccagtccaatataagattgttcttgcaattagagctcatcaggggatgagctctctgaggaggtaatgagatccttgtccctggaagtgtttaggcagaggccagatgccatgggtcaggtatttccccactagttgagaaattggacaagatgacgctaaggtactactatcaggttctatgatacgaagacatcaaagcttatcctcaaggaaccatttccagtggtgagctttcagacaattagtgggctaaataataatctaattattgttatgtgtggccacttttaattaaaattaaatcaaattaaaaattccctcctcagttgcaccagctacttgtggctgggggctaccgcattggataatgccccatttgcatcacctctgcagggtctcttggatgatgctgatctctcctctcagctctgcctttttctccatgtacaaaaaactttatttgggtccaaagcagagcctgtttcatcagcaccagccaactgggagataggagtgcttctcaagctgcatccaatctgacagcaaagacagaaatgttccaattttgaccagaaggaaaaaaatcctgccagggcaaaagggaaaattcactcatcaagtattgtttaaattatttgaaaatatactgcatctgtttaatgtttaaagcaaaagaaagtggcaaagtaaccgagcatgagatagctttcaataaataatcacggaataaataggaatattcgcatgggagccctggaaatgcacgagtagtttggtaccaataaaatgcaaaggataaaaataaaatacaatacagcggcaaaagtatttatataaatcatgaaaatgtaggaaagaaaaagagccagctgctccagctcacatttggaacaaggtaatatgagaaatataagtctgccaccaaagactgtattagaagctgggaaataacgaacatgattgcattgtagtttttccaagggtgaaatttacaaacgatttactgtaaatgtttacccagtgtacaatagagaaatgtgatcagagataatttatcttaaaattttcaccacattcttatgtattccacttgagaaaggggcataaggtttttaaatgcgctattgtatattcacctcctccagcttcccaccctctttatttatttatttttctttttggcttaccttaagctactggacaaagttgtctctttgatcctctgctaagaaagtcaagaattgtggcctgcagtgaggtgctaattgatgaccaatcagatcaatgcctatttcattaatcaagagtttcagagcaaaatccacatgaaggaaagaaactttcctctcgttccctctatggaaacagaagcttgactgatggattcccctccatgagtttgcttccactgaatatggtccaaactctcatttgctggacaaactattctgcagcccagttcaaattaaaggcaaagtctttggagctggaagacagaggttcaagttcagcttccccaagttgtacaatgtctttgtcaataaaatggggccaatgaatgcagtttttggaagctcttttctatcatgaagcactaggtgagggtcaggttattactgtgacagattttgctgggcatggacccccaattcccttatcttcatcctacccactgcctctccaaccttctccccaaatgaccattgctggagaggaaatcacatgctcaacaaatcactgcgacatgttggtgactccatatgtcactctttccagtcccacaaaaaaagagaaaattattgaaggaattgtctagttgtctcgtctagagaagagaagacttggggagctttgttgatgccttccaacactgacatggctcctgtggggcagcctgagtaggcctgttctaggtagctccaggaaacagaaccaggatctatcgggtggaacagatcccagtccagtataagattgttcttgcaattggaactcctcagcggacgggctgtcttggaaggtaatgagatcctcatccctggaagtgtttaggcagaggccagatgccatgggtcagggatttcctcactagttgagaagctggacaagatgacgctaaggtacgactatcaggttctattctatgaaggcgtcaaagcttatcctcagggatccatttctagtggtgagctttcagacaatgagtgggctgatatttctcagcaagtcacctccaggaaacactgaaagcctacatgtaggtgacagaggctcaacctacaccccatgtccccaacctcattaagcacagcctcaacaacaacatgcttttctgcaggaagatgtaggtggaagggtacagggagccttttcccagcttgaagcaccactggggcaaaggagctgttcatcttccaccagggtctgagtggaagggtcccctgaatacaacagcctttcttctctgaaggttatctgctaagcaccaaactttgagagctgccagccatgactgccccagcgagggcagacacaggcccaaccgcgatggaaagggaggccgagttctattttatctctggctgcgtcagcccctttaaatgtcctcaattcccctacttggaaagtccctggataacacgttatttaaatgaacctattccacatcttccatggttacttacttttctcaatgacgaatcttaaaacggattgtctgtaaaagatcatctgtactttaccaatatccaggctccccctccccaaaaaaactgtcagaggtacaccacgtgtgtgaaactagtcgatttccttaattcatccctggagaatggataagtctatcaatctattaaattggaaagccattaggaggcctggtttatgcgtttcaagctgttaactagaagttgattgattgttgttcctctgataggatatgctgatctaatctcactgtgctccagtttgcaataaattacacaattcatttcctccatttagagagagaaaatcacacctccaggcatgcctgcttcagaggcaaagagcaggaagcctattttatggtgccatttagcctgcaagctttcagcaatccttgcctccaaaaaatcgaagcataatcaaggtgtatgtttggaaaatttattgttataattttccccaagtaatctcctccattttccaggcgctccaacggcataagtcatcatctaaaagagaaaatgaatagcagtttaaaatttatcggtctttgattctcaattatacgtgtttatgacttcatctgtcttcagtgacttcaaccttttccattatggtggaatattatttgtacgggatccattaaattcacaatccagccctaatggtaggctgtagcgtttccagaagaaaatttttgaaaggtggtttgcagaaagcgaagctgttatgacactagaaattgctttattgatagcctcgcctctcgcctgaacattttgcaatttgtaacctggcccatatctatatttcaggctgacgttgataagagcccttctgccccccacaccagattacactttgtaatgacatggagaatgcagggtggggagggggaccgagaagggcagccaccttcttcctcctccctgtccccagctgtcctcctcctcctctccattgagaaggaagatggtggaaggggattgtgtcttgccgtgctcctggtctttgctggccttgatccccatgatgcctcaggctcagcctctccatgaatgtcgaccagggagtctcttgtaatggaggtctcttgggcccgaccctgtccagcacccgaccctgtccagcaccatggtcctgaacctctgacacggggagagcctgggccttttctggtggagtggaaagaattgagctagagatgtccagtaggctggacacttctctctggatctgatcttttggtgacagaatatactttggggagaagcaagttcaagttaaattcaggcttaagccccaatctcggcctctcctcacacacatgcagactcaatgtgctccctgccttccctggcaacttgttctttgaggggaaagatccaattcttagaaagaatctcccagctgagtccaaatgcaccatgattggctctgagccagacctcagcagttccccccatggcttgcattcagcaggggtgtaactctcctcacatgccagcgccccagctctgagcactctccaccgttcccacgtccttcacaagcagcaatcagaacaactgccacgccatgctcacgaatccacctgcagctttgcaaagagtacatcatgctttctgttaaagatgaaacaccgaggctcggaaagggcacagccgttcctcgagatcatgcagctacagccagggcttaagtgcaggtctgctgacaaccaagttcttgccctctctacactgaactccttgttcagtatctacttaaagtcagttcttctttccttatttttctccctccctccttccttcctttccttctcccctccctgttctctttctcttcctccctccttccctccctctctttctcttcctctctccttcttatctttctccctccctcccatatttgttgagcatttacctcagcccagaaagtcacaaaggtaagaaaggttacaaagcccagaaggctacaaagcagctgctcttgaagaccttgtaaacaaatgagacagacagacacaaaattaagtgctgggggcagcaaggcaagccccgtaatcatggggcaaacagagggcctggaggaccaggccatggttccttctgctgaggctgctatgaaaagcttcacagaggaggccaagtttgggtcgggcactgggggatgggcagccacttgccaagagaagggtagaaaggcagtcaggtcaaaggaagaggggagcagagacgtcagctttccctgggaggaaacagtgaggaagattctccatgccctgcaatttgactttatgtgcttgggggtagagtcgttaggaagcaggaacacaggccacagagatagagccctgggctctacaagcccatcagggaggggctggggtctggctcccaacccaaacccagtgccgggctggggaacagtgtgtggctcctcttgccacaagcactactttggggtttgacctttcaccatgcttccaagtccccaccggctggaatgctcagaatacattctgtcagagcttggtcccaattgctcatgaatgttttccaggaaacacaggccccacctcaaacctgcagaatcaggatctctgaggttgataccaaggggcaagcccaacgctttctaccagctctgccgctgttccatgttacaaaagagaatgacagtcctcggtgtccccacacccccctctgccagcagcccaatggtaccttctcccaaggagttgctatttctagttaatagttccaagaaatttgcattttgttccattgaattacagaaaaaaaaaagtttccaagaaaatccaagtatgagaatctgcataacgctaatgttagagtgttagaactgaaacagaccccacacaccacgtaacttcaagccagttacactctacaaatatagaaaaggaggctcagaaaggttggttgacttgccgagggtcacacagtaagcagaagagccaaagctagaagtcagaacttatcctgagttttgcagttatcaaggacgacgtgcattgaggaaaaaagccctagaaacacagcaatgttcttattaatgaccctagaaaagggcctggtgcagtggttcacaactgtaatcccagcacttagggaggccaaggcaggaggatcacttgaacccagaaattcgagatcagcctgagcaacatactgagggtccatctttacaaaaaattaaaaaattgtggccaggcgtggtggctcatgcctgtaatcccagcactttgggaggccgaggcgggcagatcatctgaggtcaggagttcgagaccagcctggctaacatggtgaaaccccatttctactaaaaatacaaaaaattagccgggtgtggtggagcccacctgtaatcccagctactcaggagactgaggcaggagaatcgcttgaacccaggaggtggaggttgcagtgagccgagatcgcaccattgcactccagcttgggcaacaagagcaaaactccatctgaaaaagaaaaaaaaattatctgggtgtggttgcacacccctgtagtccccgatacacaagaggctgaagtgagaggatggcttgggcccaggaaatcaaggctgcagtgagctgtgattgcaccactgtacttcagcctcggcaacagagtgagatcctgtctcagaaaacaaaccaaaatgaaacaaaacaaagagcctagaaaggggctgccagtgatgtaagcaaaggagttaattatagatggcacctaaatattggaccacaaaggtccacttggggtttccagtaacccataaaatctagtagaaatgagacaatttgtgggttaactgaaacagtagggacgccccacatggatcacgaagaccagccaaccctctgcagggctggcctgatagcatctcttcaccattgatgctattaggtggactgctgtggcattgccattggctctgtgtttcagagacccggcagtcccagagccactgggagcacagccaccattccccaacgtgacctgtgtgtgaggtgaggaagcttagggccattgccagctcctccctctcttggctctttgagagtgttacacttggacatgcagccgaggtcctcagtctcttccagcctagtggagatgagggggaactggctgccctcacatatgggcgagactcaaaactcgtgacagtgacttttagttcagccttgcagataatcacatgcagaccgatctactgtttataacacacctgcttctgccacagaaagtagtacatcattgagaataaatagatggatagggaaataatgtctacaaacatatacagaaagtcagccttcccattttggattcattgtcaagtaactggctaaaggctggacctggctgttctgagaaaaaggtgagacccacggagttttggcggaaaaagaaaggagccgcaggatagcccatcacgtgtaaggtctcctccctaggtctctgtgtgaggtgagggatctattttaaggtccttgttgaggctctctagggtgctctactgcttcatccctctccaggagaactgcccatccatgccttcatggggacacccctgcagctgccttcgtgctgtttacacagttagcaggtgctctttcgctgctgaccggactttgggtgaatgcctgacccagtgggcgcctctctattggctggcgtggaccaatcagaatctctgttgtaggtatctggaattgggacagtgtcagcctagaggtgatgtaggatttctttccctcagatgcatagaaagcagagacattcggggtgttggcagagcaaagaatgaccaagttgggtttagagaggtggaaatgagcggccacggggccccaggaatgcagagagccttggcttcctggtttctggccatcatgaggacaatcagactcttaacccagcagccttggtggatttctctgtttaataaatccctcgttattgaagctaagtctgagtgagctttgctcctggcaataaagccatccttaagagggctccgatttgctaccgatagtgtttaagatgtcaggagaatggctgtgggaggtggaggaaggggcatgggaacaaggaggaagtaagggaagttctcctgttcattctccttccttggacagccacacctaggaggcagacactgggtgtattcttaaggaggaacacattgtttttcagaggacaagagtgtctcttggggcagtcattttttaaatggacctggaaaaaaaactgtgaagccagtaaagctttcctgcactccccaggaccctccacttctgtctttctgtgccctactttgtgatcccttcctctcccaccaatgacagggatagtgggttggatagtgtccctccaaatttcatggccaccagaaccccagaattgggctttttttaaacattgggtctctgcagatgtaactggttaagatgaagtcatattggagtagggcaggccctcaatctaatcactggtgttcttgtatgcaggggagaagatacacagatacatggaggaaagaaggctgtggagccatccagtcagactggagggatgcagctgcaagcccagggacgccaaggattgccagcaatccccagaaaccaggacagaggcagggcacagactcccccttggagcctccagaagggaccaaccctgctgacactctgatttcagaattctggcctcctgaactggaagagaataaatttctgttgtttaagtcgccccgtttatggtaatttgctatggcagcctgaggaaatgaacacaacagggaaaaggactgagggtctccctgtaatgttggcatttttttaggtgacaatagagaagagggcagagtttcataccaacgtatgaattactaatatcgactctttacgctccactgagaaagcaattttggaataagtgtaatcaaaatgcaaacaagtaagcctgcctgttctgtttacacttatgtacgcttttgacaaaaggaaacatatatttatttggcacccaatacgtgctaggcaatgcgataggtgctttcatatctaacatttcacttaattttcacaataattccgaccctgtgagggaggaattactatgcccattttgctgttcaggaaactgaggctcagagagcatgaacaactgactaccaggcacagagctatgggggcaaaagtggctgcgcagagtgtaagtgcaggagtcccaggggtggagctgaaacagccaacctttctgtcggcctgagccctctaccttggagtccttcacgtcttcatgcgtctccctgggctcggcaaggctgtgccggtgaaggatgctaagatcattgccactctggaggagcaagacatctgacccactgtcacatggcaggggccctggcagaggggcatggtagcctttctcagggagagggatgtggcaaggcagcccctggtggtgaaccttgcaggggtggtgcccggaaatgacccatttacctgtgcctctcttcacagcatgccacgccctcccacacatactttctaacgtgaccctgatacttccctggatgatgtgaacagccccactgaacaaatagccgaggacagagcagatcagagaggatgaaggccttgtccctggttgcacagctaagagcctcatgacaaggccaggcacagtggctcacacctgtaatcccaaaactttgggaggctgaggcgggaggatcacttgaggtcaggagttcgagaccagcctggccaaaatggtgaaaccccgtctctactgaaaatacaaaaattcaccagatgtggtggcacatgcctgtaatcccagctactcaggaggctgagacaggagaatcacttgaaccggggaggcagaggttgaagtgagccgagattgagccactgcactccagcttccagcctgggcaacaagagcgaaactccgtctcacaaaaaaaaaacaacaaaaaaaaccaaaacaaacaaacaaaacacacacacacacacacacaaagcttcaggacaggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgtgcctgtagtcccagctacacaggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaacaacaaacaacaacaacaaagcttcaggacaggcctccttctcacgtgatactttactccactgccaggggaaaagccaaatgatctgttagcaaaatacttcctacctcaacaaaactcaaaaagtttagaataaatcagttaagggacaactgctgtgtggggccattgattttggctgctcagacccgttctcttcccacagccagaggggagtggctggccaatcagcgggccccatctgcttggccactatgattgggtgaggaagtggctacttgacccaagctgggccaatcacaggtcattagttttcggctggtgctgggagtgggtggggattggctcttgacaacgtagagagaaaagctgaccccagagcacgaaactgggtgggcagtgggtaggggagaccttcttcctggatccacctgtggctgagaccaacccatcagaatcctacctattacctgggcagcaaattccttttattcctgagctggtttgagttgcatttctgaaagaattgcaatgaatacaggcattctcccacagaactggaccacatacttctgggtattagttgagataaactaacagacccaaaaatgagtcatggccccaacaaacaagctgatttcacattcatgtaaatagtgcagagcagttcgggtggatggtggggtagcagttaagggagggaagtcaaggctttgttccccaccatcactgggacagagggcagagaccctcacaatcttgatgtgtgacctgtctggaaagacttgaccgctgaggcatgtcctgagagtaggtctccagggccttctgggagtagttctgtgaaagcccctcgagagagaaagagccctctccactcattctcctgcaggtcatctctgcccagcctgctccagccctctctcactgcagcaccttgaggagttcacctaggtggtctgggacaatggcaggctggtgggcatccccagatcaccaccatacagtctgaggcttttgtgcttttcttggttcagcatattgagtgcaaggctgagctttggggctctgggatgcccactcatctccaacagcctccctgagccccgtggaaagtgcctggggaccagccttcctcccttgggttgctttgagggcctgtggctttgcagactcgaaacagtcaatcttatgtgcagagcctgctgtccctctctacttcccaccaggccaggaagttttgaccaggccctttctatccaacaaggaagaccgtttcccatgatgcctgtcatttgcctcctggccctggcatgagcaccagacctccacccccaaagccacaagaagcagatggctacgatctcgtgttgaaaccaccgggaccctcaccagcaagaaccctggatgccagaatattgtggcttatctctcagcctggcggcacagtgctttatcagcatcatcctcttggttaaatatctacaacattaattattacaatttattaaatctggggaaataaagtcttactgcaatccccttgccacttccccatgcccccaccaaaacggagtatcttattttgctaactgcttaaacataaaactccagaagaaaaaaattgtccccacagctcatatttttcatcatttggtcattaaatagtgatggatataaacctataaagaacctaaactgaaccttttaacaatccatgagcaatactatcatttctttaatagaacctgctgacggtgccgcgcgcagacaccatttgtcattttcagcacgcaataatcaataagttggcttgaaaataaataatataacagtcacaatatattatctttcagactggccttatactaaccataaaatgggactaaaacaagacagaaacttttacatgaatgttaaaaagttagagacatcacagtgaggactaatgcatgaattagacccatgccaaggtcccaaatttgctgtgagttctgttgagccaggcttctgctgccgcccactgcctgcagttagagtaaggacgcagcagccaggtggcgaagtcacagtcagcacagtgcatgggggccaaaggtgacagcgttctgtcacaggctatattacccaggtgcagacttcccgacgtcattccaggtaccccagagcatggcttcaaacagaaccacctgacgggtcatgcacccagtgccagggctgggtagaggtttgcttagttccaagaggaggccatagcccagattcagcttcagagattttcattccgtgggagagaaaaacgccacaaagaatccaggccagcaggtggcattggtggagagtgggttccggaagcagcaaggtaatggctgcagatcacagtgagcttgccgttatctgggatagggtgacccttagcagccctcagcaactcagctttgagtctgctggccatctggtgctgctcttcaagagcaacagaaaaccccctagtttgttcatttgttctttcatccattaattcattcattcatccattcattcttttaacaaaaaaggtattgagagcttacgtaagttccaggcgctgtgctaggtgccaggaacacagcaatgaagcagacaaaattccctctgctcccctcccagagcttatgtgctagttggcgcactacaatagacaggatatgtaaatccatctcaggggggtggtcagtgctagggaggactgaccccctagtgtaaagcagggcaaagggacaaggtcaagtgtgtgcccttcagagcaggtctctcctggttcccaggtgcccaggccttcactcagagtgccccatccagcctcacacctgcctttggctccctagcttctctggtaaccagtctccatggcgtcctggtgacaccctatgctgccaccagaaaccattgtatgggaggagccccatgccctgctgtgaggcaggcagcgccatccccactgcacagctgggagcccaaggctcagaggcagcatgtctttggtaagcaggttgaccaaatgtccctgtttgcctgggaatttcagtgcttaaaccagcacagtcccaggcaagctgggatggttggtcatcctcaagcaagtggtagagctggatctcaatctcacctgggtcaaaggactttccaccaccccttgggggccatctcctcactaaggctgatgcactcctgggaaattctcatagcaatttggtttcttctctcatttttatttatttatttttgagcctcgctctgtcgcccaggctggagtgcagtggcacgatcttggcttacggcaacctccgtcttccaggttcaagcgactctcctgcctcagcctctggagtagctggactataggcatgaaccaccatgtctggctaattttttttttttttttttttttttagtggagatggggtttcaccatgttggccaggctggtctcaaattcctgacctcaagtgatccacccgcctcagcctcccaaagtgctgggattaaaggtatcagccaccgcgcctggcctctcatagcaacttaaaacagcaactgtccctaaaagttcttagatgatttgggcttatctgcaccgaatttggagtcaaagagacctaggattccatcccaatttgggcattcaatagctgggtggccttagtcaggctacttaaactctgagcctcatctgaaaatgaaggtaaatatgcatatttcagcagggtcttgatgcaaatttgacatcttgcaaatgacctagcccatggtaggtattccataagtggtggtgttattaatacctagagggttttatcccaggaactaaaggaaagaactcctattcctaggggaggtgtggaggtagaaacgagtgctgccacatttattatgaatcagctagctatatggagccaaaaatactctccttgggtagcgtctctgtgactgatattaaaaatgactgatttaagagaaagtgcttcacccttgttgcaaactaaggaggtaggtctggagtattctcagccttaaatgctgccagtatttcatctttgggtagtcataaagttaaaggttaataggctgtacaaatgacagagtttaaagggaaagatggggaggggccggggagctccgggcagctgcgggcatgttggagacaggtggcgactcacctgcaggcaggaaatacggaggtggggctgagccagccttctcagccccttctcattcctgctcccatatggaaactccttattccaagagctcttttcctctacagggatttctttcctggtaggaccggagggcacaaggccttggagacgcaggctgggcagcgtcgtgaaagccagtgcttgatttagtgtcctgagaaagagtgccaggaagcaaggggactgagccccttggaggcatgagaagaaggcagaagggctcaaatggaattgcagtgagccccactttcatgaggctgaccctggggtcagagttttggttctcaaatttgggagcacatcaggatcaccaggaagcttgttcctcaaatgcagattcctggactccagcctggagatggagttggggcctgggcatctgtattttagtaaattcttacccatctcccggggtgactgtaatgtggctctaagacagatggtccatgggcatgccttgagaaatcctgaatcagtcaatgcactggagtctagttctagatccagattcctggaccttcagtaatgagggtctttggggattattgagccacaagctgcactcaaatcagccaggcgctgttgaatctgagtccccactgggacttcattgaccacacagaatctcgaaggtgcgaacaagcggccaggggtggggacctctgcctcccacatgttaccaatggggaagcagaggcaatgcccaggaatgacctgtccaaggtcaaccacataacaggggagccagcacttggactccccagtctagggctctttctactgcgccacaggcctcttcttgccattggcaggggcttgcgctcgcttcaccaaccactgccatggagcctggtttcgaccattcccgctttctacacatacggagccagctttctcctgcactctgtcgggactgacaaa

SEQ ID NO: 11970 - DNA, 7020 bp, Human
agaataaaactgtctcaaaaaaaaaaaaaacaaaaacaggccgggcgcggtggctcacgcctgtaatcccagcactttggaaggccaaggtgggtggatcacgaggtcaggagatcgaaaccatcctggctaacacggtgaaaccccgtctctactaaaaaatacaaaaaattagccgggcgcggtggcggcgcccgtagtcccagctactcgggggtgctgaggcaggagaatggcgagaacccgggaggcagagcttgcagtgagccgagatcgcgccactgcagtccggcctgggtgaaagagcgagactctgtctcaaaaaaaaaaaaaccaaacaaacaaacaaacaaaaaaacaaaacaacaggagaagatgatgacagacctcacaagagcttggccccagggctgaaaccccacccagtgctgtggttctgcggctgtgggcccatgggtgcccccaaagggtcccaggcagatggaggctcctggttggcgtggaggaaggaaaaggatgaaatcggctcccctggccaccccttctagcccagctgcagctgcagtccgtgggtctgagccgacccttggggttcatcggcccattttacagatgcggagcctacagccgggaggcgtggcggctctgggcggtgcagggttccggggcggggaggccgaggcgcccgccctccccgccggggctcacctgggtcagccctgagccctcgagcagggcggatcggccgctgcctgcttaaagctggggccgccaggagtgcgatcgcctgcggatctgcagctgggcaccggccgcaacgcccgccccgcgacggcaggtgagatgcgggcggccccgtgggaggggtctctgcctgtcctcgtcacccacttccttcccgtttgttgctgctgcagggctgggaatgggggggaccaagcacttcgcagggtgacccggggagatctgtgagccagtggcctcagcgttgaatgagagctctctcccgggtccgcgctcgcagggactgaagggactcctgaatgtccgcgggacgtgtcgcggcggcgcccagcacggaggaggcaggcagggaggtgaggagcaggtcagaccggccgcaggtgcagggcctcctgccctcccaggctgcggtcccgtggagggcctgcagacagctgctgagactatgagggtcagaggtctgtggtcacgcgcgctatcaccagctagctgcctcctgcctggttcctcctgcaggaatgggagtctggggggaggggagggtgtgggcaggacttcctggaaaagggaagcccgttggtgtttatgtgtgggatggagagagggcagggggaggacggggacacacgcggagtcccccacccagatgttgtcaaacacagctcccacaccagacacgcaacccatcctagagatgcaacccaggcacacacacatggacacacacaaaactccatccatagggattcccacccagtgccacgtgagaacacaggcgtgcatcgcagacaagccacacaggcctcgcaggctcagcatacatgtctgcagcaacaccatcaggtacagagccgaggcccaggtaggcatgctcagctgcacgcaggaagcaagacacacccagacacacacaggtaagcccttactcagagaaagaaggtgcaggagatgtgtcttgggtaatcacagccacagcctctcaagtgtgcacacacacacacactcacactgagatacacagacacacagagatacctggacgtgtcaagcctacagcacaaacaggcccctgcaggtccacccggaggctgtgtgggccgaggctgctgcacacgtgtgcccagatcctcccacccccaccccaatcccgtgtcctgctccagggaagtccagggctcacatgacccaaggggagggctcccgggacagccctcggagaaactgcatcatcctcactaatgatccacttcctcctcagggaataaaggctcagggaccggcagttctactctagagcccaccagcctctcagagcctccggtgactggcctgtgtctccccctgggtgagtgctgggcaggctaggtggaaggagggtgaaatgggcctgcagggccatcttggtacagctcgccctctcacagaccgcgccccccttccctaagccagcttgtgcagccttgtgcagcttgtgtgtcctgagaattagggcaccaaggggttcccgcaggggcagcctgcagcaagcagtctccctctatctcagggcaggcgggggtctcaaggcctccctgcccttgtcacagcccgggccacctatgcttgtctctcttctcccagatggacatgtggacggcgctgctcatcctgcaagccttgttgctaccctccctggctgatggtgccacccctgccctgcgctttgtagccgtgggtgactggggaggggtccccaatgccccattccacacggcccgggaaatggccaatgccaaggagatcgctcggactgtgcagatcctgggtgcagacttcatcctgtctctaggggacaatttttacttcactggtgtgcaagacatcaatgacaagaggttccaggtctgtgcccaacagagtggggcaggaggtgggggcgggcagtggggagaagccgccttacctagtgaccttcctttggtgagggcagagggaaggtgatggggcacctttgggcgccgggagcattcagtgtctcccttatcctgacttggtgggaggatcggcatagccactgaccccagggaagaggcctgccctatctgtttgctacaggagacctttgaggacgtattctctgaccgctcccttcgcaaagtgccctggtacgtgctagccggaaaccatgaccaccttggcaatgtctctgcccagattgcatactctaagatctccaagcgctggtgagccaccctcagccctgccttccgagatcctcacatagcagggacacaggggccctgtggcttgagctgaccctgggacttctgcgcccaagatgtgcacccacgacctctatcccctccacaggaacttccccagccctttctaccgcctgcacttcaagatcccacagaccaatgtgtctgtggccatttttatgctggacacagtgacactatgtggcaactcagatgacttcctcagccagcagcctgagaggccccgagacgtgaagctggcccgcacacagctgtcctggctcaagaaacagctggcggcggccagggaggactacgtgctggtggctggccactaccccgtgtggtccatagccgagcacgggcctacccactgcctggtcaagcagctacggccactgctggccacatacggggtcactgcctacctgtgcggccacgatcacaatctgcaggtgagggccctgtgggtggggtgggagctgggtgaggggggtccccatcccagctgatgtccacatggctggggtcctcctgctgtttgagggtctcctgtggccttcagaatgtctagactgtccctcaaatcttgctgtctaaccaggaaaacactccaaagccagaataatatcttcgaattgccaatttctttctttctttcttttttaagctcttttttttttttttttttggagacaaggtttcattgtttttcacccaggctggagtgcagtggtgcaatcggggcttactgcagcttcaatctcccgggctcaggtgaacctcccacttcagcctccagagtagctgacactacaggcatgggccaccacatgcagctaatttttgcttttttttttttttttgagagggagtgcagtggcacgatctcaactcactgcaacctccgcctcctgggttcaagcaattctcctgtctcagcctcccaagtagctgggattacaagcatgggccaccaaaccttgctaatttttatattttagtagagacggggtttcaccatgttggccaggctgatctcgaacttctgacctcaagtgatctgcccgcctcggcctcccaaagtgctgggattataggcatgagccactgcacctggcccttgcgcattttttttgtagaggcaaggtctcactatgttgcccaggctggtctcaaattcctgggctcaagcaatccaccccctcagcctcccaaagtgctgggattacaggcatgagccaccacacctggccaccaatttcttactaagtgctctacctatgaaataggattaatacactcctaaaagtcaggaaattgaagccaggaggggttacatacctcaaggtgactctgtggttagggccagatcgagccctggaccttaggcagggctctgctcaaagctgggtctccactgaccccttgtcctccatcctcagtacctgcaagatgagaatggcgtgggctacgtgctgagtggggctgggaatttcatggacccctcaaagcggcaccagcgcaaggtccccaacggctatctgcgcttccactatgggactgaagactcactgggtggctttgcctatgtggagatcagctccaaagagatgactgtcacttacatcgaggcctcgggcaagtccctctttaagaccaggctgccgaggcgagccaggccctgaactcccatgactgcccagctctgaggcccgatctccactgttgggtgggtgggccctgccgggaccctgctcacaggcaggcttttcctccaacctgtggcgctgcagcagggcaggaaggggaaacacagctgatgaactgtggtgccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagaatagttgccaaggctgaaccagtgccactggtgtgttatgttctcctggttagagtggctgggctcccctgagctgctgttccttgcctccatctcttaccccatccatgaccaagttgccttatccatggatgtgattataaaacccggccaggcacggtggctcacacctgtaatcccagcactttgggaggccgaggtgggcggatcacgaggtcaggagatcgagaccatcctgactaacatggtgaaaccccgtctctactaaaactacaaaaaaattagccaggcgtggcggcgggtgcctgtagtcccagctactcgggaggctgaggcaggagaatagtgtgaacccaggaggcggagcttgcagtgagccaagatagcgccactgcactcctgcctgggtgaaagagcgagactccatctcaaaaaaataaaaaataaaaaaaaaataaaatccaagcagaggccaggctcagtggttcacatctgtaatcccagcactttgggaggccaaagcgggtggattatttgaggtcaggagttcaagatcagcctggccagcatagtgaaaccccatgtccactaaaaatacaaaaagttagtcaggcttgctggcgagtgcctgtaatcccagctacttgggagtctgaggcaggagaatcacttgcatctgggaggtggaggctgcagtgagtcaagattgcgccactgcactccagcctgggcaacaagagttaaactctgcctgaaaaaaaaaaattggccagttgtggtggcaggagcctatggtcctagctactcaggaggctgaggcaggagaattgcttgaacccaggaggcggaggttgcaatgagctgagattgtgccactgtactccagcctgggtgacagagcaagaatctgtctcaaaaaaaataagtaaataaaataggccaggcacgatggctcacgcctgtaatgccagcactttgcaaggcctaggtggtcggatcacttgaggtcagaagttcaagaccagcctggccatcatggtgaaaccccatctctactaaaaatacaaaacttatctaggcgtggtgacacatgactgtaatcccagctacttgggaggctgaggcgagagaatcacttgagcctagggggtttgcgggtaaagggggtggagaggtgagggcggagattgcagtgagctgagattgtgccactgcactccagcctgggtgatagagcaagactctgtctcaaaaaaaaaattaattcaataaaatccaagcagaaagaagggtacaacataaagcaagtcttcctccaccccaggggcaactaatattaatcattttctttctctatatagtctatgcctccataatcaaaacattccctttattattttctttttttttttttcttttttttttttttgagatggagtctcactctgtcaccaggctggagtgcagtggcgtgagctcggctcgctgaaacctccaactcccagattcaagcaattctcctggctcagcctcctgagtagctgggattataggcacgcgccaccacgcccagctaattttttttttttttttttttttttgagatggagtcttgctctgtcgcccaggctggagtgcagcggcgtgatctcggctcactgcaagctctgcctcccgggttcacaccattctcctgcctcagcctcccaagtagctgggattacaggcgtctgccaccacacccggctcgttttttgtatttttaaatagagatggggtttcatcgtgttagccaggatggtctcaatctcctgacctcgtgatccgcctgcctcagcctcccaaagtgctgggattacaggagtgagccaccgcgcctggcaatttttgtatttttagtagagatggggtttcaccatgttggccaggatggtcccaatctcctgacctcatgacctgcccgcctcagcctcccaaagtgttgggattacaggcgtgagccgccgtgcccggcct

SEQ ID NO: 11971 - DNA, 30973 bp, Human
ggctgtctcagcagaggacactcctcattcacaccatctcctgcctcaattttcagttaatgaggaagccagacctgtaccaagccattgcaccaggtgacccaaaaccacctggaactccctgtgcgtttagcagggatgcaatgcatgcttcttctattgaagcgggggtatcctgggcaccgggtggggaaagtttaagaaacacagatggctgaggcctattcactgagtttctgtttcaatagggctaggtgacacctgagaatctgcattgtgagcacattcccatatcatgctgctgctgcactctggtggtccccatgctttgggaacctctgtgttgaagacgaagcagagtcaggaaggccagtcaggaagctgcgccccactccaggccagataggactggagcctgaggcagcgcaggccagcagggattgagggaggacacagagctgaggggcatttctggtcgggggagcaccaggctgtggtgcccaggtggttgtgggagcatgagggagacacagggttctagactgactgacttctagcttgaagggccgaggggtggacttggaagttggcaacccaggaggcacagcagctttgagggtagggaagaagggttcagttttagacaggatgagtttgaagagctggagagtcatctggattgggatgtccaataggcaattgatcattttagtctggatcagggtgagggagggggaccatgagaatgtggagttgaaagtaatactgcagagctggtagctgataatgtgggaaatgaaccagctacctagggatagtacatgaattacacaaagaagagcaatcatcagccagccatggtggctcacacctgtaatcccagcactttgggagaccaaggtggagggattgcttgaatccaggagttcaagatcgagaccctgtctaattaaaaacaaaacaaacaaacaaaaagaagtccaggcgtagtggctcacacctgtaggccaaggcaggtggatcacgaggtcaggagctcgagaccagcctggccaacatggtgaaaccctgtctctactaaaaatacaaaaattagctgggcatggtggcaggtgcctgtaatctcagctactcaggaggctaaggcaggagaattgtttgaacctgggaggcggaggttgcagtgagccgagattgcaccaatgcactccagcctgggggatagggcgagactctatctcaaaaaagaaaaagaagcagctcaagaatcacaggactgtggaaaatcctacaggccaagagtcttgttaggtgtgcctcaaccctgaagcaggtccctcagtctgcagatatttagagatatttaaaggaaaaccaggaaggagccaagagagaatgaagcctaaggtgtcctgagaccctcagagaactcagcccaagggttaggagcttgtgtcaaggtgcagcaggtgagtagggcacgcaggatttctttcctgggtacggaaggcatttctcttcagctttcattggtcccaggctcgtgccagacaaggcatgattgcacccattttggggacagtgcctgggcgtcccaggcagacccaggggccgcatgcagcagggcctgaggagggaggtgtggacggaggaggcccgctgccattcttggtatggttctcactccaggagcacagctgcatctggtctcactctgggcagcttataaggcctggtgtgagttttgtttatgcaagtgcagcataaaaggaacaaatctaccagcaccggggctgttgccactgagtccttttgcatacatttttcaaatgataactcactctacccaccccccttccctacccccaaggcgatttattgaaaaaaccaccttatatggtaatattgctaacacaccgtcagctggcctttttagggactttgtttaaagaagatccgcctctggggttttatattgctctggtattcatgccaaagacacaccagccctcagtcactgggagaagaacctctcataccctcggtaagtactgtacggcttttgccacctcttcctttccggggctgcctggcctcctgggtgcgggaggtgcctccagattggcctggcttctgtgacgctggcccagatcacacaccagagcccttggtgggcagcggcacctgcaagcatactgcagcctgctgagaaaaggcgtatctggccatgggacatcctggggcaggggcagcttggaaccgtgctccctgcctcagaatggggactggcgggatataatgcctgcagtctctactagccctgctccccagggccagtgcagatccacaccctgatgtcctttgtcttgggttagaatgtctgggaggctgttttaggggatcatatactttgcagaaaagcagcttttcagaatacttgagtcaaagccaacagtggtcctggtgtctgtgagctgtttagtccatgaaatgtctgtgctgggaatgggagggtattttcttcaggtcccctgtgggtctctctgtcctctgatctgtgcttggctgaggagaatggagggtttctgcagtccttgaaggctctaggatcattgggggatggagaaaattccacttgccctgtggcatcgtgaggtttcagggtagaaggaacttgggacccatctagttcattctcctctgatgaggacattgaggcctagagacgtacagccactcatccaaaagactcacacccaactgtgacccatttgcagatgtcattactccccccaacccacccaacacacacacaacacatgcacaaagaattaagaggaagatgagatgaaggggccacttctatgtttggcatcagaattcactagcatctcttcacaggtgaggcaggctgggtgtggcagtgcaggccttgaaggcagactgtcaggctaaccaagttactgagcgacctcagcttcctcacctgtaaaatgggggcaagaataataatatctacttggcgatggtgtgaggattaaacgagagaatgcgtatatacagcactcagctcaaggctgtcagggcccggccctgagttctcaaactttaagaatcacctggagtgcttgttaaaacacagattgccccatgccccaccccagattctgattccagtaggccgagatatggcctgatacttggaattcctaacaagctcccaggcgacactgaagctgctggtctgggaccacactttgtacagggaggctctaagtgctcactttgattacttgaatgtgggtttggactctgatactaacccttgggctgaaaagaggaagagcttcctgtgacagagagggatgggtgctggagaaactgcaatgaacagtaagatcctacatgccaggcctgagaaaaggggatgggccgtgtgacatcatgaccttggggcgagatatctttcctctttccccttgttcattctgccaacatttattgagcacttattatgggccaggcactgtctctgctccttagggacagtggagaggcttctgcagttactggaagagacagataaacagatgagaaccatggagcaaataagtacacgaaaggggtaaaggccaggaggagcccatcactcaacccaggagttatcagggaagacttcctggaggaagaggtgcctgagcttggtcctgaagtaaggaccaagcttggtccttcctggtaaagaggaagcatggtctttgggactcaagtggctcaattccactgaatttagatagcaaggcaggaatcaggtaaaactaaattcagaggggtccgcagggctggattacaagggctttagactctaaaggatcaggctatggggagccatggaagggttttaatctggagggtatctgttgaaggggctgctttggcagctgtgaggagagtggactggaacagggcaagagcgctactgcagcatgcggtggtcctgagctggtggcatgggtgccgtgcaggtagaagtaagaagggctggtgataggttgggagggaagagggcggcaccagggcattgggcatgggctcagggtgggtggtgtgagtctgtgagggcagctccgggcagaggctgctgatgaggagagcagtcctggaggtgtggagttggggtgccaggggggttttggtgggggagatgcacggcaggctctgcaggcctagagctcaagagaggggtctggacaggagcagagccaggggagtgaatggaagtccgggtaagagccagaagataaggcacccacgacagattgtggaggatccaaaatattactcagcagagttgtttttaattgaactcatgtatatatagaacctagtgaagatatcctgaagttaattagaggtgctgttagaattttccatcgtggcagtgtttttcatagacaatttctctctgccagggtttctgatggtttgtatatacgtgtaggcaaataataaaaggcagagacgcagctgcttacatgtcacttgaagctctcacccaaaaacctgtcgccaactattgtttgaaatctcatcatcgcagaggccctccgtttaggcctaacactttctgtcaaaatgaaaatgtctttgagaactgacataaattcaactttcaatagtcattgatgtgtgaaatggatcattcaattcctttcaatatgacaggcttcatcctgggagcaagttttgatggagaagagtaagagagattaataagaatcattattctttacagcccttgacgacagggattgacgaggcccagatagtaaatattttaggctttcggagcctgaagttctctgtcacaagtactcaattctaccattgtaaccaaagcagccatagataatatgtaagtgaatggatgtggctgtgtttcagtaagactttattagactctgagatttgaatgtcatataatttccatgggtcatgaaatatttttcttcttttgcttttttctcaaccgtttgaaaatgtagggccgggtgcagtgcttgcacctgtaatcccaacactttgggatgccaaggcagtaggacaactggaggccaggagtttgagaccagcctgggcaacatagcaagaccctgtttcaacaaaaaaaaattttttttgaaattagcagaatgtagtggccatgccagccacatgcctgccatcccagctcctaggatgaggagaaaggatccttgagctcaggagttcaagcctgcagtgagcttgatggtgccactggactcaatgcctaggtgacagagtgaggcccagtatctcaaaaaaaaaaaaaaaaagaaaaaccattctgagatataggccatacagaaacaggccggaatttgccttaccctgatttacaatgtctacggcaccttcatttccgttctgtcatcttgtgagatagatactatcatttccatgttctagcggaggaaactaaggcccagggaaggaagggactgggctgtgggaaaggggaaccaggagggagaagagggtaaaggaaggaggagcagtgggaggatttctagagccaaacttgtctcctttgaggtgctggggagggtggattttaacagctctgccctcacattgggtttgaggtggccagggagacgggtgagtgagtaaatgacttgcattcattatgtctttggtttctggccacctttggggctaggggaataaaagcttcattcctgagtcagtgagagcttcaatgaagcccagatgtcattcgtgctgaaagaaccagaacaactctctgctccctgccaagcatgaagcggttgtgaccccaggaaaccacagtgactttgactctggttcagctgacatgctcgagtctagccacaaattaccagaaagcagctgaggaaagtttagaatttctcctggcagagatggtccacgagtctggctccagggtgaaccccttcttcctagagcagcacggggccctttggaggctcaactccgccagccctcccactgccttccccctgccttccccaccctcacttcggttgagttttgccttcaaaatagcagactccaagccacctgaagggctgcagaacagcgttgttgacagcttcaagtcgccttgtggcttctctgagctgctgctgtgctttggaaacgaaattccaggctctccctctttctgtgtgtgggaaacaccggagagagtttggggagggagacaaaagggcccattgaaaacccagacaggcttgaactgtaagtcacaccggagagagggttgctgaggggaccctagagggaggcagtcccggagcacagctttgcttctttggctacttcctcgctttggaggttgctttcttctcaaggtggaccacctgctagaacagggcagcactgctgttcactggccagcttggagagaagactgcccatgtgattctaagtcaggcccttgtgactgaaccaccatgaggctggactgtggggactcgggtatcccagaggcagagcacaccaggtctgggaggggggccactcagacggcaacattgtcattcaatatctattgaacacctactgtcttaatccatgtttgttgctaccacagaatatgtgagactgggttatttataaacaatggaaatgtatttctcaaagttctggaggctgggacatccaagatcaaggcaccagcagattcagtgtctgtctggtgagagcccagagtctgcttccaaggtggcaccttgttgctgcaccgttacatggcagaagggcaagagagagtgagaagggaccaaattcgcccttttataaaaaaacccattcttgagaaggacattagtccattcaagagggcagaaccctgctcttaaaattggtaactaaatttcaacatgagttttgagggggacaaacattcaaaccatagcaccgcctgtgtgttaaacacccacttaggtgctggggctgtaaaaagtaaatctaggcgtggccctggcacaggagggactccatttcatagagagaaaagaacacagacccttttgttttagggtgcttgctgccaacagctctggagagacaggctgaagcaaaaacaccaaacatggagaagttatgacagttccccaaagtagtgacgaaggcacatctcaggcttgggaagtgtcctcggtgggtgccaggcctgcctttcccagcctcttctcggtgaagagatctctggctaagttctttaccttctctgagatttggaacatactgctgtttcacctaccaaagcaacttgcaccttttcttttccttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcaccttttctattgtattaaatatttcagtttctccattgtatggaggcttccagcaattagtttacaagccaacttatttactattcagtaactttttttgatattgagattgttcctaattttgatcattttaaacaaaggtgtgaaaacaggccaaatcttttcattcactcatgactatttcacaaagatagattcgtagaataagtattttcaaattccctttcagaaaagtagtacaatttaacactcacaagcagtgaatgtgaagccaattctccatacctttgccagcaagggtggccccaagaaccacacacagtaccccagctaagggcaaaggtagcttttatcctggccatagcacactgctgatggtcaacaagacaccaagtcctgctcacagatgctaaacagagctttcttttttcttttcttttttttttcttttttttttttttttttgagatggagtcttgctctgttgcccaggctggagtgcagtggctcgatcttggctcactgcaagctccgcctcccgggttcacgccattctcctgcctcagcctcccgagtagctgggactacaggcgcccgccaccatgcctgggtaattttctttttttttgtatttttagtagagacggggtttcaccatgttagccaggatggtcttgatctcctgacgtcgtgatccgcccaccttggcctcccaaagtgctgggattacaggcgtgagccaccgcgcccggccacaagaactttcacagtttggtgattgaaacccacatataggaattcatattcatttcattaaatttaaccttggctgtgtgtggtgggtcacttgtaatctcagcactttgggaggctgaggcaggagaatcacttgaacccaggagttcagaccagcctgggcaacagagggagactctgtttctacagaaaaaaatttttatatcagccagccatagagcatgcctgtgatcccagctacttgggatgctgaggtgggaggattgcttgggcctgggaggtcgagtctgcagtgaactgtgttcttgccactgtactgcagcttgggtgacagagcaagaccccatctcaaaaaatatatatatatatatcttctgattcagctcattttctgtgccttttgagatcttcttggacttttattctttcacccagtgtatttaatattactctctcccagctgttttatctgaaaactttatcaacctgtgctttatattttcattcaattcatttataaaaatgtcacatgagaaagggtcaagagtagagccctgggacatattgctgcctcctcattgacattgactgaggcagccgcaaatataccaaattgtattattgcttagtacatggctttatcaagagggatatcctattctggaccttgtgggctggtttagagagtgaggactcatcactggggctatgggagacataaggatcagcagagacagaggcaaagctggatttaagaagtcacagcaggcctctcccctagtatgagccttgctttgaacatatctgggaagggcttccttttagtcttgaaaatgtttacaagcctctgctcagcatctacctagccttcagacctcgcgttctcaggcctgtggtgctgtctcctctctgcttcagtatggtcttctctgtccagcttctgcatgaggccatctggggccaagggtcacaggttttagaagttcccctctccccgctccatgccataggcacctgcaatcgcacatcctggataaaacttcagccggccttctctttatgtgcctggcgcctctcttttctctgggtttttggaagtctgcctgcccagcccctcagctggggccttccccacttctgccccgccccactgggtcctcccagggtaggaggcaatctctgactgtcttccgaggctctgttgcttctccttcatcaccaaatgccaggaatttgtcagatgctgtttgtaactcaaaagaaagaaagaaaaagaaaaagatacaggaaggaaggaaggcagaaaaagagaaagaaagaatgcgtgcagcagatgttgggaaagttaatttcttcattattttgcatccatcccagttcggatctcagcatggggtagggaatcctctgttgtccccatctgtcgaggcaacagtgagtcccatcatggagtcccttcttttcctctctcctcccagagtgccccttcctcatcaaggtgcttctacccttaggagtgtacatttcacctataaccactgcctattttttcctagtgatatgttatgctattgatttttaattatataaactatatgcaaatgcagcctccttgtaaaaaaattaaaatattatagatataacccagcacttcttctcccagttcctttccacactcccagaggtaatcatgataatcagtttgctaggtgtccttccagaacttttagcttctttctttggcttgtatatggccaccttctcactgcatcctcccgtggcctaccctctgcatgcatctggatcctaattccctcttcttataaagacacccattgtactggagtagtcatactggatgacagccatattgcattaatctcattttaacttaattacctctttaaagaccctatctccaaatacagtcaccttctgtgtactgggggttaggacttcaacatgaatttttggggggacacaattcacatttcagggcagagggaggaggctcaactgccagtgagtgggaggccaagcccatgcctgtccctcctggaagtgtgccctgattgcaggtagggtcaggccccaaagccaagaaactgtctccaaactgattggacaagtagctgactagttctcttctcccccaaatcccaaggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggagtaagcgctgcactgtggagaccctgctgagctgggggttaggggaaggaaatgtgtgtgtgtgtgtgtgtgtgtgtgtgtgtgtgtgtgtgtgtgtgtgtctgtgcgtgtgtgtgtgtgtgtgtctgtgcatgcacatgcgtgtgtgcacgccaggtgtagggagttcttttctgattaactgatagagcaggaccctttaaatagaaatatccagggccaaaaccaacatacatcaggcacacaatgacactactatgtctggcttacatttggggggttgccaggtttggaaaaattaatttatatgggattgaacaagcctcttgcctttaagaaatttacactttgtgaagaaatacacataactaaccagagatcatgggctgtaatagaggtaaaatatttcacaggaagggaaaagtatcacagaaaaagtaatatctgagaataagaaggatttcagcaggtggagagaatagcaaagatttggagatctaagcaggcacaggggacttgaggaggatgcatacaagtcgtgtgtgtgtgtgtgtgtgtgtgtgtgtgtctgtgtgtgtgtgtgtgtgtgtctgtgtgtagtaggatgaggggaagaagtgtatgggaggggcttgttttatctcagaaaacatcgttgtctgaagagaaagaagaaaggccaccacacaagaaatcctccaccttctcttcctgacaccttcatactcactggcatctgctccatcctgtctcctgctatcctgtttctgggggaagaaaggctgtttttcccatccttatccttcttcagagaccttccagtgcctgaatccctctgtgtggagccctcagccattcatttctcttttcttctctttgcattgcagggtgtgatggtgggaatgggccagaaagacagctatgtgggggatgaggctcagagcaagcgagggatcctaactctcaaataccccattgaacacggcatcatcaccaactgggatgacatggagaaggtatctgtagacttccccttaatgagcctgctttaatgatcacccatcatcatgaccctcgtattcataggccactgtgctctgtcaactctccctgtaaaatgcttctcacttctgtctttcctttcttttcagccccacgaccatttctccaacctaggctgccaacatctctccctggactattgcaatggcttcctggctgatttcttggtctcttgccctcattcaccgaattaattctctacactgctgcaaaactgatctttctaaacacaggtcagctcatgtcactcacctcctcagaaatcttcagtagctcttcattaaccaacagggggttcctaactccccgtcttggcattggaggacctttccctgcctgatccccgcgatcatcttttcctgaaatatttactcaggccagtgctcaccccttctttaaaatgctggtgctggctcaagagaggcaaacagccatctctctcattcttatcttccctgtcaagacttcacataggtggactgatgctagactatgatgatgagtctccagtgaaagtttctaagtagaactctctcagggtttctagaagcatttttgtttaagaaaatattgtggggagagcgggatttttaaatggtggagctcatggtaaacaaaattatgtgtgcaaaatgttaatagagcctttctaatattcttgtgattaactctggtgacagttggctgagtgttcttgtttctgcaacgcctgtctttggaaatgtgatagggggcttattgagcagactgcaactggaaatgaggaatgttgacttgaagtctgtaattcacttatacttttctctaaatcctagactgagtcactcaatgtgagataagtactgcacataaaatgcaatggatttcacgttatacagtggagtgggtaagagcagagacattagaggcaatggcaggaaatccaggtgcaaatcccaccctataagtcttagttttcccatttgtaaagtgaagataaaaaacactttgtgcattaggttgctttggagattgaattagctaaatgcttagtataatcccaaggcatggaacatacttatgtgctcaataagtgacacatatgattcatatatatgtaacagtatctaatttaaaaacataataggccgggcgtggtggcttacgcctgtaatcccagcactttgggagaccgaggcgggtggatcacaaaatcaggagcttgagaccaacctggccaacatgatgaaaccccgtctctactaaaaatacaaaaattagctggacatggtggcgggtgcctgtaatcccagctactcgggaggctgcggcaggagaatcgcttgaacccgggaggcagaggttgcagtgagccgagattgtgccactgcactccactgtgggtgacagagtgagactccgtctcaaaaaaaaaaaaaaaaaacaaaaaaaaaaaccacataatagaggccagtggctcatgcctgtaatcccaacactttgggaagccaaggcaggaggatagcttgaggccagcctgggcaacatggtgataccctatctctatgaaataaaaatgtaaaaattcactgggcatggtaacacatgactgcggtctcagctattcaggaggctgaggcatgagaatcacttgagcccaggtggtggaggctgcagtgagctgtgttcacgccactgcactccagcctgggtgatagagtgagaccatgtctcaaaaaaaaaaaaaaaaaaaaaaagaaaggaaggaaggaagaaaacataatagacaaataatagacaaactattttattcacagtagtgacaacatgtgaactctttaaagaaacccttaaaaataaattatgtgccttaaggccgggcacagtggctcatacctgtaatcccagcactttgggaggctgaggcaggtggatcacttgagtccagcctggccaaccaacatggtgaaatcctgtctctactaaacaataattagctggatgtggtggttagcacctgtcgtcccagctactccagaggctgaggcaggagaatcacttaaacttgggaggtggaggtttcagtgagccaagatcgcatcactgcactccagcctgggcaacagagtgagaccctatatatatttttttttaaaaatgtatatatgtataaatataaaatcatttcattatataatcatttcattatatatctataaatcattgtgtgtgtgtgtgtgtgtgtgtgtgtgtatatatatatatatatatatatatataatcttgtgtgccttaaaagaaaaaccaaattgggtaaaagtgtcaaatgtcctcaaattaatttataggctcattgcattccaataaaaattatgtgacataattctaaagtatgtttgcagaaataaataagcaacaattatgagaacaaaatgaatttttttaattatgaaggaagacataatgtaataaaatacaatataaattataaagttaaaacaatttgataccagcaaaaaggtaaagaggaaatatataataaatgaaacttccagcatcagaaaggaggaaaggactagtcaataaattatttctgggacaactgattagttatttttggagctagagaatcttggtttatagccctaagctcataccatttcaccaaacacatgtcaattaaatataaaagttaaatgtaaacatttaaattaccaaaaatataatacagttaatgtgagcatttaatcaaatttctggtaagagtggtcatagagaaaaagaatgacaaatttgacttcttaaaaaatcgtaacttttaatatctcaaaaataaccaaatttaaaagccaaataacaaattgcaaaacaaaagggcaatgagggattaatatgaacagttaatgcaaattgacaattaaaaatatgaagtgtcccccagacaaataaaaaacagttaattagctgaacagaaattatgaaaagttgcaaatgtgaaaaaatttaaactcatttgaaacaaaaaaattgaagtaaaataactaggtatgatttttacctatcaaattatttcatattttaagagtgagagcactgaattcagttaagaatggggtaaaacagccacttttttattctgaagtaaagattggtttagcctatttgttaataacagaaatcagaaagtcttccaattgctatgttctttagcccagtcattccacttttagaatcttcttctttggaaaacatcctgaatacaaaaaataaattgcaatatgcacaaagataactatcataggattatttataaccaaaaatcaaagacaccatgaatagtaatgtgattaaatatatgatagtatatgataaaatgttatataagcattttcaaaagtttaagtttatcaaaaataaatatttattatgaaaagtaaaataatttgttataaaaacaaatttgaacatagtataataatataataaataaaagaatatgaaataaataatgatagtaataaatttaaaaatacataaagacaaaggttaggaaaaagaaaaaagccaaaatgttaactgtttgttgttaggtgatggacataggggagatttttattccattaaaaaaaattttggccgggcgcggtggctcacgcctgtaatcccagcactttgggaggcggaggcgggtggatcacgaggtcaggagattgagaccatcctggctaacacggtgaaaccacatctctactaaaaatacaaaaaattagccaggtgtggtggtgggcacccgtagtcccagctactcgggaggctgacgcaggagaatgccgtgaacccgggaggcggagcttgcagtgagccgagatggcgccactgtactccagcctgggcgacagagcaagactccatctcaaaataaaaaataataaataaataaataaataaataaatacatacataaaaattttgagctaggatcttcctctgtcgcccaggccggagtgcagtggtgcagtcataactcactgtggtcttggcctcctgggctcaaggaatcctcttgcctctgtctccggtgtagctgggaacagaggtgcacaccacatccagttgattttttaattttttgtagagacagggtctcactttgttacccaggctggtctccaacccctgggctcaagcaatctgcctgtctcagctccccaaagtgctgggattacaggcataagtcaccacactcgaccttaaaaatatttttctaactttaaaaattatcaacatctttaacttttaaggtataaaaactccaaaaaataaaccaaaatcaagtgcagatgcttgagcccaacacccaaggattctggttcagtgggtcagatgatcccaggtgactctgagacagggccttgaggaagcacattttaagtagcatggggtcccctccttaagaccagttgctgtccttcaggctcctgtgcaatgctcacagtccagggcctctgcctgtgccattccctctgcctcggatgccttttgcagcagcctctggagaccttcttttgccctcaaggcccatttaaatccctcagataatgaattactcctacctcttctttcacttaaaatgtggcttgtgtttttctttttgtttgttttggtcttttttaaacgtctctctcccctctggactttgcaactgagaatagggtgccatgtctgattcatatctgccctcatcacacttaccaccgtcttagcacaaacctggcggtccataaatacatgggtccaatggcatcaaatgaccctgtgcctcacctctgaggaaaccaaagccccatgtccctgctacactttgcccaatccctctgaaagactcctttttggtcgtacttgatcactgaagaaggaactggacacaggaagaaattaacttcctctaaaacagtggttcttttttatttttgagacagggttttgctctgttgcccaggctggagtgcagtgccatgatcacagctcactgcagccttgacctcctgggctcaagcgatcctcctgccccagcctcctgagtagctgagattacaggcaggcgctaccatgcctggctaattttttatctttttgtagagacaggcccacagtgtgttgcccaggctaagcggtggttcttaaccaggatgattttgcttcccaaaggacatttggcaatgtctgcagacattttttattgtcacaactggaaaactgctgctagcatccagtgggtggagaccagggatactggtcggccctccacaacaaagaattatccaacctaaaatgtcatagagctgcgattgagaaaccctgctttaaagcaccagcctggccaataatagccagtgaaaattgagcccaagtgcctctgtcagattctcagcaggagatagtgtacactcagctgcggttttgaaattgtttgacagtgtatactcagctggggttttacaactggttaaatgaatgtcctacagaaatgtgcatagggttaaggcaactacaaagggatgtcgaggcacccaagagccagcaacagagggagctctcacacccctaaacatgaaggggtcaggtgacgagggcagtgtcattggagcttagtgagagcttgagctctgaaagaggggctgcccaacaggaactgtgctcatggagggccacgccattgtcaggaaatagaccctgacttcttttgccctcctactttccagcctcttgcaggaatcttctatcagccaaatatagccagaagccagaaagcaatgaacacttgagtgatacaatgtgccttgcatcactcagtgcacaaaggcaggggagagactgtaggagagtgaagaggagggaaggtcaaatggaaataatgaacacatagaaaatactggttccaggtctgagtcctacctggggccctgttgagaaggagtataccctttaaatgtcaatcagaaatttccagggctgaccattctcctctccagatccatcccatcctgtgtaacatggtgccacactctcccagcatgggaatgtcaatgagaattttccagccattgggagtctgccaggctcatatggcttttgtctccaccagatctggcaccactccttctacaatgagctgcgtgtagcacctgaagagcaccccaccctgctcacagaggctcccctaaatcccaaggccaacagggaaaagatgacccaggtaagaagccaggaagacttgaacactggcataagaatgcaacatggatgcttggccagatactttctccccttcaaacatcagtgcaacagaactctctgaggacctgctatgtctgtggtccatgccaggccctgggggagtgggtgtggaataatgaactatcaaactggcatagttcctgcccttaatgagattacaaaccattctacaggccaagaagtgctgtgatttttgccaaataatcttttattcttcattgtcctttaagatcatgtttgaaaccttcaatgtccctgccatgtacgtcgccattcaagctgtgctctccctctatgcctctggccgcacgacaggtgagtaatcctgtaatccattccttttctgacttcaggggaggtagggaaaagctggggtctggcagaggctcctgctcagaagaatcaaatggacagctgaagtccaggcaaaatctttcttagggataataggtgagaatgcccatgtggaatgccagatgtgagcctagctggtatagttggaaaaaacatccagcaagaactgtttccctcacagtaataattccaggagcttctacacatacacacattccaacaatactggaatgtttctgcttcatgaagcagaaagagtagaacctgtggtggtggaaatgtaagtgcagttacacattgcttaatgacagggatacgttccgagaaatgtgtgtcattaggtgactttgtcactgtgggaacatcagagagtgtacttgcacaaacctagatgctgtagcctactacatgccccggctgtatggcgtggcctattgcttccaggctacagacagtatagcatttaactataattaatactgtagggaactgtaacagaatggttaggtatttgtatagctaaacatattgaaacatagaaaagttacagtgaaaatataatatcaaagataaaaaatggtacacctgtgtagggcacttacatgaatggagcttgcaagactagaagttgctctgggtgggttagtgagtgagtagtgagaaaatgtgaagacctaaaatgttactgtgtactactgtagactataaacactgtacacatcggctgtactacatttataaaaatattattcttggccaggcacagtggctcacacctgaaatcccagcactttgtgaggctgaggtgggcggatcacctgaggtcaggagttccagaccagcctggccaacacggtgaaaccccgtctctactaaaaatacaaaaattagttggacgtggtgtcaggcacctgtaatcccagctacttgggaggctgaggcagaagagtcacttgaacctgggaggcagaggttgcagtgagccaagatcacgccactgccctccagcctgtgtgacagagctgagctccgtctcaaaaaatatgtatatatatatattattctttcttcaataataaattaaccttagcttactgtaatgttttttaccttataaactttttaatttttaaagccatttttactttttttgtagtgacagtaatagaaaaacatcttttttcgacttttttttttttttttttttgagacggagccttgctctgtcaccaggctggagtgcagtagcgtgatctcggctcattgcaacctctgtctcccacgttcaaacgattctcctgcctcagcctcccatgacttttttttttttttttttttgagatgaagtctcactctgtcacccaggctggagtgcagtagtgcgatctcagctcactgcaacctccgcctcctaggttcaagtgattctcatgcctcaaactcccaagtagctgggactacaggagcgtgccaccatgcctggcttatttttgtctttatttagtagagaaaaaaaaggagtacaccctttaaatgtcgatcagaaatttccagggctgaccattctcctctccagatccatctcatgttggccaggctggtctcgaactcctgatctcaagtgatctgcccacctcagcctcccaaagtactgggattacaggtgtgatcatcacccccagccaaaaatattttcatttatatcctttattctacaagcttttttctattaaatttattttattttattttttacttttagagcttttttgataaaaactaaaatatacacacattagcctcggcctacacaggttcaggatcatcaataccattgtatttcatctccacatcttggcccactggaaggtcttcagggttaataacatgcatggagctgtcatctcctatgataacaatacctccttctggaatatctccggaaggacctgcctaaggctgttttacagtcaactttttatttaataagtagaaggagtacactttaaaataatgattaaaaacatagtataagagctgggtgcagtggcttatgcctgtaatcccagcactttgggaggctgaggtgggtggatctctttgagctcaggagttcaagaccagcctgggcaacatggctacaacctatctctacaaaaaatacaaaaagttagccgggcattggtagtcacgcctgtagtcccagctactcggtaggctgaagctggagaattgctggagcccaggaggcagaggctgcagtgagctgagatctcaccactgcactccagcctgggtgacactcaaaaaaaaaataaaaaaataaaagacagtataagaaatacataagccagtactagtaccatagttgtttattatcattttcaagtatgttgtacataatgtatgtgctgtacttttatacagctggcagcacagtaggtttgtttacaccagcatcaccacaaacacgtgaataaagcgttgccctatgacgtgatgtcagctatgatgtcactaggcaataagaatttttcagcttccttataatattatggcaccaccattgtgtatgtggtccgaagttgaccaaaatgtcattatgtggacatgactatatgtggccttggtatagaagtgtgctcagcgtaacagaggaaatctcaaaataaaatggtctttaataggaacttgacagcttccataaacatttgtttaaacgttcattaatcatttattcactgatttatccattcattcatccatcatatattttccattactccctacaatgtgccaaacatggtaccaggccatgggcacacactgacaaataagacagactttgtcattatggagctaacagtttagtgggagatagacaaaagtaaaagataatttcactgcatgtgataaggacaatgatggagaaatgcatggcatatacagtgtcgtatcctgtgctttgcactttggtttttgtttttgttttcattttgagatgtagtttcgctctgttgccaagactggaatgcaatgatgtgatctcagcacaccacaacctccacctcccgggttcaagcgattctcctgcctcagtctcccgaatagctggaattacatgcacctgcctctgcacccggctaatttttgtatttttagtagcaatggggtttcaccatgttggccagctggtcttgaactcctgacctcaagtgatctgccccccttggcctcccaaagtgctggcattacaggcatgagccaccgcgcccaaccttgcacttcgttgcaaacatcatgtttaatagccacgtggtagtcgttgtatgatggtttcattatgtatttattttaccatttctctattgctggagctttaggttgcctctcatttttattatacaatatgccatgattcaggtccttacacaagagtaagttgctgctttctggacatttattttgcatctggcccttactgaaccatctaactaggtctaatggtttcttaattgattctgttgggtcttctgtataaaaccacattatctgcaaataatgacaattttggtagtcacacctcctatttctattttctgtttcactgcaattggctagaacatcctggacaatattaaaaaatagtggtgatattgtaatgttttctcatccgttatgatgtggctgtcagattaagaaatacgaggctggacgcagtggcacatgcctgtaatcccagcactttgggaggccgaggcaggtggattgcctgaggtcaggagttcaagaccagcctggccaacatagtgaaaccccacatctactaaaaatacaaaaaattggctgggcgtggtggcaggcacctgtaatcccagctactcaggaggctgaggcaggagaatcacttgaacgtaggagacaggggtttcagtgagccgagatcatgccattgcactccagcctgggcaacaagagcaaaactctgtctccaaaaaaaaaaaaaaaagaatatgcaatgtagacttaatgcaaattgacaagtatgcattaccagtaatgtgtttcaaggaatacaaaaaaaggacacattttacttgccctccagaggcctacagtctcactggggggaaaaaagtgacatacataaaaaataaaaaatatgattgatgattcttgtgatgggtgaatattcttaactggtaaaggaaaatatggtagtcagagctcattggtaacagtcctagaaagagactgatgaaaggcaagaatgagaattttataagcctgatcctctctgtccacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacaggtatccagccccttttctgattctgactggagctcagaaccaatctggtttaggacaagaagttctcaggaccaatgagaattctgtgactctgtgtctttaaactctcctgagatagactgagaggccttaagctggggctaggcctctggataagaccagatagtcatggaagcagtccctccttccccagagaccagctgcctctgtccacgtccacaccaggactagggctagtttccacaggctgaatggtagtgaagatctgctgatgcatttcattacctaggggcacctttggtttgaggacaaattgaataagtgaggcccgaatttctaaggggaaggtgtcatgtggcccacctgggcaatcggcattttttaggtgggagcctctctaggttctgtaagatcaaacatctgagtctagaccagaaatatgtcctgcaaagcccccaggaaggcctaaggctttgtcagaaatctcatgcaaagtcctgcatgggaatcaagacttgagactccctctttagaaagaggagtagaagaattaagattgaatggagtgacgcttgaccctcttcgcggcaagtctatcatcatcctatgactgaacctaaagtagacgtgaggccaggcatggtggctcacgcctgtaatcccagtactttgggaggccaagcaggcagatcacttgaggtcaggagttctagaccagcctggccaacatggtgaaatcctgtctctactgaaaacacaaaaattagccgagcttagtggcgcacgcctgtaattccagctacttgggaggctgaggcaggagaattgcttgaactcaggaggtagaggttgcagtgagccaagatagcaccactgcacttcagtctgggtgacagagtgagactctgtctcaaaaaaaaaaaaaaaaaaagaataaagtagatgtgagaaggaggttttcatggagatcaaaatgggacaaccaaactatcagagctcagtattcaccttctgtcatttctgctccttccagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggtgaggtgctgcccacagtccctgccaatctcaggaggggagggtggaggagtgggtgaggtatggagagagaaacaccaggagtcatggccactttgttaattacatacacgtacctcacattttcctaggaagggccaaaaatgtattttaaaaaaaattagggaaaatctcattttaaataaaagggaaaggaaatcaagatacaggaaaagcagaacaggaaatataacatgaaacttaagaatgaggttaaaacacagaaagtttgtaggcagcaatgtagcaaggtcaggttgtagtttagcaagattcttctatctacagtgtggaatcatattgcatggataaaagaccggaggcttggccaggcgcggtggctcacgcctgtaatcccagcactttgggaggctgaggcaggcagatcacttgagcctgtgagtttgagaccagactgggcaacatagcgaaaccccatctctatgaaaaatacaaaatttagcagggcatggtggtgcatgcccatggtcccagatactcaggaggctgaggtgggagaatcgcttgagccgcagagatcaaggctgcagtgagccgtgattgtgtcactgcactccagcctgggcaacagggtgagattctgtctcaaaaaaaaaaaaaaaaaagagtagaggtaagtagaccaggcagatggcaagagccagtttggcgtgcaggaccttttgctctagaagactgtgatgccaggctacagtagctggatgtcaacctgcaggcaatgggtgactgtcagatgacatgacgagtatatccatacaatggaatcttatttggcaataaaagggaatgaagtattgatccatgctgtgaccttgaaaacattatactaagtgaaaggagccacacacagaagaccatatggtgtatgattccattgacaagaaacatccagaataggcaaacctctaaagacagaaagtggattcactgttacctagggctggggcagggatggaggggaaaatggggagtgaccgctattaggtatgggggtctcttttgaaggtatttaaaatgttctaaaattagattttggtgatgtttgcttctgtggatatactgaaaatgactgaattatatctcaaaaagttatgaaaaaagaaagatgatataacaaaagtgttcctttagaaatatgcttcaggcaacagtgtaaaagatcaggccgggtgtaatacctcacgcctgtaatcccagcactttgggaggccgagatgagtggatcacaaggtcaggagatggagaccatcctggtcaacatggtgaaaccccatctctactaaaaatacaaaatttagctgggcgtggtggcatgtgcctgtaatcccagctactcgggaggctgagacatgagaatcacttgaaccagggatcagagtttgcagtgagctgagatcgcgccactgcactccagcctggtgacagagcagactccatctcagaaaaaaaaaaaaaagatcaatcagaactggggacaataaaggaaaggccatgacaaggaagggggtctgatcttataatccttctgggagatattaaggttctgaactagggtagttgcaacaatcgaagaagggtcatttgaggagctggaggtgtgcatatttaggaagtgatgcctgttgaccagacactgtgatctccactaggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaaggtgggtcttgcctcagttgtctccatcctgttctttgtataaagtcttgcctacctgggagttcctcggaggcagactgccagacctgataacttgcaggtctcctgggttcaatatcatcctggactggagccaattttatcctacagaattatgttccttgggcattgatgggctgaagacccacttagcatggatctcaaacataatcccaggactgtcacatgagaagaggctgaaagaatttgggatgatgagaatattatccaggtgtaatggctcatacctgtaatcccagcattttggaaagccaaggtgggaggatcacttgagcccaggagttgaaggccacaatgagctctaactgtgccactgcactccagcctgtctctaaatataaattcagatagatcctgtctctaaaaataaataaataaataaataaatagaatattgagagggttaagaaggaaatcaggagatgggaaatagaaggaaagaaaagaaggaggtcacactatggtatctttaaactttattgctctgaaggagggtaaaagttccaaagagtggatgtttggtcatagggccagctctgcttcaaactcaacagggacattccttgattcctgaacatctctgatctactgtcccttcttggccatgcccttccccatactgcctcccaacagggcctctcgcctcctgggcatctgcaggatgggagcttctcttctgcctctggtctccaagcagtcacacagacatttttagctccttctaggaactttgctgctaacagctttagagaaagagttgggaatagaaatatcacattggttgaaagttacaaagtctcacaataaagctggtctctggggagtaggcctgatgtaaggaaatgtgttctcagtcaatattctaagaaccttcatgaaggaaggctgccccgggccttccccctgcctaacagatggtgttcatcacagagaaatggagaaaaccagcaggaaactggtgagaacctgtgggctcttctcacccagagccacaggaatggtgcattactgaggcctgtcctgtggagagctgtgccaggcctggggcaggggctttttaccaggactgtgtgtcagtataccacgcctagcctcactcccagattctggtccaacaagtctgaattgctcccccatcacctacactgataaacaaccaccagtgatctgatgcatttcccaattcatgagccacagctctgacttaaacagtacgtgccagccttcatggagtttaggatctaattagtaaacattatcaataccaggacaatctaaataaaagcggaagggaaaggacactctaagcagaggaaatagaaggagcaaatgtgtccaggcaggtgtgtgcttatatgagcacctatccaaattggacagcaggatttgttataggggaactgggggagatgaggcaagtctcaaggacacagaagaacagatttggggtgggggtagggcttatatttaggaccaccaacctaagagaagccagagttttctcatgagaagtgtccaacaataaaatttgttaccttgctagtggctgtgcattcccagtccttgaaataatctgttcaaggagcatttgtgtgacttttgtctgcctggataataaaataacttctaaagatccttcttattctacaattccatgatctctgtgatttagggactatgtaaagagattctacggcaacaaaaaaaatcaatttattatctggtttgctctagcactgaattcttagacccttccaaaactggaaaactagttgaagaatcatagtccttctggatcccctttgaagtagagttcaaagttgtttgacctgacaatcaatttctaaaagctaagcccaggattcctagtggaaagcatgaacaatgtagatataaatttgaggacttctgagatataattggctgatgacagatagctcaaaacagggtttgggtagactggtttatactcaggcatggaggaagcccagcccaacctgcccatgcttccaaactccaggcaagaacagaacaaggttccccttatagatatttgtattggtcagctattgccaagtaacaaacaaccgtggaatctcaggggcacctaacaatgagcatttattactcgtgcatctgcgcatcacctggaagttagctgatcaaggtcaggcttggctaagtaagtggctctgaattaactgcaggtccagccagctcaggtcaagtccatatttctcattaatgggcccaggctgaagggctagctgcttcccaggggcagctcttctcatgcacatggcagagcaagagaacatgcccaagtacacaagcatatttcaagcccctgtttgtgttatgtctgctaatatcccattggtcaaagcaaacacaatgcccagccttacagggagcagtgcactcttcccatggaaggaataagggaagaggggggaagtgaaggttttgagcaataatctaatctatcacaatgtttctcctgttcttttctgaccatggggctccccttttctgggataagtagatttttggaccaccttgcttattcccttggggactgatcatgattcaccacatttgttctttgcagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttacttctctgtgtggggctcttttttcctgggctatgtctcatacacagtgctaaggacttttcacacattacttttaatccatgcaataatgctgtaaggtaggtgctatcattatacccatattacagatgaggaaattgaggctcagagaagtcaaggacttgcgaagatcacacagattccagattaaaattcaagtatctgactgcaaagctagtgctccttctactgtgtcatcttgttttcttttccttgaatataagtaagaatgaggctagatgactcttgggatgggggtagaaacacagactttcagtgatgtaagtccttgtgctctagggcagttcactagggaatatgaacgcagtcgtgacataggcttatgggatgtgacatgaagagttcacatacaatgttactgtcactcacgtgaaggagggtcaccgtgggcttaagatctctatgatctctatgaggttgtcattgaggattaggctgtattttttttttgtttttttttgagacagagtctcactcttgcccaggttgtggtgcagtggtacgatcttggctcactgcaacctctgcctcctgggttcaagtgattctcctgcctcagcctcctgagtagctgggattacaggcatgcgccaccacgcctggctaatttttgtatttttagtagagacggggtttcaccatgttggccagtctggtcttgaactcctgacctcaggtgatctgcccaccttggcctcccaaagtgctgggattacaagtgtgagccaccgcgcctggccaggttgtattttgccccaaaattaattaagaaaggagtagcatcgttaggaaggacattttctctccctccctctcctgttcctcctcctcctcctcctcctcctcctcctcccctctttatcaatttcctccctacacactaggttaattttgtttaattttacaagtatttactgaatttttggcatctggaattgccgggtaaggccacaagggatttatgtttccaacaaagatgattcctgcccattagggtctcactgcatacaggcagagatagacacatgcatacaagacagtgacacgaagtgaaacaagcgcctaaaagtactatgagaaaataagggatgataataatagctaacatgtattcaggccaggttaagagttttgcatggatttcctcaattaatcctcaccacaaccctatgaggcaggtactagcatcatttcccattttatagctagtttactggttactaggtcacccagctagttcaccttagaactagatcctcacattgggctggtgcacctttcacctccccacctagcaaagtcccagccttcgtgcccccatcagatcccacctggtccatgaagcttcccagacatacccatttggagacagtggagtccagtggttaagcgcagacacttcaatgccagacattcctttcaccctcccagcacttgatctctgtgggtggggtgggatggaggagcggctttcataagcccttaggggatttctgtgtgaggaccagaagcagaccctgaaatgaggattccctgcaaacgacttattaaagaagtgctctgaggacagctggtaagcagagtgcgggggaggggggcgcagaagaggaaaggggaggaaatctgtcaagggggtaattgcagataatgtcctggagagggcagcttcagcctggccccgcccactgggagctctggagtctaaggttagcctggtgaaggacagggagccaggctttcacagtcccacctgccagtggttggtgagggcgctccctgggaggactgaagtcctaggctttccacctgtatcggcaaaggcctcctccaaagaagagctgcaggctctggttgctggaagagaaggcacaggaggaggcgggagcgatctgagatgtagggcaccgacactgcgctatagaggggcatccggacctcc

SEQ ID NO: 11972 - DNA, 8133 bp, Human
tattttttagtagagatggggattatccatgttggtaaggctggtcttgaactcccgacctcaggtgatccacctgtcttggcctcccaaagtggccgggcagggctgaattcgccccctcaccagctactgccaaccacggatgaatggcttctgcctgcctcctgccctccagatcttaccagggcatttcactgggaaatatggcaacagcccttgccactcaggggacagcatggcaggggctgggaacgaatgttgttgccaaacgacaagacccagctgggcccagtggctcacacttgtgatcccagtggtctgagaggctgaggcaggaggatcacttgaagccaggagtttgagagcagcctgggcaacacagtgagactctacaaaacaaaacaaaaaaaattagccaggcatggtggctggtgccaataagcccagctactggggaggctgaggctaaggctgaggcagtgagccatgatcatgccaccgcagtccagcctggtgacaaatgagaccctgcctcaaaaaaaaaaaaaaaaaaaaaaaagaggaaggtgagcgcagtggctcatgtctgtaaatccagacactttgggaggctgaggtggaggttcgagaccagcctgggcaacatagcaaaaccatgtctttacacaaaataaaaaatgagtcaggtgtggtggcacatgccattggtgccagctacgtgagaggctgaggtgggaagattgcttgagcctgggaggtccgaagctgcagggagccgtaactcaggcatcacactccaacctggctgacagaatgggaccctgtctccaaaaccaaaagattccagctcgaaaaataattgtggggtggcggcaaaagctcctgactggccttgactttagagtgaatcaatgaattaattaagggcctgcctgttagtgagtctcctctgaaatttagcccagaaatttcctaactcagcaagatgaagcaggaggtagaaggaactaagggggcaataagcaggaggaaggaatgtccccatgagggtgacatcttccctgagagccccaggacgaccagcaggaagccaggcggggggcaggcaggaggactccagaaagctcggcctgaggggaggcccgtgggggtggtggggagtggtgcggggaaggcagaggctgagcagcaggtgaggtcccctgggttttgggggccaagcctggggctcggggcgagcaagcatgagtggagaaggggctgctgtggttgggctggggtggactccccacctgcgtcgtccaaacattagtgcgagtgcacccacacaaacacatacacaatcacacacaacatgtgagcaatgggcaggactggtccggccccactcagtgctgtcaccattggccccacagctgcccacagccctagagctctgggcccagattcctgccagccccacctgtccaggccaaggtaagatgatggagcaagggggtgccagggcagcaaagccccccacgtgcccctttcccacagggcccaggctcctggcatcaggaggctgaacccaggccctggcccagactgtgtgcttccagcctcccctcctctcgacaccagaacacagcctggccccagcttctgggaaatatagaaaaaaatgggtgaatgatccagtgacagggtgtcttgttccacacaagacacagtgagcaggggttgggggaggggctcctggctgcgggaggcacaccacactcacccaaatggcatctgtactcaataccgcacccttccctgggggacacctggtcccaacctgagctgcctttctcaggaccccagccccagcccggcccagcccagccacaccctgccactcccttcagccagtgtggcttcaggtcaagaggctgggcagggtcaaggtggcaacgaggggagaagccgggacacagttctccctgatttaaacccgggcagcctggagtgcagctcatactccatgcccagaattcctgcctcgccactgtcctgctgccctccagacatgctggggccctgcatgctgctgctgctgctgctgctgggcctgaggctacagctctccctgggcatcatcccaggtaatgaggctccccgagctgcccctacacaacacacacacagggcaccccccagcccaggctgacctgatctttgctctccccctggccagttgaggaggagaacccggacttctggaaccgcgaggcagccgaggccctgggtgccgccaagaagctgcagcctgcacagacagccgccaagaacctcatcatcttcctgggcgatggtgagtgagccaggccttccagccctgcagccctcacagccccggcgcccggaccctcagtggttccaggagagccctggggcccaagcctcacacatttctgttccttcagggatgggggtgtctacggtgacagctgccaggatcctaaaagggcagaagaaggacaaactggggcctgagatacccctggccatggaccgcttcccatatgtggctctgtccaaggtaagtgctgggctaccttagagtcctccaagcacagaaggggaatcctggctatggagtgtggtaggagggagggaccctaaacagctggggctccagtaaggagttagaggcagttggaatcccagaggacagagatcagggtctgggtctccgtgtctgccccagagaagagctcagagtgtctctgtccccagacatacaatgtagacaaacatgtgccagacagtggagccacagccacggcctacctgtgcggggtcaagggcaacttccagaccattggcttgagtgcagccgcccgctttaaccagtgcaacacgacacgcggcaacgaggtcatctccgtgatgaatcgggccaagaaagcaggtgagctggggcccgctgctgggtcacggccaggtcacagacgttggtcacatatactgacctctgacacccttagggaagtcagtgggagtggtaaccaccacacgagtgcagcacgcctcgccagccggcacctacgcccacacggtgaaccgcaactggtactcggacgccgacgtgcctgcctcggcccgccaggaggggtgccaggacatcgctacgcagctcatctccaacatggacattgacgtgcgacccccaggccaagggctggggctgggcagagagtagcagggagggggcactagctcagacccaggcaaccaaaagccttatctgggccagcagggtctggaggtggggttgtgggcgtagaaggtgcagcccaggctgggccattcccacagccttggggaggggagtcaggggctgtgcatgaggagggggcacggggccagccagggccccaaatccacctgccccatcctctgttcccaggtgatcctaggtggaggccgaaagtacatgtttcccatgggaaccccagaccctgagtacccagatgactacagccaaggtgggaccaggctggacgggaagaatctggtgcaggaatggctggcgaagcgccaggtgatgggggctggcgggtgcagggggcacagcagggggagggcagaggtgtggggctcggggctgtgggctgaggcctggctctctccctccccacagggtgcccggtacgtgtggaaccgcactgagctcatgcaggcttccctggacccgtctgtgacccatctcatgggtaatgacccccttcctgccctggcatccctcagatggcctcagatggcaccttctgagcctgtgtgcacatccgccagcacccgcccacccccagcctgccagtcaccacaggaccccttgtcccacaggtctctttgagcctggagacatgaaatacgagatccaccgagactccacactggacccctccctgatggagatgacagaggctgccctgcgcctgctgagcaggaacccccgcggcttcttcctcttcgtggagggtgcgtggtggcccctggggagtgggggttgggggttggagcagggcaggctcagcatctcccccctctggccttcctgcaggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcggtaggcctggggagagtggcaggtgctgctgcagcaattaagtgggtgaaatctgagcctcagtctcctcctctgtcaaatgggagtaatgctggcaccagccctgtagggtctcctgaggactaagcccctgaccaggcaaaacgtggcggtgcctagcacgtgggagacactccacagctgtgttcagctcaaccacagggacccctctctctgcagggctggcccctggcaaggcccgggacaggaaggcctacacggtcctcctatacggaaacggtccaggctatgtgctcaaggacggcgcccggccggatgttaccgagagcgagagcggtgagtgccgcggggtggccccctgagggggaccagggtgccaaggatggggggctggcgggaaggggtcacctcctgtctgcctggaactgaatgaaccctcctaccggaactgaaccctccaaccagggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggtccgtggtccccgcgttgcttcctctgctggccgggaccctgctgctgctggagacggccactgctccctgagtgtcccgtccctggggctcctgcttccccatcccggagttctcctgctccccacctcctgtcgtcctgcctggcctccagcccgagtcgtcatccccggagtccctatacagaggtcctgccatggaaccttcccctccccgtgcgctctggggactgagcccatgacaccaaacctgccccttggctgctctcggactccctaccccaaccccagggactgcaggttgtgccctgtggctgcctgcaccccaggaaaggagggggctcaggccatccagccaccacctacagcccagtgggtaccaggcaggctcccttcctggggaaaagaagcacccagaccccgcgccccgctgatctttgcttcagtccttgaatcacctgtgggacttgaggactcgggatcttcaggacgcctggagaagggtggtttcctgccaccctgctggccaaggaggctcctggggtggggatcaccagggggattttgacacagccttcggctgccccccactaagctaattccacacccctgtacccccccagggggccctctgcctcatggcaaaggcttgccccaaatctcaacttctcagacgttccatacccccacatgccaatttcagcacccaactgagatccgaggagctcctgggaagccctgggtgcaggacactggtcgagagccaaaggtccctccccagacatctggacactgggcatagatttctcaagaaggaagactcccctgcctccccagggcctctgctctcctgggagacaaagcaataataaaaggaagtgtttgtaatcccagcactttgggaggccgaggtgggcggatcacgaggtcaggagatggagaccatcctggctaacacggtgaaaccccttatctatgcgcctgtagtcccagctacccaggaggctgaagcaggataatcgcttgaacccgggcggcggagattgcagtgagccgaggtcatgccactgcactgcagcctgggcgacagagcgagattctgcctcaaaaataaacaaataaattttaaaaataaataaataataaaaggaagtgttagacaatgtaatgccagtactacttcctaggaggaaaatcatgagtgcctgtgggcacagtgtctggaggggtggataacgcaggccaggaggggctgctgaggagcagatgattgagcaggagacctaaacagagtggggcttgagcaaggcagaacagcagtgccaaggccctggggcagcgccagcaggtgctctgggaggccaagggctggatcagagggtgggtgggtagaggggtaaatctgagggtcaagagggtgggtagtgttggggagtgtgaagtctgagtagagggatgtggttggaggtctttaaggagtgctgtgacccgccctgggtggaaaataagtattctggctgctgccagaagaagggtcttgtcttttgggtggatggtgggggtggtagagggtagcagggagaggtgagaactggggaaggaactgactccaggtgtttctgatctccgtccgaaagcattcgggagcacccatcccaacacagccatgcttggtgagtaccacacctgccccaaaagaacattgaaaagaattttttttatttgaggcagagcctcactctgttgcccaggctggagtgcaatgaccttgtctcggctcactgcaacctctgcctcccaggttcaagccattatcctgcctcaccctcccaagtagccaggggtcaacaagtgtgcaccaccatgcctggctagtttttgtatttttagtagagacggggtttcaccatattggccaggcaggtctccaactcctgacctcaggtgatccacccgccttggcctcccaaagtttgggattacaggtgtgagccacgtgtctggccgaaaagaattaaaggtgaaatcagccacattttccagcaaagtttacactattacaaaaaatacaaaaattagccaagcctcgtggcccatgcctgtggtcccagctactcaggaggctgtggtgggaggatcacctgaagtgaggagtttgagaccagcccagccaacatggtgaaactaaaactggtctaaactaaaacacggtctctactaaaactacaaaaattagccgggcgtggtggtcggcacctgtaatcccagctacttgggaggctgaggcaggagaattgattgaacctgggaggttgcagtgaattgagatcataccactgcactccagcctgtgcgacagagccactctgtcttaagaaaaaaaaaaaagcaagcattttgtgctcactagaaatattagcatgattgaatgcttccttgcatatgaaaattattttaacattgtaaaacatctatttggcaggcatggcggctcaacacctgcaatcacagcactttggcaggaagagcgggtaggatcgcttgagttcaggagtttgagaatagcctgggcaacatagtgagatcccgtctctgcaaaaacaacaactgagtccagggaggtcgaggctgcagtgaaagaagattgctccactgcactctagcctgggcaacagagcaagaccctgtctggaaaaatatatacatgtatttgaggacctggctctctcaggacagttttttttcttttctaattctaggttttagtggctgtcataaaaatatgggaggtgaacagaaggtagacaccattagctggccttactaaatcatcatactcattgttacattccatccaccaaatatgcaaaggttttggtaaaatccagctagtgtatttctatcttcccagttgtcagtgggttagaaagttcctctttctaaccaatgtggaggtgctgcatgtttaggttttacatgagtgctcacacccaaggacttctatattttaaaagtgaagacattttaaaaacagattattctggccaggagttgtggctcatgcttgtaatcccagccttttgggaggccgagacaggcagatcacttgaggtcagaagtttgagaccagcctggccatcatggtgaaatcctgtctctac

SEQ ID NO: 11973 - DNA, 251682 bp, Human
  misc_feature (1)...(251682): n = A,T,C or G
caagttgacactcagtataaccattacagccccaaaggcccctgtttgagggaggtgactcaaattcctggtttctgagcatagcctttttcattgaatgttgaccaagtggtggatttttttttatctctctgaaataaacctctgtttacttggagtgttataagtaggactcatccaaatttgctcagaactttcccactgttagcactaagagtcctgtgtcctggaaattccttaattcctaaggaaactggggcagatatttatcctagggaaataagagccaagcacatagaccaggtgttccaggtacctactgttttataataaagcattataaaagtgatcgactcataaaaactgttttgtttgctcacattctgcactctggctgggattagctgagtggttcttctgctggtcttgctgatggttgcttgtgtggctgcagccagccagtgaactgattggagaatgggctcagctgggacatcttggctgctctctctctctctctctctctctgcgtaatctcagggcctctccctttctgtatggcctctccttgttattttattttattttatttttgcagcagggtagctgaattagctgaatttcctatatggtgtcacaggaatccccagagggcaaaacttgcctggtttctaggttgggtgggtgggggggggactggaattaccatggcgtcactttcaccacatcttattgattaaagctggccatagcatcattctagaatcaaggtgaggggactacagggtgacacaagagtgaacaccaggtggcagctcgctgaggtctaccaatgtaacagtttcccccagaggtacagtaggatgctcacctggactcataggattcactgtgagtgaccacttctgacctctgtttgcagggcaccacctgacttcttctcctcacactctcagtgagaatggaatatgaatagtttgaccactggtcagagccaacaagagctctaggtgtagggcaggtttatccctattattcgtacttctcccaagcattaataagaataatagggatggtgagtccctgttaaggttgccaaaaggtttccaaggaagcaacaagttaggggggactgggtcttccatggttgatgcgaagctataagggacttgactgttccatgcaccatttcttgaagagtagtctattctaaggtttctgcccagcacaggaattttggagatgaccaaaacacatcgcctgtcttccggaagctgacctttctcaacgcggacctccccgccctgctaactcttgttttaaagtttaaacaagtgtcagcgatggtctctccccgctttgctctccacacgcctctctcctgcagctctgacttcgttggtttcccagccagggcccctcactgggctgtgagcctcctgagggtagggcgacctccataccttcttctgcaacacccagggtgtatggaggggcctctgttagctggaaacttttgggagcagcaagggaccagccccatcagctccacttcagagcagttccaatccagctggcttccacatccctagggttcttcccttttttgtctcccctatttctttttttgctggaaagaatcaggtcccctcactctccccaaatacaaactgcattaaaagaacccccgagctgcccctgggcccagggacttctgctaggcttggttccctttctcctctcgaaactcttctatcatcgaggagacaatctggcttctggcttttccctctctttttcttggcctctttctctttcttcccccgccccttctccccatgtcacagccagtcccgacgcatcccgcccccgctctgtcgctttaagctggtcccgccgccgcgccccgccctcacccctccgcgctccgcggctccccgccgcttctcccgctcctcccttgctcggccctctcctcctcctcccgctcctcctcccgctcctccgcgccgccgccagccccgctgcgcgctctgctcttcgcagctccccggacccgcagccatggccgacatcaagacgggcatcttcgccaagaacgtccagaagcgactcaaccgcgcgcaggaaaaggtcagcggcgggcggccggggctggggccggggacgccaggcgggggcttggccggagggcaccggctgcagctgtgcggggcccgagcctcggggtgcggcgcgctgcggagcggggccggggccagggacgctgggacgccctgccctcagctcggtgactgccgcaaggcgcgacccgggcgccgcggggagcgggtcgggaggacgcagcgccggggacccgcagaccctggccccggagacgccggatatgtccagctccggagccggccccgggttgccgctctcctggccccaagccaggcaacagaagtaggaggtgcggcagcttgcccgctgcgcccggagcagagcgcatctccctgcgctcgcatctccccgggccggctcccagcgcgcccgcaggcagctcgcggggacgcggcccgcagatcggggcgggagattgcagcagccttccttcttgcgggggattttgtggctacttaagtgcagcagacacgaacgatttaacagagaagccaccaaaaatctcccaggaccaatagggtaggatcgtgatcacacagtgctgtctggtgagttctggagttcaaaacagagatctagatatacacacttttaattttggtctatatgtttgtgtcccttttgactccagtgtccttctttagaaggtcaaaaataaatatgacctgaacctaatagttcctttctgcatatttctgcacaaagaaggaccttttattgcattttaaaaaatccagattgcacaaattgggttctctgttgttttgcaagtccctcagtaaattgcgcacagtaatttattttttttccccagagacgtgcatgaatgaaacccaggtccgtagcaagcacagcccaaagcaggtggaggggagttgtaccaggcaccaggcttgcctggcttccctggtgactgctgtatatgacggccctgaggtcttcatttgtgtcctgagcaaaggacatttcctttatattgtagcttgagcattgtacttgaaaatcaacaccggctaatgagccccatgattggtatcacttgaactgtgttctctttcacgtggcagtattttccgtccctaggatatggggtgtttagcgttttcctgttttactggaagtcagatttgccatgttgctcaggatggcaatgaatttccctcttcagacccaatctcaatctcaggctgcctcccagttccggctgaccatgagttgctgagcagagggggcactgatcccttttgtccccaggcccagaggcttggtggctgcctctagtccctccctccacacatgcacactctccatgcagtaagaggattgtatttcttttaatatctacccaagctcatcctgaactaaagtgatcctcctcctgcctctccctccgcagctgaattagcaaggctgcctgctgccttccaggcccgggttacttgtgcagaaagtagccagggatctgctggcttgggatctgggccaggttttgtcatcctttttccacacttcattttacccacttgtaggtactcctcctcctgccttccaagtaattacttgactcttcggtctgaggcttttcactgaatccactttccatctgtgaaggaatttagtgatatggtctgccttttcacatattgaattatttcttaatctaggtcaccagctgttaatatgctcaaaataaatgaaaagaaaacctaatctcttacggagcattcaagtcctgtgaattgtcaaaactcactttttcacgatcaaggtcaagtgtactttatgactgcagttgtggatggtggtcagtcttctatgggagcgggggtgagagaccctcttgggggtttcaagcgtcctattttcttcactggggaaaggtgctgatgaaaagtgcctgccgcacctagtatagaggttcaaacactaagaggctgagagtataggctcttccccagggtgagttctgcccccctttctgagtctgtgtagcatcaggatatgcttggcacaaagagaaaagggcatgttggcatccaggtaaagcagcccagcccaaatggaggctgctggagaaaggaaagcacagtatgttactgtcagaggctccattagacatatccccacgtgattccctctttctacacctttggcctcttcctcttctccagagaagactcttcatcccaataactatagaccatatatgtccctgagaccctttgcttcttgtttttacaaccaaattttcttaaaagagagtccactcccttgactttcttatcatctgtgcttcacctaaaagcttgcatatgtttaggctccaactgcatgtctgaaatcacttttagaggtgacatggctttttaggaattttaaatacgtttttttcttactgaaagtcagtgaagattcattggagaaaggctgaaatgtattagtcagcagaaaaaaaccacaaggctgaaatgtacatataagcagaaaaaaactccagcaaattacgaagcacataattctactactcggaaattttactaccatttgatatgtatctgagtagatctttttccatgtgtgtatgtatttatacaaccaaaacaggctcattgctgtatagttgaagacctgtttatttcacttcataattatgaacatccttctatacatgtacatattttccatcaatattttaaattattgaacactattggaatgtatggattatactgaatgccttatcttttgaatattcatttttccagtgtttctatatggaaatacaagtcagtgagcaaatttgtagggagaatgtttgcacacctctttaattatctccttagataaattcctagaagaagacttattgcatccaaggtttgcctatttttattatagctagattgccttccagaaaggtgtaccaatttacattctcatcagcagtccatgagacacttgccaactctggataataaaatttaaaacaatgtttagctatgtcattggataaaatttgttcatgattaatttcatttgtttgatttttaaaaagcaaacttttgtgcattcgtgtttttgttcttgaattgtgcttttatatttctgcccgttttctgtagcaattctgtcttgttattagtaagggcaaaaactttatcaagcctaagggttacaaccattctttcttccttttctatttacttttaaattgtttggtgatttctactgagaaaatgtttttgttgatgttttatgtatatctgcttacatctattggttggttttgtctggtttctcttttgcgtggttgaattagtcaggatcctgctacatgcaggtgtcagaaagctcaacccaaactggcttaaggaaaaaaggaatttaattgctaataataataatatctaacaatttatatatggttcttgtacatataaatttagattagcttttaatgaataaaagctatatattcacataagatatatgaatatcttacctatagtagcctatatacatattcttatacatatgtatatgtaaaagtatatgcagaccatatctttcctttagcttttttttttttttttttgagacagagtctcgctctgtcacccaggctggagtgcaatggcgcgatctcggctcactgcaagctccacctcctgggttcatgccattctcctgcctcagcctgcccagtagctgggactacaggtgcccaccaccacgcttggctaattttttatatttttagtagagatggggtttcaccgtgttagccaggatggtctcgatcttcctagtagctgggactacaggtgcctgccaccacgtccggctaatttttttttttttttgtatttttagtagagacggggtttcgccatgtttgccaggatggtctcaatctcctgacctcgttatctgcccgcctcagcctcccaaagtgctgggattataggtgcgagccaccgcgcccggcctccttcagcatttttacagaactctttggtataactctcagtggcccaaactgggccttgtgcctatctctggaagaaaaaacatctctgagagcaagggccaagaccacgggttggactggttgaattgggcctgagtcatgagccagtgcgaaagccaggaatgaagattcccctgaacgatatggactcttagtggaggaggtagggaacttagagtacagaatggggagtggacactgggtggcaaaataaatgatattcacagaggcgtccctgaaagaccttctccatcccaggtttatataaataatcacatatttaatatttgtttaacatttttatgtgtgcagttaaaaaatatgttagtaaaaacttatcatgaaaaattgtatatccttcgcctactttttgatggggttgtttttttcttgtaaatttgctgaagttccttttagattctggataattagccctttgtcagatggatagatagcaaaaattttctcccactctgatgatagtttcttttgctgtgcagaagctctttagtttaattagatcccatttgtcaattctggcttttgttgcaattgcttttggtgttttagtcatagagtctttgcccatgcctatgtcctgagtggtattgcctaggttttcttctagggtttttatggttttaggttttacatttaagtctttgatccatcttgagttaatttttgtataaggtgtaaggaaggggtccagtttctgttttctgcatatggctagccagttttccgagcaccatttagtaaatagggactcctttccccattgcttatttttgccagatttgtcaaagatcagatggctgtagatgtgtggtgttatttctgaggtctctgttctgttccattggtctatatatctgttttggtaccagtaccatgttgttttggttactgtagccttgtagtatagtttgaagtggggcttaaaacctaaatgatggggttcataggtgtagcaaaccaccattgcacatgtatacctatgtgacaaacctgcatattctgcacatgtatcccagaacttaaggtaaaatttaaaaaaaagaaagaaaaataacagtcccctgttcccctctcctcaacctacaatcttgttagaggcaatagtgctaaccatgagatttctcaaaaatatgcttatacagctatttcttgatctatcttttaatgtatggtgaagatatgtaaatttaacttttttatttctcctctagttcttcccccaattatacactgaacaaaaattgttattgcaaaagattacattttaaagattgaagtccaatttttattgaataaagtgcacaaatcttaagtgttcagcttcatgagtttctatgtatatggatatctgcatagctaccacccagataagtaacagaatgtttcttccatcccagttacctaccatttcttttgcctttcttgttctttgtctttttatgttcataccttttaaattactttactctcttttccctgatgagcacctttacatgtacttattggtaattttgatatcttcttttgtgaagtttcattaaagtctcttgccagtattttatttgggttgcttgtcttttttctgttgctgtttagttttctatgtattcaggatatgagttctttatcaggtggacatcttatattttcttccagacagtgccttgcttttttactttcttagtggtaccctttgatgagtggcagtttaaagttttcatgaagtcttatgtgaggattaagtttttcatgcagctttttgtttttcctggagttaataattgccttgcctttaaaaatttgcttattttttaaatgaactttaaaaagttgtttcttcttgcttcatcagatatgtcaaatgtttatcaatattattgttcgaggttcaatatatcaaataatgtaattgctcattttctcatcctggagatatcctttttggatgcctctgcccttttgtggtaatctgggctgatttttctgtagacctgttgcatacatgtcatcctgggtcttcttttgccagtgttggggttgaggaatggacctgaaatctcaagtatcctatattcccgggctttcaaacagtcccctgttgtcagtgttgtgcttcattcttaccttctatggtgtgtggtgtgtggtgggaccaggtcctaaccctgagtgtgtttgtgtgtgtaactgtgtggtgataattggttgctttttcattggttgttcctgtataggcacacttttttttttcttatagtttcctccattctgctgacttgtttccattctttcatcttttttagcatctgtaaaatgtatggaactcttgtattcactaatgctggctttcctgttcttgtccttgtatgttcataattttttattcctttactgtcgccttagttgggctttggaatgagatggaaataagcacatgcagtcagcctgccatgtttaacgaaatgcctttttatttaaatacttgatctctctgggatttatttttttattatttttatttatttatttttttgcccatcttcttctatttgtgaaatccagtggcatttatttggtcttaactctctttgacctctatacaatatttaaatcagtgaagcactgcctttaaacatttttttttttttttttaccatgactgtagtgagcaggatactcgggaggccgaggcagaagaatcgcttgaaccgggagggcagaggatgcagtgagccgcgattgtgccactgcactgcagcctgggcgacagagcgaactccatctcaaaaataatactaatactaatactaatactaataataataataagggagttagactatttaaattctaaggacctgcccagtttgatattctttgtgtcattttctctgtcccaagtgattattatataattgtcttaggtgcaatttttttttcatgcattacatcttccaaactaaattgtaggtacttgaggacaaggaccaaatatcttgcgaattgtatgtactcagtgacgatgtactgatttgcctttccatgtccttgcttgttaacctcccactcctgcaaacacattgtcttaaagaatccttccacaattctttctgtgacttttgtgaaattatcataagggtttcatcgtcatttgctttgtcattttgtgaaaatagtacagcaaatgtaattacccttatggattctatacatggtgggaatgctataaatattaggctgaatcatgtggaattgtcatatttgtgagtcaaacagtcaaatattggcagagtcatgtgcttcagtgcaatgttgattgagtgatatggtaagaaaacaatgttgtctccttccatctgtctggttgtgtgacatttggattctttttcgattgtcgctttgccgatgcctgcattttttgttctcaaggagaaatattgtggatggtgtgcatgtataaaaagaatgggcaaaggaagatcctcctctgtcaaggagatttgtactgtgaggcccagggcccatctgtagaagagtagtttatatggccacgtttacttccgaggacacttcagagaccaaatctctgagacatattggggtttctcttttttcagatcatctgaaatctcttttgttgcctgcatctatattttacaaagcttatgccttcttttccactagggttattttctctggctgtattagaaacttcaaaaattaaaaataataattatgggacattcttaacagagtagagtttccttcttctgccttttttattaatgcaaacatatatatactaatgtatccttctttctctaggaatgagtacaacagaaaataagaactgtaggaactcagattttaacattaataaaagttaccattctcctttaacacaagcatatttggttacatttgaaaactagcttttttaatagaccaaacaacttgtcatagctgagatatttgtataaacaatatggccccctttacttggtgtatgaaattagatcccatttctttaaatattcgaattaaatgatttctccttcctacccaattattatgaaaatctcttactcctcccaggggtccctgtctcttgtgataatttcaggaacccatggtgagtttcccttctttaaatgagtcaatggtttttactacagccttgtgagaaagggtccctaatgtgagtccagcattcggataccgttcttatccctggatgagcactgcagggaacaagagcacagtacggtgccctcaccagtgggtcttagggtggaggcaggagctggaagcctctctctcctgggttagactcagcttcagtatgtctgagctccacatatgtgagctctttacaaatgaatatccatgaatattatacaaaccattcccaaattatacaagccattctcaaatttacttgtgcatatacacatacaaattccccctcccccaagatttgctcatagtgcccgtgttccaaagttaggaaagattcaatatcctcacacattgtgcctagaattatctatttcattccactctactcttccacttttgagaaaattatctttgggacatactaaatttattctaagcccacaatttgaaaaacactaccctagaggacctctggtatccattcctgtaagttgactatcttttgggccattgcagttcatctaaggggatgtgtttgtgcgtgtgtgtgtgtgtgtgtgtgtgtgtgtatgtattcatacatacaaatatatagttacatatattacatacattcatatatatgactaaatttcaaacaggaaatattgtgaagtaccttaggagaaaataagtagagaagggaaagaatctttcttaaaatgatgcatttttctgatattttaaagtctggaaatttccaccttactgtccaaacacaattttaaaagactttctagccatttacactaggggccacctgcatagaacttctgagaaaataagtggcccagtgggctcctgtaaaagggacaaaagatgtaaagattccttgtgttgcagatataatttttcctacattctcagtaaatggctaacatttacataatggaaatgctgtcaccacagagtttaaggaatttacccatgaaagaatatagtaagaccatctatacagcatcatgcaaaattgaagtgataataatcacgattttctgagactgcatctatgggccacctttccacatggaaatgctgaaacatcattcttattgatttgagatctaaatttaagtgtactatttggctgtagatgtacttcctgaacacaaattgaccaaatctcttttgaggaatgatgtcgtataaagccatggataagatcttagttttgaaatatttgctatgtgataatcatatatcaattttgatcaccctgaacctacttagaacagatgtacaaaaacgagaaaaccaccattttggtcatttacatcttactctcatgcagttatttagttgaaagctgagttcataaatgggaagagcttgaatatataataatttaacaaattaataaatatatatatgatttttccctatctttacgtgcctataatgatttaataaaatatgcatagacccatgcataaatgcacttttatcaaggcacctaaaagttgttgagtaaaggatgttaaattcatatgctttattagttatctattctattgtcaagtcaatttggtagaattcatttatttagagccatttattgagaatctaatatgtggaaggcactttctagagactcataatatagcagttgacagagctgtcctggttgagcatacagagcagcaggagttgatagtgagataaacttttgcacacactactaagtacatagttattagttaaaaatagtaattttaacttatgtatgataaaaatacagttcagtttgtaactagggaactaatctagagtcagaggatttgaacacagttacttaaagtaggtagatttcaagctaagatcctaagaatgaattgtagccatcagacaagaggagtaagggtgtgctgattacaggagtcaggaagcattctatacctctgacactttgtccttactccttgagcataaataagaactgtagaatagagaattgactgcagacactggccttataaatgatctcttctctcatttggatatttaactaggcaaagtggaccctaattgggtccactgctgtggtagcagtccctcgtttgtgtgatcagatttttacccttacctgttgaagggtccttctggggcatagttgcccccttgacacagagccaggacactggttcagagctgacttgccctctgaactatctgtcatccaaaatccttttttacaacagcagtaaactccaacccagtatgctttcatggatttgttgagagaagggtctcttattttaaaccatcagaaatccaaaaaaaagaaagcccttatcaaattcttaagtgtcacccatctataaagatgcttttgtctttaaaagtcttaattgcatttggatgcctaacatttaatcaacatttaatcaattgcacgtgtgtgtgtgtgtgtgtgtgtgtgtgtgtgtgtgtgtgtgtatgtatgtatatatatagcatagatgcatagatggtccaaaccttgggaggatctcccaacttatggcagcactgcctagggtgttgaagaacagtgtaatacctttccctgtaattactctgtaattcctcaatatatgaaacatctgtgtaagacatcctgcttctttaacacacacacacagacacacacacacacacacacacacacatatatatatctccaatgaattggtatataatgtacacgggggtggggcagagagggaaggagggaaggagagagagagtgaacgagcgagagagaaatataattaaggctggcaacttgacttaattatgggtattgacttgattattttgcaggcagtggtcttggacttaggaataatcagcttcaggtgatttgcagcttggaaggaatcctaaattagggaagagaatctttcatagcagacaatcttttcctctatctgataatggttacaaacctttaaatagcgtagatggtccaaaccttgggaggatctcccaacttaatggcagcactcctaggatgttgaagaacagtctaatacctttctctgtaattactctgtaattctttaatatatgagacatttgtgtaagacatcctacttttttaacctacagattttataacacaatattttctctgagagtctctaggaaaatggtatccagagttctgtttccatccctttacaaaatgcttgtgaccatggggaccactggcattcctaaactataggttgagacctaagtccttgtagggctctcctggggatgtatattggcccatagttgttcctgttaagcatagacagtgaatccattgtaggtggagaaaatattttatgtgactttaatcttttaaaatttgttgaggctcattttatagtctagcatatggcctatcctggagaatcttccatgtacgcttgagaataactgttttttgctgttgttgggtagagtgttctatagatgtgtgttaggatgagttggtttgttttcttgttgatcttctatctagatgttctatccattattgaaactaaggtattggagtcttcagtattgttgttgaattgtctatttctttcttccgctctgtcagtttatccttcatgtattttagtgctcttttattaggtgcatagttacatttgttacgtctacttcatagattgaccttttgtcattattaaatgtccttctttgtctctagtagtaacttttgtcttaaagtccatttttatctgatacggttatagccattccagttttcttttggttactataatatttgcatgatgtatctttttttttatttaagagacagggtcttgctctgtcactcaggctggagtacaggcacgatcataactcactgcagcctcgaattcctggactcaagcaatcctcctgcctcagcctcctgagtagctgggactacaggcacttgccatcatgcctggcagcatgagatatctttttcatccttatactttcaacttatttgtgtctttgaatctaaatgttgtctctcatagacagtattttgttagattttttggatcaattttgccaatctctgccttttaattggagtattaagtctatttacattttacataattaactgaaaagacaggatttatgtttgtcatgtatatcttatttctctttgttgctttatttttcatgcctgcttttggtgttaaatagatattttcttgtgtggtcttttaattcccttgttgtttcttttacaaatagtttttgagttattttcttagtggttgccctgggattacagttaacatctacatttgtcacaatagaggtcagattaatactatctcaatttcaatagtatataacatttttctcctgtgtagctccattttctctcttttgttgtattgtgattgtcaaacaccttacatgtttatatattttatgttcgtcaacaagatttatagtaattgctttatgcaactctttttttttgagacagagtctcactctgtcacccaggctagagtgcagtggcatgatctcggctcactgtaagctctgcctcccggtttcatgccattctcctgcctcagcctcccgagtagctgggactacaggtgcatgccaccacgcgtggctaatttttttttttttttgtagagatggggtttcaccatgttagccaggatggtcttgatctcctgacctcatgatctgcccgcctcggcctcccaaagtgctgggattataggtgtgagccaccgcgcctggcctatgcaactcttttaaatcagatagaatcataatgagttataagcaataatgcatttatactgtcttttgcattaacctatgttgttactgcatatttcaaaaatatatttttcttatgaaatggactctgtttaataaacaattattaactcatttgctcattaaaaaataaagcaagatcatagtacgagatgtccagtgttactaacacatttattaagcataactccagctaaacataaagtaaagtaatataaggaactaattagtttttagccatagtataaataaagttacacttactgtctgctaactggtttggattattgaggaaatgtttcatactccccttagtagttttacaattccagttttttttttccattccatagttaggagctactaagtattacttatgatacctcaagatatatgcaacatcttataacttttttctgggtgcctgtaacttttatcaggttttcaaaaagatctgtgacttaaaaagcataaacaccaacaatgagtctaaagtattaagggactcttggcttaaatatttctgcaaaacttgaagagcaggaaggagaattaagtcatcagtgggtgacagagctgctggcacctgggcacccagcatggtttattcttggtttggttatggtccttgcccttgaagactcagattttctaggtccctcaggatttggcccaagtattgtgatagtttcaacataaatgcgtggtgcacgccttctgccactccaggttccttgtcacacatctctaaaataattattttgatctgttatttaagggataacaaaatttcttaaggtaattcagtttttgagtcaccacagcctatgactttttctagttgtccatttcatggcatctagagatctctgtttagaggtggcccaggtaaatgagaggaaccctctatcagaggtgaccaggggaagtctacatttatttccaacgtacattagatgatgccctgtagagtttgggtgtagatcagcccccttggggtaacacacattcctctcacaccttgcttccttaaattgaagtggaaaagactgtgcatgtatgttgttttgaagcttttataatgaggtatgaaatacatgtagtaagtagcaaaaatcttagccgtacagcttcatacatttttatatatgtaaaaattttatgtaaaatactaaatcaaaatctatatctacatctacattatctatatttatatctacttctatctgtatctatatcttatctatatctatcctgtgttactgctactcagatgaagtcacagggtaattccagaatccattagctcctccatgcctcttcccagctaatacctcctctcctctgctcacttcctactaccaggtagccactattctgattctaaccccatagattaatttcagttgttcttgaaccttgtataaatggaatcatatagtatatactcttatgaattttacttcttttgctcctcatcatgtattgagattcatccgtattgccatctgtaggagcagttccttctttttttattgataaattatattatagtgtacaatatcccacaatttatttacccattcttcacctgttaggcattttgtctgtttccagtattaggctatggtgaataaggcagctgaacacatcttatacatgtctattggtagaaaaaaccacttatttatcttgggttaatacctgagagtggaatgaatgattcattagggtaggccctctttagcttttagagatggtaccaaacagttttccaaagttgcatcaaatttatagtcctgtccacagttgtgagaatttagaaagcctatattttcatgttctaagtttgatttcgctgagttgtatttttttcactcctgcatccccatgggactcatatttgtttagtgataattgattttatctttatatatttcacacataatcgtagggacgtttctctcatgaactgtccacattttgtgtttgaatcaggtgggggagtggtcaccattttaaactcagactacgacttgcttgtgcagaggagatgtacacatggtgtctgtgtagatgattgggggaaggattgtgatacagctaatctcgtggtgtcagaggttctttggtgtgctatattctgcctcctgtcctctgggagcagtgtcctatgctcacatgagtggtattccctgcatgtatatgtggttcattaactcacgatctccatctttggctctagcagaggccagtggcatggcatgcacccactggctcaggctcaccttcattgctctgccatctggctgcactgacattgggctctgatccccagcccttgctacagaaccacgtggccactgctacagtagctaacctgctgtgtcttcactacatgagtattaagggcagctggggtaatctcaacttcaggtctccttagcctggctacactgtgcagctacaggatgtaactgtgccctaggctggtgagaggggcagcccaagaagtgatctttccagagtgttcagtggggcataaggactgtagctcccctctgaccctgacattatcctcacttctcagggaggagaggagaaaattggggtatattttcttccacttttgttactcttttttgcagaggggaaggctttcttcttccttctgttatatcctcctgtggcagagcttgccaggcaccatggatgaagggggcacgttcattccactttgggaaagagggctctatgagctggggcttccaggttttatctccctttttagacttaatgaagggtaatggaaaatttgcactcaaggtatcttaattcttgtgccaagtccagttagaataaagaattgggtgtttcccctgctaggctctgtgatgagcagtcccatatattaactcatttcaccctcgtagtgaacctatgaagtaggtgctattattatccctatcttacagatgaacagactgaagcacagagatgaatggttaggcaatttgcttgagactacttagctagttaagtatggaattgatctcggaagtctcatttgactttgcagtgcaatgttcttttcatcagttctggtgaagttattctgcaatattgagttgagagaatgtcaggtgtcatgtagtgtaggggagtaattccaagtggtctggcacctgaaaaggttttatgcctttacatttcattcattgctttacgtgtcattatacttatatcgctgggaccttccagttaccttctttttaactttggagagggttttctttaatatactggactttcctaaagtggggcaaactgatgtgataatcagctctttttggttgcacagtagttatatcccagcaacttaaactgctttaataaatctgatgcctaaggtcttgtgggatctgggaaagaggcacttctacctcggggccttagtgcctcgaaagatggtttggaaaaatcataaagaatgcttgagtatctgagttaatttcatttcttacaagatgaacatcttacaaaacctttacagctcatcttaagttgaacaccagaaataaagatgtgcctccaaatatgaccttacagactgagaaagatgagagcaaagcctggatgcatgtgctctaccaattggcaaagggccgatttctccaaagggcagatgtttcccaggccatcagagaactcatgcgtgttctatatctgcttcttagcaacttccatatgccaagaattctgatttccacttaatttaagcttacttcaatagctcaattttcatctttccaggtgcttttccagagctttccagttcagtcaattttacatgatccatcatggaaactgcaggattgtttgccaattgcaattcttttccttactatatgtcagagattgcaggttgcccccagtatcaattcctcccttttcatttagtaataaaattccaacttttgctgggatataactacccatatatgataaatgatagcatttcacagcatcatttgtggctagatgtgtcatgtggctaagctctcatcagtgggagatgtgcagaaggtgcatagaaaacttctaggtcttgatcctaaggggagaggtttgtgttccactgctgcctttccctttcccggtctttggatgtggatgtcatggtgggaggtggggctgtgacctttagactatggggtggactcctgccatgtcacatgttgagtacagcaggaatatgagcatggaggagcatgggtcctctgtactatggaactgctgtggcatcctgggttccttacactagcacagttgcatgaggaagcaggagacttctatatctacagaagctgctattttttttttttttggcttttattcctgcagctaaacctctgtcctaaggtttactttgaaccgtttgaaattgccatttttttgtgaaacaaaatttgtcaaatatcagcaatctcatacagttcaacttaagaatatactttcacttgtaaaaattgaattttgcacctactgtctgaggctgcatactgtggaagtggagagcattttatgaaaggttcagagatgattcaggcacggtggagaaatactctccgctcagaacagcggataatgagcaggtgcttgattgcttagaaattatcccgattatctgttaaaaagattgatctctttagttaagacctccttggaagcattgtcaggtacttttagtctaattggttggaaggcagccacctcaatacagagctttacaatttggcccctgggcagtatttctacttgaattgtgaggtgaaagttctacctgtattgggtcctatgccgtggtaggtatgatgatgctataaggggactatttggagttggccaagacgttttagaaagggtgactttggtaaaatataagctgaaatgctagaattacagaaagattttggtacaatttatttggaagcagttcagaatgatgggaagacctttggaatgagtcaattatggattcaaatcctgaccttctcacttctcagctgtgtggtcttggtcaagtctctctgaaccaatgtttcgactttagcaaaatgcagaaaatgatgctttttttttaaggttgcagttagagtcagaactaatattttaagtactggcacggtatgtagtatttccatagaatgtaaatggtagctatttttattttctttggatttcaatgtctttctcaaggtggcaaattagggctatatttatatgcttttaaccttcctttagaatagatggcataaaagaggatctaagtgtataacccacatatctatttgaaccaaatggggaagcaccttgtttaaactttgaacacgtagtatataacacatatttcctttggtcacacccaagtgttctaaagaggtgtcccagaactgcagatggggacagaccatttgacatcatctactggctctcgggtaccctcatcttcaaccatggggaaagagacccactggaccttttgaaaaaccctgattccccttcctgcagagaaccatctttagataagaccaagatagaaagacatttcctctctcgctcttctttcatatggataatctatccatatcagtgtttctgaggccctttgagaaaactgtttaggctgtagaaaaggactgtattatgtgggtaagatgtaaaagacaccagccttgccctctattgaagctccaaagccccctgtgaaactccagtggcattttcacagtgatatttgtaaaaagacaaaaacaggccgggtgcggtggttcatgcctgtaatcccagcactttgggaggccgaggtgggtggatcacctgacatcaggagttcaagaccagcctgaccaacatggaaaatccccgtctgtactaaaaatacagaattagccgggtgtagtggcacatgcctataatcccagctacttgggaggctgaggcaggagaatcacttgaacctgggaggtggaggttgtagtgagccaagattgtgccactgcccaagagcaaaactccatctcaaaaaaaaaaaaaaaaaaaaaaaaagaagacaaaaaatcagtcttagcagtgtttattgaacttagaatgttagagctggaacagaagtgagcaatcagaggcgtgtccttagacctgggtcatttacttagtccacttattaagctgtgtagacagaccgtgtttgaggattaacacccaaaggttcatctcttttcctgtgatttagctatcttgtcagtaaaatcaaggttttaataattagctcctattactaacatttatggtatagggaattaatgaaaccttctgagtcccatgcaccggaaaaatatttgagacacctgcaggcaagatgaactaatgtaagcaggaaaagttaggtgtgaggacctgtggccagtgggtagaactcaactcttggtttaatttctgctgggctgctgcaaataacaggtgtggaattattgttccagccagggtacagaagccaaagtggtatttcctactgtggctctgccttccgcaatggagactgaaggtttagccattaaggctgtatgtagaggtgaatcagatattcacaatcttggagaacaaatatgatttcactgtccagataagagatgtttacgtcttgtaaaaaaaaattattgtggtaagaacacttaacatgagatttgccttcttaacaaattctgaagtgtacagtacagtattgttaactatagggtacagtgttggacagcagatctctggaacttattcatcttgctaagctgaaactttatgctcattgattagcaactccccatttccccccttgcatctcctggcagccatcattctactctttgattctatgaatttggctgttttagatacatcatatgaatggaattatgctgtatctgtctttctgtgatgagattctttcgcttagcttaatttcaagtttcatccatgttcttgcatattgctgaattttcttaaaggtggaatcacattccattttatgtatgtatcacatttcctttatccatttatctactgatggacatctggtttgtttacacctcttgtctattgtgaataatgccacagtgaatatgggaatactaatagcttttcaagattctgttttcagttcttttggataaatacccagagtgggattgctggatcattaaacttgatatttgatctaatgtctgggtaccattcacttctctgtttttcttcctttctattctctcattctgctgctctgtccttatactccttaactcttgtctctatgagctcataagttgaaattaaatgattttttttgtttgctatgttactaaatgttttacattcctttttatttatttatagggcaaatcaagatggatagacacatgtttaaaatgtgtctcttccaattacttgttatttggcaatggagtctccctaaatttcactttcctcatttgtaacatttgtaaaacacttaacttaaaggataactgaaagattagtagatagtgcaagtaaaagtctagcatagtgcctggaatatagtaagttctcaaaacatggtaggttctatttttttaataatccaagactagtgttttatacttttattagaataaaatgtcaacaaaattggctttttatttgtatgtgcccctctgtggatttgtgttttctgtaactcactgagtttcttttttcttttcttttcttttcttttcttttcttttcttttcttttcttttcttttcttttcttttcttttcttttcttttttcttttcttttcttttcttttcttttcttttcttttctttctttctttctttctttctttctttctttctttttttttttttttttttttttttttttgagagagcttagcttttgttgcccgggctggagtgcaatggtgcgattttggctcactacaacctctgcctcctaggttcaagcaattctcctgcctcagcctcccgagtagctgggattacaggcatgcgccaccacatccagctagttttgtatttttagtagagatggggtttctccacgttggtcaggctggtctcgaactcccgacctcaggtgaggtttacaggtgggatttacaggtgggatccctcaggtgggattacaggcatgagccaccgttctcagctgagtttcttttatattatgtgctttcctccttttactggtttttgaacagagtaagtttttgaaaaagcttatggactggatgaattaatgattattgagtgctgtctgtatgatctgtaactaaatttccatttttagaaatagatactttacaattgtgaatgtaatatatattcattaacacagcacctgcaatctattacccaggggtaaccactatttaaatgtatatatacaccttatacagtatggccccagctttgttaaaaaaaaagataaattttacaagttgagatcatacagaagatagccttagatccagatctttctgcttagcacctcttggttcggtccacttggagaatgtggtttttaatgggtgtaataaggatggaccattgtttggacccaattcttcactgactgcctttgtggaattcctgggatgtcctcaggctctctacagtgtgccaacagtttctgacaaaatgcctaaagtgcttcagccagtggtcactgtggctgagtttgggcaggaggatttctaggtataatcaagcatggtggggaggcttagcagatgcctttcagggtgacttcgagggcctttattggcacccaagttaaacagaaataaaaggaaacctccatcgaaggagagagcctgtgtttctccaaaaccagctctgctcttgccctcctgtgtgctgcgtgcatattcctgcttgtgctgactttgatactattagctggctctgaaaacagttcctatttatccgagtcgagcctgaacacagagagctgatttcagcaactggcccctccctccgccttgtgatcaaatgatcaccctcttctcacagtcatctcacctttccagcaaatgggattggggccaagagcccactgggcttttaccaaagctttgctttggcttaaaatatcgctctttgcctcatgatgatttatcattgactacgtaaagcacgttcatatagcaacaaaaagacactagctcatttaaactgcccgttgtgttgcttagaactctcatatctcctttgccctaattcttctgtaggaatattcctaatgtgggcttgcctaggggaaatggacaggttgaagaacatggtcattgcataatttcgattgctgatgtgtactgcacatgtgggttaaaaccatgaatcacaccacagatgacagtgtctgggggccaggccttccaccatcacttcttgcagccctcagccttctttctcctgtttgatgtcagtattgattattggtgtctgtagtgacaattattggcatcaatatattggaggattggggagatacacagcaaaggcaaaaactgttagcctttctcgtttcaagtctgagggttttcagggagctgaccaggataatagatgtgctacagaaccccaaaagcctagagaggggtcaaaatagtatgttaggaagacagggagctccccagtgaaaaaaggtggaagaagggggcagagaggagagataccttgccaggcaattgtttattgtctaagttaatcttcactggcagagagagcacgttgccttcagttttacccatgaggacaccaggagcagagagataaagggctggatggtcagagctgctgacagtgattgtgaagctgcacctgggaaagctgaccgggagccgtgctcagatactcacaatcctgaatgccacccaggctgtgtcttatgcacagcaacacccacgggtgctcttacaggggttctaagaagagccacagaaaatctctgaagggccaggcgtggtggctcttgcctgtaatcccagcactttgggaggtggaggcaagaagaacacttgagttaggggtttgagaccagcctggacaacacagtgagacctcatctctactaaaaattgaaatggaaaaaaatttaaaaaaagcagagaaataaaatcaatgtgacaaattaagaaaagaaaaagaaaatcactgacttatatcagccttttctccaagggggaagctaaaagaaaattctgtgttttaagtaattttcataaggctttgtaaatggagtttaacatcaggaattcatcccacaaagtcctgggtattggaagtctcaggtcctattttcagtgccttcagtggcctatgtaattcaaataaactgagaacattgtgcagggttccttgtcttcatccttatagcatctggaccccctgcactttcattttattgtgcagtcatagatatcgatgacttagcagatattaattaaaccattttccagtagtagaaacagagcctcttggtttcttttcctcaactgctttcctccacttactatactcctaccttgcttcaccgggggtcctgaggtccctgaaggggtctgtcaccctcctgctgttgaccactggagcctctttgatggtagcttgagaaatcataaagggtatttaccttttgcattcaaaatgtattatacattaatggacatgcaccatttatgtataaccaaatagacatttaactatgttagcattttgcatgttctgctttggaaatttagctaaagtggagctcgtaataagaaaatgaggtgatttgaagtgctggttagttgctttcatattgggtggatcttctatgaatatttgggacctttagaaattagtactgaaattgagaaattttcggttggtagaatttagggcatttctctgaatgtgtcatttctaagtcaccatctccattaaagaatgcttttctgagcctccttggatccctcaaagctaggtggttgtcatgggaattagtcacattttgaagagttgggcactgtaatgatgaaaaacatggggatttctcaaaggaattgaaaacaagtgttcaaacaaaaactcggacttgaatgttcacagcagcattatttataacagtcaaaggtagaaacaacacaaatgtccattcactgaggaaagataaataaaatgtgaaaattcatacagtgtaatgaatattatttagctttaaaaagggatgattggcctggcacggtggctcatacctgtaatcctagtgctttgggaggccaaagcatgaggattgcttgaggccgagagttcaagaccagcctgggcaacatagcaagaccctgtctctacaaaaaagtttaaaaaattagccaggagtggtggcatttgcctgtggccccagctactcaggagactgaggcaggaggatggcttcagcctaggaatttgaagctgtaatgagctgagattgcactactgcattctgtcctgggcgacaaagtgagaccctgtctcacaaaaaaaaaaaaaaaaaaaaagagaatgacgttctgagacgtgccacagtatggatgaatgtagaaaacatgctaagtgaaaggagtggtcaccaaaggccacataatgtattgtagatattccacctatatgaaatagctagaataggcaaatccataaagacagaaagcagattagtgtttgccaggaaatgtggagagggaggaatagggactcactgcctaatgaatacagggttcttttttgggatgatgaaaatattccggaactagacagtggtgacggttgcacaacagtgtgaatgcactaaatacccctgagttacacatttaaaaagggttacaatggtgaatttcatgttatttgaatctcaccacaatttttttaaaaagcaaaaagcaaaaaacaaatccctaaaccaaagataccccaaaacctaaagcatggggactgggcttgtactgacctagtacaagacctaggtttgagtcccagctctcccatttacttactgtgcaggcttgcacgagttccacaatctctctgagcactcatttcttgatttgtaatgtaaggacacgagcgttttctacaccacacagttgtgaggagtaagtgaggtcatgcatatgagggatggccatagactcgcactgaggggctttctttcctacgagtttagacttctagcactcaaaataacattataaaggccaggtgcggtggctcacgcctgtaatgccagcactttgggaggcgggtgaatcacctgaggtcagaagtttgagactagcctggccaacatagtgaaaccctgtctctacttaaaatatttaaaaaaaaaatagctgggcatggtggtgggcacctgtaatcccagctactcgggaggctgaggcaggagaattgcttgaactgaggaggcggagactgcagtgagccgagatcgtgccattgcactcctgcttggggacaagagtgaaacttcgtttcaagaaaaagaaaaaaagaaaaagaaaaaacgaaaagaaaaccattataagtctccagtgaatattggatcaaaattctaaaaatcaaaagaaatattaaatggactctaccttacattttcacagagaaccaaatgtgacctccacaaaagccttagaaagttccagaagtctctgctgaaggttctcaaaaaggggcccaaaggcaaagtacattgactaatatacagcagaatgttctagagatgctttccatctcatctcttttccatcatttcatgtgtcatggcagtgtagccccctaaaaacccctttcttcctcttgctttctctctcaatacccaaactttagcccatgttcccctcgtcccctcacctttcctctcttgtccccttctcccaccctttctgctctgagtggctctgcctccttactgcataacagtttatcctctgtctaggcctttctggttctgtagccatacttattatgggatcagtaccccaaaaggcttcagacttcactgaagaaaagctaattgctttatctttgccacagaaatttgtgtttatgtgataaatatccttcattaatctttactaacttccaaatgaatcacctgttaatcctttgtcatttttatgaaggatggagggaataaaaatgatagtctactttgactaatcacattgtacctccaaataaagaaaactattaggaaaaaaaaatgaaggaaaatgctgttcttagagacagcctgagaagaaaagggtgagaaaaaagaactttgaatcggccatcatttgctttagatgacaaagtcagtcctcctgaggcagaggggagattgaagagggaacatagttcatttggtgtagagcttttataacagggtagattcctggtaataataataagagctgggtctttggatgaaggactcttccagttctcaggaaccttaggaggtagttattgaggaagctgaggctccatgggatgaagtaatctattctactcatgtgagcaacacatggctgagccaggatcccaacctaggcccgtagactcatcccaagctctcaactgccctgtgcagggctggggcagtgtgtgctcgtcctcattcttgcatatctcctttctctaccccacatcagcacacaagcattgcccagtccacagacatgctgggcttgccgaagttgcagaggctctgggctgggggataggagggtttatcaccttgtcctttgctcttgttgcaatctgtcctgccatcattggatagtcaaaattcgtctgcctgcacaatgtatgattattcgttttctagatctgttgctatgcattgtttctgtgtgtgccttgttggagatagtgcaaaaatctcctatttacaaagatcttagagcacaggtgaatgaggaccactcatcttccccagatgtggttttcacaaatgaccacatcatcccatttcagacaggcacaatcacacttgtgtgtctattttttgaagcttcctggaaattctctcaacatcttaatcagtataggatataattctcctactgtaattatttctgacatgtaacctaaattctttctgctccaccctgcattcactgaagagaaaggacatcacgtttgttgaattacacagtcacatgtttgtcagatttgtcaaaatgtgcatctcttttcttatttttgcttccaggatgagagcacggtctgaatacagtttagctggattggtagcattgtccactctgggacctagcaatcctttgaggcctcagggaagtgtcacataaatgaccagactgcatgagcagggagggctgagctgtgatgcttggtctactggatctgacaagcccttggcatgctgggtttcagaacctccatggaagactgatatggaggcctggctcttcttctgcacactccatgtaactccatttgcatagtctaggggcgttagaaaccaaccactgttttaagccaccatggaagcatgtacgttcgtagctgtagcttgtacctagctaactaccaaatatggttcgggtgctaggaaggatctggcacccatggagtccaaaggaggttgagagaatagaaaagcatttcaaagctggttcatgtagcctctttctttgctttgaaattctgagaaatgaggattgtgtttcttaatgtgatttttatgtgatattttctggcttgattttaactttttattttggcataatttttttttttttttttttgagacagagtctcactctgtcaccaggctggaatgcagtggcttgatcttggctcactgcaacctccacctcccaggttcaggggattcctctgtctcagcctcctgagtagtagggattacaggcgcatgccaccatgcccagctaatttttgtatttttagcagagatggggtttcgccatgttgcccaggctggtcttgaactcctgacctcaagtgatccacctgccataaagtaggttcaatatttgcaatgaggaaatagatatggtactattttctcatctctggacctgattcaggtgttgtcagttgtgctctttacaacatcatatccttttagtttaatctcaggcaactttcagccttccattgggccgggatattgactttttgaagacgatacaccagtaattttggagaatgtgtcttaatttgggcagtctgtttcctcaggataccatgatttaggctacacaatttcagtgggaataccacagaagagaagcagtgttcttggtgcatcatttcagggtgtcacgtcaaggtattgaaaactgtggtaggcagaataatgtactctcaaagatgtctacatcctgatttccggaattttttaatatcttgccttacctgacaaaagagactttgtagatgtagttcagttcaggatcttgagatggggagattattctggattactggggtaggctcactgtaaccacagggattgctataaaagcaagaaggaggcaagtgagtcagagaaggagatgcgaccatgaagcagaggtcagagtgatgcagggccatgcgccaaggaatatgggcagccttcagaaactagaaaaggcaatggaaggatgctcctttagagcttccagaaggagcacagccctgccgacagctcgatgttagcctggtaagactcatttcaaacttctgacccccagaacaaatagtttgtgttgtttccagccacaaagtttgtggtagttgttataacagctgtgggaaacagacacagaaatcaatttagaaagctgggctactgagctgaggtggaggaggctctgagagagggctgccacgtggtcagggtgggcctctgtggaccttgggacaaggtgtctcatcccccttattggcgtctgtggtgctgcccactgttgggctgtagagtgtctgggctgtcctcagatggcttgtgcttaacatcctccattatcaatggcatagacagggtgagatgaccaggttgaaggacttttatttgctgccttccttagggcgtttagatccacatagaaaatttgctaatggttttgcattgatacccacaggtagttatggttttgcttttgggatctgagcaatacacaggccttcggtagttttctggggttctttataggatcttataatgagggagtagagaaggtgaggagagtgcttgctcacctcaaatattatataaattatgtttgctttcttcttgagagctgccagcaatctgattagtccatattgcaaaagtgaaaacagacactcagagagcttgagtcactcagacaaagttacacagtggagctgggatttccaggcagatctttagcattttgaggtcctagtctttccattccattaccttacctctgaaaaatacgactatgttaatactttgaatccagcaagcatttactgagcagaactgtgctatagatactgggagggcttgaaagaataagaaaatgaataaggcatagtttggattttcaaatatcataaatttaattattagaatacagctttgagtgtcctagatcatgaaaaaagtaaccgtttgagcttaaaggccccttcacaaaatggaacttggattaagcaaagagaaaaaataatttaagtgtgaaataagacagaggtctttggccttatctcccaagggaggttgcttttaatgagatgctattttaacagatctggagaaagaagtgtagtcagacacctgcttcttgggaatgagggcttccaattagtatcagagtgaattctcgggacaactgttgcagtagcgaagaagggccagccatggtggctgtggatgaggccttgacatttggatgcctggacattctctcttgatttctattacagaaggacaggtttatggctgggcacagctggtaaggtggcactgctcactgacaatgggaaaggctgttttggagcaggagaggagatccactggataacaaggacctcaggagagttcggcgtctctgtgctaatgagcttcaaggaaaagatgtgaactggcataatgagcaatcatttgtaatcgtcttttgagtacagtttcctgcttggcagaagacaagctgtatctgtggctcactgccagcatgggtaatgtttgtggtagtacctgtcactttataacagtgtcttaatgtcttatgcaaattaccttataacaaagattgaataaagaacacccagccaaagctaactcatgaatgcagataccaaatctcatatagaaacactgacaaactgaatttaaaagggcactgaaagaattaacctctgtaaccaggtaggagttgtctcttcggtgcaaggatggtttaatatttagcatatcatttaatatgttaggttgaacaatagaaaattaccatactttctaggtaaaaaatggtcaaagattgacattttcctatggttcaacataaaagtgtagccaatcagtaagtaataatctcaatagatatatagaagttatgataaagttcaccactcattcctgttttaaaaataaaaccttttttatggtaaaaatattaatattaatcttacgagaacatcagagtatgctgacactgaagtcattgtatttaaaaatcgggaatatgaagaggattccaccattaaatactattttttaatgttaatctggaatttctgggtaactcaaagaggcatggaatggaaggaatattataacaggaatgtgacatgataaacagatacaaagaaaaatttaaatatttgcttaaaactcatgattggcctagattgttctcaaaagaagcaataaaaataatttagaaaggtatgggaaaggtaagattaattaataataaaataaatgcatttaaagtgggatttttatcttttatttttttaaactatcacaaataaaaatgtattttaaaaaccttgttacctcttggcgaggactgaatccaaaggccactctcaaattgttgtttgggagtggtccttaaagatgcttacaacttttgattcagtgattccactcttaggaatatattataagaaaataaaaagatacaacgatattttatatcacagtgctctgtatgaggagactcataacagtggactgttggaatactattggaaagtaggggctttgttaattcatttatactaaaactatttattattttactattaaaataatatttacaatacataaatatttaaaatatttcaaatttaatattaatgataaaatattaatacaagtgcatgctacagaacaaatacagaccaaatacagaccaaatttgatgtataagaacatagcaatttatgtagatgtaatatgtagatatatatttaccgttgaccctttaacaatgtggcggttaggggtgccaaccccgcaatgcagtaaaaaatctacgtgtaatttttgactccccaaaaacttaattactaatagcctactgttaactggaaaccttaacgatagtacaaacagttgattagcatatattttgtatgtaatgtgtattatatgctgcattcttacagtaaagtaagctagtgaaaagaaaatgttaagaaaaccgtaaggaagagaaaatatatttactattcattaagtggaattggatgatcataaaggtcttcatcctcaacatcttcacgttgagtaggctgaggaggatgaggaagaagaggggttggtcctactgtcctataggtggcagaggtggaagaaagtccatggaccagtgcagttgaaatctgtgttgttcaagggtcaacggtatatagaaacaatgaagttcatgtccctgcattgctaaaagcagaaatcacatagaccacattctctccacaactcaaagaattagaaaataattgaaaaggtttatcacaatttacttgaaaaattagaaagatttatgttaagtaacttaagtcaaagagaggaaatcaaagctacatttaggcactatatagaaattaatgacattgagcacgttacacactaaagtcatgggagacaagcaaagctatattcagggaaaaagcagttgttttaaatgcttttatgttatacaggaaaagataaaattaaagaaaatgagtgtctacttaagaagccaggaaaacccaatctaaggacaggaggagaaaggaatatcaagattacaagcagaaatcaaggaatgagacaataaaataataccaaaaaattaatcagttaaagtacaaattaattctttgaaaaggctaataaaataaacataactaagatgacaaatcaagaacagaagctggaagccacatcaagaaaatacggaattagaaacaggctgataaacctataaaatataaattataaattggaaaattttggtgaaaggaagtagaccttgtgttgtaagatattaaaacattgcatcacgcctgtaatcccagcactttgggagcccgaggcaggtggatcacgaggtcaggagttcgagaccagcctggccaacatggcgaaaccccatctctactaaaaatacaaaaaattagccaggcatggtagcaggcacctgtaatcccagctacttgggaggctgaggcaggagaattgcttgaacctgggaggcagaggttgcagtgagctgagatcatgccactgcgctgagatcatgccactgcactccagtccaggtgacagagtaagactcagtcttaaaaacaaacaacaacaacaacaacaacaaaagaacaacaacaacaacaaaaaacattgcaaacacaagtaatgacttaaacagactaacttaacaacttgctttcactaaaaggaagttgaccttatcttgttggatattaaaatattacaaatataaatagacaaatcagtggaaaattatggaaagttaaaacataaagtcaaaggtatgtaagaatcattcaataaatctatttgggccaacaactcatcatttgaagaaaaaatgaccccagctttattctatatgctctatacaaaaataagttcatagctaagatgaagactaatgtgaggaagataaaataaatgttctcagaggataagggtgggcacatgcagggactgaggaaagggaactctttctgagccaggtgccaaggcagatactacacctgaaaagattgccagattccaccccatagaaacacaaaacaagaatacaagttaccataaacaagatggaaagataaagctattttcaaattttaagatatctcagcatatggtattagtattttccattgagttgtgatgggtggggttttttaagactggctaagcctattagacattaatgtcacatcctgtgagtatcattggtatttggtaggagtaatttttgcctctgcttgtgagagttgataaaaatctattttcattgtggaaaaaaataaaaagataattcacctcagcatggggaatgtatacagtatttaattctgcttaagaaatctcagacagtgaattacctcagagcatatctcttgaattaaaatattcatatttgactgtataacatatgttttaccttgaagtcctagttgcagagctgattcagaggcatctaggtcaaatacatgatcttctgatgtcagtgattcattataacccttttcctgttcctcttatggggcaaatattcagtagagggcaattatttaacataatataactttcatgatgacagattcctgttaaatggaaatacaatcatatatacaaatctgcatgagttgtatgaattcatatgtcataatcaaatggatgactatgaatctgaaacttttattatttattgtatgaaaaccatgggctgttttttttccctgcccttttagtttactttaatggttgacaagaactatgtgtgctttttgatagtcagctcagaggtttatcctgactcaaaatggagtagcatacatgaaatgatgtaaaatcaaaatgttcacttattcaatgactatttgttgcattgttgctatgggccgggcggcaggggactttgttctgtaagagttagtgggaaactgttgaagccagagagaactatgatcagatgcatgtgtttgagaggtcatttggacactggagtagagaatgggctgaaaacagagagataaatgcataggccagaaggccatctacctcagggtgctggcagtggcctgaaggtggtggatggaatggagggtccactgggaggtagaattggtgagatttgtcatgtgggagtgggcaagaggtatggtaaaggacagttttagatttctggtttgaaaaaataaataaagaggaagaggctcagaatcccatcctttctcatctttcccttcccgtcacgtttcatttttgtttgattgtgtttgactgcatcaggcaaacatgaaattatagaattacaacatgaaagcacaagttggggcatgtttataatgtagggtcccagtttaagatttgggtgtgaataatccactctgccctctccctttcatgtcctcccacctctcagtagtgtctcaacatacaaaacttttaccctctactgcctatacttcttgcctgataggactaataattccccgggctcctgatttctgtctgaagagccaatcctgtgtgtgcccaggctggaactgagacaagaggctggaggaagcccactgttggctcctagaagctggttgcttgtaagcaaactctacccctccatagacttattccttctctcccacagggcaagtaataactcctgtttcccggccactttcaaacctttcacaccagtagctgttctctcacacttgctcacatccaagctaaagttggagttttctcagtttggagatttctcaaagaaattaaacagagctactatttgacccagcaatcttattactgggtatataccccagtgaaaataaatcaccctaccaaaaagacacatgcacccatatgttcatcacagcactattcataatagcaaagacatggaatcaatccaggtgtctattaatggtcgattggataaatgtggtacagatacactatggaatactatgcaggtatagaaaagaatgaaataatatcttttgcagcaacatggatgcagctggaggccaataccctaaagggattaatgcaggaacagaaaaccaaatactgcatgttctcacatataagtgggagctaagcactgagcacacattggcatgaagatgggagcagtagacgctgggaactactagaggtgggggtaggagcttgggttgaaaaattaccaaatgggtactgtgtcactacctgggtgatgggtacagtcatatcccaaaccttagcatcaagcaatatacccatgtaaaaaacctgtacatgtaacccctgaatctaaaattaaaaatgagataaaaaaataaagttggacttttctggacaccctgattgatatttgtcctaaaactcctttgggaggattcttgcacttctccacaacctctactctgtattcgggcttcactggccattgtgataccctttatctatgagagaaacatggcagggactatcctcctggctatagagcccttcagcccagactgcagacatatctttttcatacagcctaatttcagcatgacctttgtcttcccagcacctcccacctgtacagcactaccccatgtacctgggcccctaatctgcctcctgctgagggaaagggggagctgtgatatgtggaggagaggaagggaagacacacaggagtgaagccctggggagcagtttgcttgtgtccccaaagcaggggcggggcagcgtcgttgtgtatcaccagggcaaccagggcacaactcccctctgtccctccctggtcatggagctcagagccctggccattagcagactcctgtccctgttttcctctagcaagtttctctcatggagggcaaaggctgtttgtgttctttctggtacatttcacatgtaatgtacaccacagcagtggcctaagcatccgtcttaaaattctttcccccccttgtttttttacttccatctaatctctgccttagatttctttaaagggtttaattgcctttgcatcacctaagatcatcatttgaaaaaaatattgcttaaaaatttagaaataatttagaataagcagcactgatgtctttatcttgcttcctttaggggaaatttgggatgcagatttgtttgtttggcccatagtttttttttaaactatacatgtaaatatcaggagaatccacatagtagtctcgatttcatatttctctagaaaaatatgaaaatgtggtaatactggcttggctttccctcttgaaagcaaaccattggagtggaagagatgccaccccattcatacgtaccccttcttccccagatgaagccttggcagatcacctacatctactgagtctcaggtctcttaaccataaaacaggacaataaccaagacctcacaggttgttagtagatcacatggaatcaaagcaccttgcacaatgtctgataccaggtagggaagcagtcagtgtaggttgctgtcctccaaacagctggtatctagggttaggaggaaagggtgttttaggaaagtgtcttcgggacatcagtagaagttacttggaaggaacttggaattcactgggatcattcatgtatcttgtaatatggacctcgcagaaaccttgtcactctaaactcctttctttcttgccccacatccataacatcaataaatcatggcagctctactttcaggacatacctggaattcgatcgctcctcaccactctgacccagggcaccatcatctcttacctgattatggaactggtctcccagcttcgcttcctgcttcttcccgtgaccccctgcacccttactccacacgaccaccagcatgctaacgccaagagcttgtcaggcctcctctcaaagccccggttggctctccatgttgtccgggtaaacccaccgctctcgccatgtcctacaggccctcatcacctagctgcttgttccctctttgacctcatttcccaccaccctcccgccagctttgtctgttccttttctctcccgtctagcttccttcttataccctgagccttactatcatctcacgcactatgtgttttacttacttgtcttgttatttctctacccagttgaatgcaagctctgagtggggatttttgactgtgtgttcactactgtactactgtatccccagatccctgaacaggatgcagcatttcagtgggtgccccatacatgtttgttgatgaaggaatgaaagtgaatcaaagcaggaccgaatgtggcattcttctttgcaaagcaaagctatcaagtaatgcagcaaattaacatttgttatttttatagaggcagttagctcctgtgatggaactgagagcaataaagggaaaattacaggtcctttaatattttcatttgacttaatgtaagagccactcaggaacgctgcttgttaccctttggatgtaacctctgttaattcagccgggcttgctcccttgaaacgtacatttggtagggcacactgggagttgcttgagcttttgtttttttcttttctttttctttatcttattgtttttgaagactgccaaagaaaattagtagaaatgattctacactgaaagaatagtttctgcttcactagagtgaagtagatccttttacagatacaaaaataagtaaatgtttaccctattgttaagatgctttatggtttctcgcctataaaaagcctttcatttgtatcatgtagccaacatatttattatgcctctactgtgtgccaagtgctttgtaagatatagagagaagtagtgaaacaaagtacttgcattgttttactacttgagtaactttaattggatttcaattacaattggatcacttgcaatttagttggagagataatgcaggttcagaagaagttacaagaggaggtgtgtcagtacaataacagagccccagctttaacagcagttggggctagaatatgccgcaggttggccttggcttctcaaagcaatgctcctatttattcagctgtgaagcaggtattgctatttcctctttattgattagtgaaccgagatgcagggagtctcagtagctggcccaggatcaccaggtgagaccacacagtgggagaaactgatttttttttttttttttgagacggagtcttgctctgtctcccaggctggagtgcagtggcatgacctcagcacactgcaacatccaccacctgggttcaagaaattctcctgtctcagcctcccaagtagctgggactacaggtgcccaccaccatgcccggctaatttttatatttttagtagagacagggtttcaccatattggtcaggctggtttgagctcctgacctcaggtgatccacccaccttggcctcccgaagtgctgacattacaggcttgagccaacatgccgggcccagaaactgaattttaactgagatcactggacccaaggtcatttctttttctgatcaaacatggctcagaaggggccatggtagctgtgaagagggaatgatcataccttgcttgggataggcccccaaatctggccataaactggccccaaaactggccataaacaaaatctctgcagcactgtgacatgatcatgatggccatgacgcccacgctgaaggttgtgggtttacccagggtggaaaaccgcttaaaggcattcctgaatcacaaacaatagcatgagcgatctgtgccttaaggacatgtttctgctgcagataactagccagagcctatccctttgttttgccccatccctttgttttccataaggaatacttttagttaatctataatagaaactgtttatcactggcttactgtaaataaatatgtgggtaaatctctgttcatggctctaagctctgaaggctgtgagtcccctgatttcccattccacatgctatatttctgtgtgtgtgtctttaactcctctagcgctgctgggttagggtctccacgaccaagctggtctcagcaatatgtgcagcgaaagacatcagagaaatgtgaatggctttacacagacctcaagggatatagttggttccttgggacaagtgtcagggcagtgaacagaattagggaggtggtaaagatggcatgctgaggacagctgtaggcttgtccgcagtttggttatgtgtttattgttagtggtggagggatgataaggtttgggggaactttgcagaatcgttccacttttgggaccctttctaacttatgagagccgagtttatagaaaggagccatttggggccaggcgtggtggcttatgcctgtaatcttagcacattgggaggccaaggtgggtagatcacctgaggtcaggagttcaagaccagcctggccaacatggtaaaacctcatctttactaaaaatacaaaattagccgggcatggtggcgcacgcctggaattccagctactagggaggctgaggcaggagaatcacttgaacataggaggtagaggttgcagtgagctgagatcatgccattgcactctagcctgggtgacaagagaggaactccatctcaaaaaaaaaaaaaagaaaaagaaaaagaaaagaaaagaaaggaggcattgggcttccaagattcttaaattattctctcttggttgagaaagacagtttggcataatttatttatatttgaaaattcccttagctttagggaactggagagcttgccatgggaatcagaggagacctggtaacctagccctatgataatgatatttaccgcattctcctgaatataagacaactggtgagaagattccgtctcaaaatatccctcctgtttataaatgaacttttaaggctatactgcaaataggtgaatgtcaacttacaatattagtgtattaatttagtaacattttgaaatcgcttataatataaaattatatcttaccttcgaggtgggacatttttactcttacattttatgaaagttatattagtctttcacatgcatctatggccttgtggtcattgtcctcaatagagccaccttttgagttatcccacttagttttccagggaacttctgagagacaggactagctggatttcctaggctgactaggaattcttaagcctagctggggaaggtgaccgcacccacctttaaacacggagcttgtaactcagctcacacccaaccaatcaggtagtaaagagggctcactaaaatacaaattaggctaagagcaggaggtaaagaaatagtcaaatcatctatcatctgagagcacagggggagggacaatgattgggatataaaccccaggcattcgagccgggagtgggcaaccccctttgggtcccctcccattgtatgggagctctgttttcactctattaaagcttgcaactgcacactcttctggtctgtgtttgttctggctcaagctgagctttcactcaccatccaccactgctgaatgccgccatcacagacccgctgctgacttctacccctccagatctggcagggtgtgggctgtgctcctgatccagcgaggcatccgttgctgctcctgattgggctaaaggctcaccattgttcctgcacagctaagtgcctgggttcgtcctaatcaagctgaacactagtcgctgggttccacggttctcttctgtgatccacagcttctaatagagctataacactcaccgcatggctcaaggttccattccttggaatctgtgaggccaagaaccccgggtcagagaacaaaaggcccacctcatcttgggagctggaagaacaaagaccccccagtaacacttcaacactccatcaatgtcatttcagataaagcactctttgaagccctgtgtgatagtgtcccttgaaattttatttcgagcaacaagaactcattaagacagtttactgtttttatccattctgtgattgttggtgatttccacccactgaattgttttaagtgatctctaaaatcttgcctatgaggaggtccaacatttgcaattttgtgttcacaggtgccctttctgggcatataaaactggcattgattaaggatgtatcaggttggtgtgtttacgccaaactaaactttcacatactcaattaataattgagagctacgtaatatgaaatactgtgtcagcaatcaaatgcaaagcctgtattcttagagatataattttaataaaacctcatcttcaggttgggcagaaacagtattctacaaaattgttgtgatgaaataactagtggcaagaatacatgacattttatgtgaccattatggtttggatgcagctgttttgatgctcggggtaggttgacacagtctggaagccaagccattaaacattctgctatttaaaaaaattaccaactagtgtatgagacaggcaatcttatccaatatgtaagctttacagtcacatcaaccctgagatgaggattaaggtaaaagtaggaatgagagatggaatgaggaattcggtgggattcagagatgggtaagtgatggtgtgagaattagatgcaatctagaagtaaaattatacctcaccaagagttgagtgttgaccatattcatttattctagaaaaggatattgcttgttctttatgaagtgttctgctcacacttgcagtttttatggtctgaatctctgattatcttatttctactttaatgttggatagtcagacttcaatatcaattaaatttattagttgaaattggaatttgatcaataggaatatggtattttctattctaaagaatggactcacctacttttgtgagttttaattatatgattaaaatcataattattcttataatttcttgttaaattattatttcaattaattatatttgtttgactgtgtagtagtcagtggttgtttgggggcaggagagggtgtggaggagggtgtttgaacttcagatgcccattaagtattcaattaatttttaacaattatggcctcaatcctagtaaaatatatattcaagttagtattacaagtcttctttataatgatagtttggaagtaataataacatttagaatcaaagccagttctaataggttttctgaaaatatctgttttttccccccgattatctttttttttctaataaatacacataactcttaatccaatatggtgccccataattggagagttggttaggttcagaacagaggcagggatgtgagtagtgcatattggcaaaaattttaaaaaaggagttttacatcttgacaggctcattttgatgtggtgccattaacatgtctggcacatacagtagacatttagtaaattttagtgccctttgttttcccagatcagttcaccaagaaaggaaaagcagtatggtgattacacatatgcctggtgttctgaagctttcttatatctaggaaaccaagatttaatggagaagattcaagatgatatggatccccactatgtatggcttattgagagagcgatgcagaactaaagttgggagaaaaatactatttgggataagatggaagatattatcccatcttccatcttaattaatagtaattaataaggccaggcgtggtagctcacgcctgtaatcctagcattttgggaggccgagacagctgatcacttgagctcagaagtttgagaccagcctggacaacatggccaaaccccatctctagaaaaagatacaaaaacattagccaggtgaggtggcgcacacctgtagtccacctacttgggaggcagaggtggggggatcgcttgagcccaggaggtcgaggctgcagtgaaccgagatcacgccactgcattgcagcctgggtgaaaaagtaagaccctatctctctctcacacacacacgcgcacacacacacacacacacacacacacacacacacagtaattaataagctgtttaaagttcagcattttgaagctgtggagcctagctgatcacccacgattatagaggagattaatattagagtaaatactgtaggttagggttagagaatgagcaccgttggcagcacaattattatgacagttttcttttggaatggactgaagacattggcatacacatggtatgatgtttcagtatatcaaatcagggccattcttgcaccaccttcttgtactatttgaaggttttttccattatgtaagacatttgctaattaaatattttcttcaaagaattaagttcagaggacttacctttgcatttcccagccccctgtgaatatcttaggttataacatagtgctttctcgtttgcaaactttcattatttaactgtcaaaatctccccaaataccctttcaggtgatttcagtacaaaatgtgatccaaatatcagagagccttttattacctggacttaaataccacagataactcagggagtttaagctgacagtttctcctggaaccacctcttctgaagcacgtttagatcgatgtcaagattggtttttgctggcactaaatagtcacagctttgaaacctcctgacccacctgccccaggaaacattagcacccagagctgtttcctaatattaaaggtgctttgaagtacagtaaacagtgtcgactcagtgtccagatgagcatggccacagctccttgatttgtttattctcttcaggagcgaaaaaagttataaaattggtgagagccccacagtctcagattttaaccagatattgcacaggtactggtcattttattcattagcacactagagattcagaataggtgtggattttatgtgtgtgtgtgtgtgtgtgtgtgtgtatttacacaattcctaatatttgggtcaataatacttgggaccaaagtgtgtgataggagaaataatgcagacttcgaagttaggacaacctggtttctaatctagactctgctgaacaagccatgaaatctctctaaacctctgtttcttcatctgcaagttgaagataaaatagatctatcctgttggagatgaaagagaagacatgtaaagtgcttagcacagggtgcaggatagcacagatcatcaataaatagtcatgatgaggataatgatgagaagcagaactgggacctgtgtcccctacttggtgtggccgaatgtagactgtgtgtacctttgtgtttctggttggagccacctgctgtcacttgtactctgcatcagctctagacccctccttccatgtcagaccttgtatttttacatgaatgtgatatatatatatgagaaaagatcagtctatgttgcttagagctaactcactagcaattggccctttcatatcttgatttgttgcaaatgtgagttactgtttagagtagttttgaaattgagcagatgctgttgagttgatatattctgtgattggtaccacaaggtagaagaatctatgttattatagaaaatacaaaatttgagacaccactgtagttctgacagaaggcttgttttgctcagagaatgcccttttaaaaattctgatgagattgacatgtgacacaagaatggcagaatgttgataaggggttgaagctgggtaaacggtttgtgggggttctttatactgttctctttacttacgtgttcgttggaaaatttccacgatgaaaattttcatatttaaacaaatgctgggatggttgccttcctgttgaaatatttggaagtccaggcatattttagttccatgtctggacttcatgtggccatcttttaggtgtaatttaatgtagcatgccattatttgtaggataagattattttaaagggtgaaaaaggtgaaagctaaattcaaaagaaatgtgtgaaagttatctcagtgcaaagagatgaagcttagaaaaaaatctctcaggctagctgctacttcactatcccctggtttaaggattatgtaaatgaaatcttctgtgtatccacagctatgcatacatttatacttaatgttcccatcagaagaagtaatcagtgctgaagcattattgagatttagaaattctaccatataccacactcaaatggtgaaaaatgtttcaaaaatagcccttgctgcatttaaatagcctattaagagtagacaggaaaattccactggcacggtggaccgtgaggctattggacagatccatgtattaaaagcttaggctaaatttggctctgtggtgtgtaaaataacagcagaacctagtataaagcactttttctgcattgtttcctcaaagatccatatgtgtaaagggaatgtatttttcttaagccaggcttgtgtcgtcaggacctggtactacagatgacttgagcgcggctgtcaccatcaaatgacagcatcttcttactttgcaaaagcccctgtgagtgccctagttagcagagtttatgcatctccactccccactagctgggagctagtggccaagtcatattccctactgtatgtcctgccaactggagaaaggatacttgttcccttctttctcagagtaatggctaagggcatccacctcgagtcagacctgagtctggcactgcctcctaatagttttgaaacacatggccttgtagattctcagaatcctcactgtaaaaatggaataatagtggtatctatgccatggggttcttgtgaggggaaatgagatacttcttacttaactggcaccccgtaaataaacagttgtgtgaattgtgatgatgattatgatgatgaatcatggactgagaagtctgagggttggaacatgtagcttgctgtttcccaaggttggaaattgccacctttcttggttgtcatggagaattcagagatgaactttgtaattcttactcagaagggataggaaatttttgtttaaagcttgaagcacgtgggagaaatgtagacctgatggctatttgaaatacacatatgcccttgcacactggattcaagcccgatatttacataatggccattttatttaggtagaagttgcaagatttcagctccatctgctcaggtctctgctgaggcagtgatggaatcaggccgtgtgccccggagagtgcagagggaaaatttccaggaaggctgatgcctgggaatgttgattccctagttctctcgtcagaaactggccttccaaatctctaggaggttcttttccttttctgccacatgacgtgattcatgatcatatgccaagagtgacctaccagttcaggaatggcatatctctgcagggagctttgatttttggcagaataactgccttcaggggacatcccctcatggacggcattgtcagaaaaggacggtgttaggtggtagtaaatgactaacctcactgcggcgacatctcatgaacatgaccacatcttgaatgatattcaggcctcaaagcaatgacagccatgcagcagtgccacatttcttactaaacgaaaccatatcctactaaaacttcctactaccagggctccttgcagaaatagctgattctaggtgtgggtaggaaatgtataagatgcatctggaatagcttgttatcccctgaagcaaggaggctgtcaaagactacctggagtcacttcaaaaggacacagaggccaacatgaaggtgctcccagtagcctgaaatgctgcaataagagcatgaaaggacaatgactaaaatgaattgaaacaagtcaaatatataaaaacaaatgggctcttaatgaccttatttttttaaaaaaagaaatgcacatgtaaaaataaactggttataagcaagtcttttccatggatttagattgttgctaatcaaattctaaaccccggaaacacatgaccatcctgtctctctctaaccctgtcattatagagcagaactcagtaagttcagagatgtgtcaatggcaatggtagtagcagggttctttagggatatttttcaagagttgttactcactggaaggaagattataggacttggtgggtagtaagcagtgcaggggcttctggcccccctcactctgcctccagggcacccagtgcatggctgacacagctttatccctctctattgcagttttgttcagaatttgtttccctagtggactgtgagcttccctgggggcaggggctctgctttattttctttagtattcttattgtccaccacagtgcctggcacacaatagcatttaggaaataaatacctgatagaatatgtctatcctgtacagaggggttcatcctcaaaatgaatgcagaaggcttcactatgaatgtctacatgtaagtattgtctcaataaatcctttattctctcttgctttgaacaagtgttttcatattattatttcaagtttaagtattaaaaggtgtgtggcttgtgcttagttactgaaatactaaaaaaaattcactatttattgaatagctacttttcgctaggctttctattaggttctttgtatagcatattttatttgattgtcacgaacttatgaaatctctacttgaaagattgaagaataaagtctcagaggtgtcaagtatgttgccaaagtcactgaactaggaagtgggcaagcccaggtctgttgatttctaaagttatctgttctttttactacacagagatacagaaatgtaatcttgggctcttcatatgttttgagtgaaagggagctctgatgcatattatccttgaaaatgaataaacgggatggtggtgattcttttaaccttaatcttttattaaaataattccctattcccatcagtaataaaccatgagattgtcaatacattgttgactcttatgtgtggtgaaccattctaaactaaatttccccttagacaaaaatataataatgctaaagagaatttgaatctatggaccaaattgtgcttgagtgaaggatggtcttattcattttgacatccggccctgaataaataaggttgtttcaggctagagcttttcagacagtcacatattgcactgaatagaatcagcttttgactaggaccctgtgcgtccccgatgtgacttctgaggctaaagctttgctataagtatatgcatgcatgtctgtctgtctactcagccattctcaaactttttgatctcaggacctctttacaactcttaaaaacacctccaaagaattgtagtttattttggttatattcattagtatttcccatattagaaattaaaaacatttaaaacgtaatacacaagcacacatctcattagctgtcagtacaggatgtcatctatatgtcatggaatctttgaacaactctgccataaacttatgaaagaataagagtagttttgactctgttgatgcatggaaagctcttgggaacccctcaggggtgcctggacatgatctaataattcctgatctatatgcttttttatttctcctcttctatcttgaacccaccctagtcaggctttctacatgaccatggcacttaaactgctgtcaaggtcatcagtgacctccaccttgtttaattaagtggtcacttctccatctcttagaattatttggcacaatatatcatttacccatccttgaactattttcttcatttggcttccagggtactagactcaattcctttttagctggttcctttttatctctttgacttcttaatgttggagtttcccatggctcaggcttcgggcttcttttctttttttaatctatgttattcactctgtggggacatcattcaacctcatgtttttatataccaggcatgtatttccagcctcagcctctcttctgaacttgagatctgtgtatccagctgcctacttgacatctcttcttaggcatctaatagcatctcaaacttagtgcatgaaaaaatgagcaccccatctccgtcttctgcaaacctcttccccctatagtcgttttcacctcagcaaatcccatctttcaggttgctcagtccagaaacatggagtcattctcgaggccttctttcatgcttctcatctcgtccatcagccaagctcatctgcatcaaattctaaaatagatgtagaatgctaccatttttacacctccactactaccaacaccgtaacatcctgcctgagttactgcagagcctcttaaccgtcccttgtcctttccttgctccactagaatctcttcttcacacagccatcagtctgttcctgttaaaaggtgagtgaggctctatcgtgtcccaaacatatcagcaacttttcatgtcactcagaaagaaagccaaggttctttaaaaaggcccacaaaaccccatctgacctgatccctacttccattacctcttataacccttccctgccagttcccctctacccacactgacatccttgtgggacctctgggcttttgcacttacagtgtcatcgtcctagagtgcccgtccccatttatctggagggttcactctgttgtcgaccttagatcattattcaaatatcagcttctcaagtgaggccttcccttaatacccattttaagattgcaattcctccaacactctttcccccctttcctgctttatttttctccctggcacttttttttgccatttaatgtatgacgtattttaattattatttaaaataattgcctctcattttccaaccacagctgaacaatctattatgacagccatttcttttgtctgttcttctattgctcctcagccttgagtgtgcctggcacctactagagtattagtaaatatttgaagtgaatgaatgaatggaaagtagaccattttatgtcttcatgttgagaaataatttataaacatatcaaagaaatataataggcttaacccagtctaaactccaagtttttccagagtatgcaaaataaggtataattgaaaaaagtcttttgtaataagatgtgactttgatcaaaggaatgtcctaattttattctgaggttaaagtacagacttatacctacaaagttaggtgctttgggcataaatggattttgtggtagaggaacttcagtgtggggctctgctttgagaacaagtacaactattcctgacttctcagacccttatcgtcatcgtcatcatcatcatcatcatcatcatcatcatcatcatcatcatcccatatctcttggacttctcatcctcaggtcatagcactgatatggagggtgaatatcacaggctgaggaaagtgggccagctacaaatctggtccattcgtacagagcatcatgcctaatactcctggggtttggcgaccccaggcttgatatgggaggacgtccaacctggagagtgggccacaggggtttggtgatgtcaatagatgttgtgcaaaaagaggtgaagttcaagagaaactaatctgggaggtaatcagttaaagtttctgttttcccagggcctttattttgcgattgtgcattgtaaacccctaataaggagataaagaatgcagggttttacatgcttaatggaattcagagccttttgttcttgtagcatctcactgggggaattcaggaatataataatgaagctttactatttatatttgttaatttttttcatctttcctctggcctccaatattaggaagagaaaggcataaaaagtaagtagaaaagtcttataattaagcattttttcctagtttgggatcaaaatctaggagggtattttatttatgtaaaattgatgtagtgctctgatgagaatctgtaaatgtatgtgagcatcagaagtcgactggacattttggagattaacattttggagattcatcaatgtgtttatgtgacagtgctttttacctgagtgtttattcatgagtctgggactggtatgcattttctggcgaacattgtgtacattttcttgatcttttgtgtttctctttccctaggcataatttacacaaaaggtttggtgagagaggagctagctcaatgttacatttaggttatgtagggattaacatcaatacttcagatttggtacagatataaaagatgtcttcccatgatcaactttgattatttcattctcctctaaggaattattctgggagtacaacaattgacataaatgtcattgcacttgtgacacaactgttgcctcttttgtaagaagagttttggaccaggcatttcttaagtcttaggatattgagttatctcttaagatttcacttcataccaaccgatacctgaacataagtcaagataatatacactaacaattgtagctactgctctggagaagatagcctatacttgatgtatattacattgtaaagcaacttaggatttgtgggtttggaaatgaagccaacttgattggtttgtcacccatacctacgttgaagcttaaggatgctgatctgggaagaatggcactggaagggaaagcaaagccaacaggtggtagagagtctggccatgtttccactggaccaacatcccagtggagagtggccactggagacagccctggactggggccaagaatgggtgttttggtctctccccttgtcaaagacactgcacactacagaacagctagaaaccggtgatggacaccagcacagcaggtatggaaatctcttctgggtgttttgtggtctttctatctgtccttagttggcttagagttgtagttcttgcagtttggtctagggactcctggggcagcccaagaccctttcaggggctttgtgaggccagcattattttcataataacactaagatatgatttgctttcatcactctcattctcttacaagtgtacaatggagttttccagaagctgtatgacatgcaatatctcaacagattcaaagcagaagtaaataaaagaatctagctgttttttattaggctggagagtaaacagtaaagatatttgtaaaaatgtaagaaaaaaccattaaaatgtcataagatgttattatattgacatgtgatgagtttgttaggggtttctttaatttgttttttgtattttttagaaacagggtctcactctgtagctcaagctggagtgcagtggtgtgatcataactcactgcaacccaaactcctgggcttaagtgatcctcctgccttagcctcccaagtagctagaactgcaggcacatgccacagcatgtggttaatttaaaaaataattgttatcatagtgatgggggtcttgctatgttacccaggctgttctcaaactcctggcttcaaaaaatcttcccaccttggcctcccaaagggttgagattacagatgtgaggctctgcagttcacctattgtgagtttaaatgatgcaatatttaaaaaaaattttcgttaaaatctaatatgataaatactaacatatcacttgcataagccaaagttctttgggaattgttttctgcacatgtatttcccaaatattgcatgtatttttatttactaaatctaacaacataacttgctaagtccttgtatttgcagtaggttttagcacctgctgtttggggagagggtggagacactgcaattcttcttactgcctgttcagtgggtactggaaccaactttaataagtaattgcacacttgattattcttgatgtctttctttctgactttgcagtggtgggtatgattttctcctggaaaagtttgggggctactggaagggcatcacctataagcgtgtggcagtgtcaacaactgatttcagcccaatctctgtcatttatcactaagtacagtgtagtcgtgtgttgtcacttatagcagagcctgcacaggtgacgcagctattgtgtttgtttccaatgttaagcccttggtatttgctaagagggatgtagagatgacttccaagaggcttcacaggtattatcttgactcattcattcattcatttctcctttcctcttttatgttccgtcttccctcctcctttccttcctttcttcctgtcttctttctctttttccctcccttcctccttctctttctctcccttccttccttttttcttccttccttccctcccttgtgcccttccttcttttctcctttccttctcttcttccctccctctttctctttttttctttctttccttcctccctcccttctcctctctcaccacctccctattatttgttcaacagctgtttgctgcattcattctgtggtgtatgagacactatgttaagtgctggttttcaggagaaaacaaaaaaggtgatattcttgccttcaggaaacttggtcagtatccagaattctttgcagtcaacttacgctaatcaaactcgcaagggaataaagaatctaaaccacaatggtaatgtgctagttcagagtggggtggcattccagtggataccctttcttagcatctgcttatggagaagcgaagactcgtatgagaacttgtaactgacagggcgggggctggaactacagcctagggatgaagagggaggtcatgggagtaaggcgatttactccactgcatgcagtttggagacctggccacaggtgtacatttgtccacatgcttctcttgttattttgattttccaaattagtttttggatgtcatttgttcagcagtttttagaaaaattataataaagtagcatatcctctgcctatgcctgctacataaacatctatttctgaatttctgaattacacactggtacagttgacttgtatgtagactagaaaagaataaggtggttgaccagaaccccatataaatcctctttaagaaataataataatcactactagctatcaaaagcatatcatgagccctagatgtattatttcatttggtttctcggaacagcccggccaggtagatattatcatttcctttgtatagatgggaaaactaatttcaggaagcttaaatgacttgcccaaggtcacacaactgttgattagcagggtccggattctgactgtaagtccagctttgtaaccacatgcctagcacattgtccctgtgttagacatagtaaagacttaagtgagatctctcaggcatgagtctgggggttctgtctcgtttctttagcctgttttaaaaaaacataaaaatagaaaagaacaatgagcaacccccatgccctattcttttgcctttatctcctatattctgataaataagacaaagatcatgattatctggccatctaattcacacttttctccagttttctcctgaaaaccagcacttaacatacgatttcctggaaggcctcagatggttaattctaggaattctcgggtggctaagtatgaaaacaagaaaaataatgaagatagagcagcaatacattataatgaaaattgccatagtttagtatctgaggatattaaatcaaacatgaaggactgttgtgtggagaagggattattacttctgccctggggatataaactaagaggaccaataaaaagaattataagcatgagtcgtggagctcaatattaagaagttgttttgttttgtttgttcatttatttgttttttaattagacctttccaaagtaatatggactcctttgaaaggtttgaattctccagcaatgatggttacatcaaaggcatgttgcgaaggtgtttggttgtcaattgtgttctttatgtcctgtgatcttacatagcaccacatctcaataggtgttcaggaactctagtcactaggcagtctatcccagaggcttataaaatgtttgccaacttagaattcgaaggctccttttaagagagtaacttacagaagctaaataaaaactataacagtggtggaggaagttccagggggtgcctttgccaccatatccctaccaggttaggaaaggcagggcagccacttctctgcttggctctgatttcaggtgaattccccttaggaatagaatgaaagtgagtagcagagcctgggcagcgatcgagaggtggagatgaacaaagtggaaggagcatcaagacggctgtattagtccattttcatgctgctataaagaactgcccaagactgggtaatttgtaggagaaagaggtttaattgactcacagttcagcatggctggggaggcctcaggacacttataataatggtggaaggggaagtaaacatgtccttcttcacatgacagcaggaaggagaggtttaaatgaactttgtttgagaggtttgagtgaaatgttataaaaccatcagatcttatgagaactcactaactatcatgagaatagcatgagggtaactgcccccatgatgtaatcacctcccatgtggtccctcccccaacacatggggattacaatttaagatgagatttgggtggggacacagccaaaccaaataaatgtcctttggagacttcccttagaatccttgctttgacaatataatgctcattctccattttctacattcataaacattttgaaaattaatatttaattataccagtattaatgactgtattatctaggttaaaaaaattaaactgttatagataagactaaatattttttggtactatatccccagtgcccaatggagggtctatatagagtagagttgaaagtacgtatttgttcatgtttgaaagatgcaacaggaaacttgagatctgggtatacttacacttttccatcactgtgaaatgttttaatagtgattttttttttttttttttttttttagacagagtctcggtctgtcaccaggctggagtgcagtggcgcaatcttggctcactacaaactccacctcctgggttcaagtgatactcctgcctcagcctcctgagtagctgggactataggtgtgtgccaccatgcccagctaatttttgtatttttagtagagacggggtttcaccatgttgaccaggaaggtcttgatctcttcacctcgtgatctgcccgccccggcctcccaaagtgctaggattacaggtgtgagccacggcgcctggccttaatagtgatttttattaaggtaatagtattgaatgataaatttggaaggcctagaaaaaaatagaatagaagaataaaaatctcacccatcgtcctaccacatgaacataatgttgataatcactcctgttattcttttatttatccctaaatatttattcttgtaataagtgttctttgttacatttttcaggccacccgttttctctcccttgtaagtggcagaggctgtgtgaacagcagctgcaattgcaaatctcatttcagcttcctaaatcttgtaattagaggaaatcctaatgagggagcaatagtttggctgaaattctaattttcagtgttgttctgggtgttcatttgcatcttgaggatcctgctgtttgagaggggccgctggagagcatgactcatggtctgccggccagatgccgtggggagcagaagtctccagtggagaggttttgataaatcacctctcagttgtcttagttattgaatctgtaagtgtgcaatgggaataacagactgcttcatctctgtcgtctggcacatatgtgatgtcaaggaaaataagaatatatgtgataaagttggcatcactcgttgtgggaaatcaagatgattcagtaatgttgctagggttgttagctgactgttcaggatagcaaaaaacaaaattttacacctttgccttatacttaacatcaaaatccattccagaggcagcatggcattgtgtttgagcactgaaatctatgtagaacctggactccagtccaagctgtgccacttattagcaagtggtcaagttacttcacctctataggcctctatttcctcatctgtaaaatggggatgataatagtagctacttccttaggacagtcatgaaaattaaatgagttactacattagttactatttagaactataatctaaaacaatatttggcacaaagcaggttccatacaattgtttggtattattaagtgctttaaagcattaactatttttattgaaagaaaccatgaaataatcagaaggaaatataaattaatcagaaggaaaaataaattcagatcaggagagtctccctaagcatgcaatcagtgcaaaaaaccacagagggctgatagatttgactacatgaacattagaagtctgtattgtatatgtcaagaaagcaaagtataaattttagaatattgaaaagtaaataaagacacacaatagttacaacatgtctgaaaaacatggagttaataggctttaaacccaatatgctgtgacaccaaagctcacaccttggattcatgttatattttggttgtcattagcccatgttcaaaattatgcttgtgtgccactcataggagtgtatgtatgtgtatacatacatgtatgtatttctttcctgctttatccataaactgtttaagtcagtttacaataatacaaaaggtacaaaatagcaaaaattaaaaacaagaaaaaagaaaaagtagaaaccatgtaaggaggactgaggctgaaccagtttggccatgatggagagtgtgacatgggaagcccgagcagtgccacagcccagtgtccacaagccccagtctttgtaattacatcagggaggtacaaatatttttgatattgacaacagcagaaaatttcttttcagagccttcaaaagagagtacggactatgtaatgaatcggaatcttgacaccattttgtcaataacactaatcatgatgacatatttcattctctgggtgtaggagatgctaccacaccaaggcagggtacagtaaggcgctttttgctgttggggatgctgatattgtgctggagcttggaggccacggtcctgggcctgcttgtcttcagaggccatgctcacgcttcctctgccctctgtgttgggggtgggatggacactgcaggctgttcctatcccacactccctgttggttggcttcttggcttctggctgggattggccaatgagaggtcctgctgggagaccagagggtcagaggaagtgagaaaacaaggtcttcctcctgctcccacttcacattgggtggctgctttaccagcagcttcccatggactggcttctggtgccagcttctttcaggtgatcttggcccttgggctcattaataacatcacctcctccctgatcccttcagctcagatatgggaacagccttccacatttgctaatctttggaatacctgactcttccttattggcttttcagcccctgcatcccctgtacagtcgtgtgtggcataatgatgagggtaaaatgaggagaaatcgttaggcaattttattgttgtgtgagcatcatggattgtacttaagcagacctagatggtagcacctactgtacaccagggctgtatagcatagcctgttgctcctggggtacacacctgaaccatatgtttctgcactgaatactgtagataactgtaggacagtggtaaggatttgtgtatctaaacatagaaaaggcacaataaaaatatggtataaaagataaaaaatggtacacctggccaggtgtggtggctcacacctgtaatcccagcactttgggaggctgaagtgggcggatcacctgaggtcgggagtttgacaccagcctgaccaacatggagaaaccccgtctctactaaaaatacaaaattagccaggcatggtggcacatgcctgtaatcccagctacttgggaggctgaggcaggagaatcacttgaacctgggaggcagaggttgcggtgagctgagattgtgccattgcactccagcctgggcaagaagagcaaaactccatctcaaaaaaaaaaaaagataaacgtgtatagggtacttatcatgaatggagcttgcaggactggatgttgctctgggtgagcaatgagtgagtggtgagtgaatgtgaaggcctagggcagcacatgactgtagataataaacactgtacacttaagctatgctaaatttatcaaaatcatacttctctttcttcactataaccttagctcacagtaacattttactttataaacattttaatttttagaggttttttgtaataacagctccaaacaaacacattgtacacctgtacaaaaatattttctttctttatatccttattctataagcttttttctagttttaaatttatatataagtataaatatatatatttatatagaatatatatattttatagaatatatattttatagaatatatttatatagaatatatattttatagaatatattccatatattctatataaatatattctataaatattctatatataaatatatatattctatatatatagaatatatataaatatataaaaatatatatattctatatgtaaatatatattctatatataaatatatatattctatatataaatatatatttctatatataaatatatatattctatatataaatatatataaatatatatataaatatatatttaatatatatttataattatatatataattaatatataaaaatatataaataattatatataaatatatatattcatatataaaaatatatataaatatatatattcataaatatataaaaatatatatattcatatatactggatatatgaatggatatattcaatatatgaatatataattcgatacannnnnnnnnnnnnnnnnnnntatgaatatatatattctatatatatgaatatatatatattgaatatatatatattctatatatatattctatatatataaatatatatatatatataaatttttttgttaaaaactgagacgcacacacattagcctaggcctacacagggtcaggatcaccagtatcactgtcttccacctccacgccttgtcctactggaaggttttcagggcactaacatacatgcagctgtcatctcctaggacaacaatgccttcttttggaaggtacacctcctgaaggacctgcccaaggctgacttacagttatttttttttaatcgatgggaattcaccctaatgataagaagtatagtaaatacagaaaccagtaacctagccattttttatcactatcattatgttctgtacataattgcatatgcaagacttttatatgcctggtagcatagcaggtttgtttccaccagcatcaccacaaacacgtgggtaatgcattgtgccatgatatcgctatggctgcaacatcactaggtggtaagaatttttcagctccactacaatcttatgggagtaccattagatatttgatctgtctttgacacaaaacattattatgcggctcatgactgtactgtaaatccttgaagtggtttctgcttttctgattgatacaaacatcagaactcactaatccaggaggtttctggatgatcatatgttgtctcactaatctgcaaaataaaaaccaatgagaagcttgaagactggcctcaccatcaagtctgcattgctaatataggattcattacttagtttaaaattgttctttgtgctacttctttgagtattattttctcaccaaaagactgcatttaggttgagattgagtcttgccaacagacttggagtcctgggcctccaattccaggactcgttaaggcaacttccgggcaggttgcagtgttataatctacttgaacatccatttacactcagtacagtgttgtgtaagatttttgctgtcatgtgagaattaccatttagattgaaaaaatgaaattcatttgtttcagtaatttatttccaagaaacttatgacctgacaaatgtaacataattatgatattttggttttctgtttttatgaaaattgcttccatttctatgttaataagaaagaacatatacataatatctcaaaagacctattaatgccacttttttattgcctctaaggctgtggtcagcctaatcaaaatggtactcataaccaacctctcacacggattactctgtttatacctccccacctgtcaaaaccctggctgggatttgcttttcatcccaaaactttctgaattctaacttccttgaaaatttcttttaaaaaagtgttttcattttatatatatatatgttatatcaatttattataaaatggaagcagccctattccagccattatttttctttatgttcctttttttttctgtttcggttctactatgctttgcactaacggcaagtacttctatcaggtggttctgtttttcatatgtgagttggtgtttgttttctttagatacaaaggtataatcacacaaatacgatatttgtaatatagatagatatgaatacacatattaaaattctagctatcattagaaattatgtgtatagtaatttaaaaaatactttttatgattgtaaattgcatacttagtgttcctaatttgggggcatttcttttttttttttaaacagtagaaaaagataagatgagagtatttgtacaaaagtcatttctgggttttagactattactttaggtagcataaattatttctcaactttcatatgatgcaggttatatttatcagcaaaaatagatgagggttggattacattatcattttaaaagtgtaatgttaaaacatgtagcttctaatggcaatatagttacagctgaacagcatggactttgctgttggaggaacctggtttctgagtctcattctgacccagatgttaccttgtgcctctctaagcatcagtttttatataactcaataataatagcatctgtatcacccattatgtagagctgttacaaaatcattgagtttcctttgggcaattcttacatgtttatagacccgccagtgtcagggttcagctctcattaattccattcccttccattggtccctcctgcacacatggcctaatgcaaactagatgtcttgctgctgggcacaaggtgtggtaagtcagtcatggtcctggagttggtgtggatattaggcactgcctgcacttctgtgcctgccccttatgcctgtgacagacatcaataatcaaatacagcactcttcctgttgcatcaaggagcaacttcagaataattagtatagtcatagtaaccgtaataatgcctcttcaccagttcagcagccatgtgtgataacacttatttgcttcagaatttggggagatattagctcaaacccattacagagtagtcatagctttagaaggaaggattctttttttttggagacggagtctcgctttgccgcccaggctggagtgcagtggcacaatctcggcttactgcaacctccacctcccaggttcatgccatcctcctgcgtcagcctcctgagtagctgggactacaggcacccaccaccatgcccagctaattttttgtatttttagtagagacggggtttcaccattttagccaagatggtctcgatctcctgacctcgtgatccgcctgcctcggcctcctaaaggattctttacatattaggaagtatacattatgtaaatggtgtacctaaattggcttaatttgaatttgcacgtaataccccaacagtaataaggaaaaattggttttgttttaaagttagtgtttcttaaaagcttggggagcgtgaagacacttggaaaagttaaattggaatgacatttattaaatctgtaggattttaggggtattgccaatgaaatctagatcaaaataatatgtaacaggaaaatataaatatgaataatagaatatataaatattttcattcatacttggtatattgttacagctgccttattaattttaagtgctatcaaaattttcaatatagattcaaatggagagtcataataatcacatgggttgattattattattactatggaggttagaggaatgatgtaaacacaaaactcaatttcctggcttaaaaactattctaattattttcaatttgagcttttctgaatagtgcaaagcagctaaaacataagcttttcctgcagttgaaagcttaggttagtaacatccatttgatgacaacatatttctgcatgggcagaaaggtactcttacagaatatgatttgaaggattcatggatagcaatgcattgtgataatagttctatctttgtgtattgtattttatttttttaatttttattatactttaagttctagggtacatgtgcacaatgtgtaggtttgttacataggtatatatgtgccacgttggtttgctgcacccatcaactcgtcatttatattaggtatttctcctaatgctatccatcccccagcccccaacccctgacaggccctgctgtgtgatgttcccgccctgtgtccatgtgttctcattgttcagctcccacctatgggtgagaacatgcggtgtttggttttctgtccttgtgatagtttgctgagaatgatggtttccagctttatccatgtccctgcaaaggacatgaactcatcctttcttatggctgcatagtattccatggtatatatgtgccacattttctttatccagtctatcattgatgagcatttcggttggttccaagtctttgctattgtgaatagtgctacaataaacatacatgtgcatatgtctttatggtagaatgatttataatcctttgggtatatgtccagtaatgggattgctgggtcaaatggtatttctagttctagatccttgaggaattgccacactgtcttccacaatggctgaactaatttacacgcccaccaacagtgtaaaagcgttcctatttctccacatcctctccagcatctgttgttgcctgactttttaatgatcaccattctaactggcatgagatgatatctcattgtggttttgatttgcatttctctgatggtcagtgatgatgagcattttttcatgtgtctgttggctgcataaatgtcttcttttgagaagtgtctgttcatatcctttacccactttttgatgttttttttcttgtacatttgtttaacttctttgtagattctggatattagccctttgtcagatgggtagatcgcaaaaattttctcgcattctgtaggttgcctgttcactctgatgatagtttcttttgctgtgcagaagctctttagtttaattagatcccatttgtctattttggcttttgttgccattgctttttgtgttttagtcatgaactctttgcctatgcctatgtcctgaatggtattgcctaggttttcttctacggtttttatggtgttaggtccttgcatattttaataactaatgacttgggaggctgaggcagaaggatctcttgagctaggagtttgaggccagcctgggtaacacagagagattgtctcaaaacaaaaaaaaacaataaacaagacaaaagaagacattaatgagtttcaagagattttgagctccttgatagcctgacaacattaggatgagatgcttttgtctcaaggtgcttttcccaaaatcattactattgtttttggtcatagcagttaagaagttttacctctaaataggtagaaaatactacaaaagcaaacaggtccctgaaataaaacaaaagcaaaaataaaaaacagagagtaagggaaaggagcaggtggtgggggacttaggaagaaagttttgaaaaaacacatttcttctaaaggtggtccctgttaatattttcatatgaagatatcttttctttgatttttaaatggaaagtgatagttttgtaaatgttgcattgactattatttcagtgtttttagcctagtagcattttctcttttaaatggaactgttttacaaaaagctgataaaactaggggaaaagataagaatgggtgatgactggttgaaagagagggatgggttgaaggaggtgaaggacccggaactcttgcagctcagcctccctttgctttcatctcccactgacgtgggaattgtgacctccccacccacccccactgaattgtgacctccccaccccccaaattcatatgttgaaaccctaacccctagcacctcagaatgtgactgtattcagagctagggccctgaaagaggtgattaagttaaaatgaggtcattaggatgggcactaatccaacataattagtgtccttataaaaagagattaggatttagactttactcagaaactatgaaagagcacgtgcacagaaaaaaagaccatgtgaagaggtatctagggagtagccacctgcaagccaaggagaaaccatcctgaggaaacagttgatggcacctcgatctcagacttccagtctgcagaactgtgagaaagtacatgtttgtgttttaagccacccagtctgtggtattttgttattgacagccctagcaaaccattatacacacttcttagcttaagaagcatagctcatgaaaacaggggcttggaataatatggcttgaaactctaaataaaattataataaatcatattaaattatttaaaggaatcatttatgtggacaaagtaggattcatcccaggaaggttcttttctttttttttttttttgagacggagtctcgctctgtcacccaggctggagtgcagtggcacgatctcggctcactgcaaactctgcctcccgggttcacgccattctcctgcctcagcctcccgagtagctgggactacaggcacccgccaccacgcccggctaattttttgtatttttagtagagacagggtttcaccgtgttagccaggatggtctcgatctcctgacctcgtgatccacccacctcagcctcccagagtgctgggattacaggtgtgagccactgcgcccggccggttcttttctttttatggtatgcatttatagataaaacttatgttcaccttgataaggttttttcaccacttcgacctacaaatagccattcttaattcagaaggatgcctgagaacagaggcagtatattaagtattgggaaggagacactttatttcctgtagatggtaattcactttccatctattaggtaataggagtgagctgaatatctgaggatttggatcatcccagcatctttgagggtctcctggttttgtgctgtcctttgttcatgatggtggccctgaggcatggcttgttccccatggtctttgggcaccagctctctggtccccaggtccacatgctcagtaccttctcttctcacctgtgctctgttcctcttacctcaccaccagccctcttaccaggtccaggtggccaccaccttgccacttgaggacttttctctgcagctgcttttctgtcaggctgttccacagccctcccatctctcacactgccctgcaagtgggtcacagtctgtatagtccctgatccctgcttgacgtgtgcaggggttctgtcacctcatctccactttagtccctgggtgatggtgatggagccccagacccatcatctgaaactacacagcatctaaaccctagttatgcccttgctttcacataatttgtggagatattttacttcaactacacatttaattaaaaatgctagggatttgttctaattcaatagagaaactgtgaaagaatagttaaggagaataaccctaaagaattatttcattattgtaaaaagttggaagcgacccaagtgtttgtcaagaagggaatgattgatcacaccagttggggtctattcatggggtaacatattatggagtgactaagatgcttgaaaaatgtgtggtgaggtgataacattcttaggatgtaatttgaaggaaaacatgattccagaagtgtaaaaataaataagtaatcgcagtaaaagaacataagaaaatatgtcaaatgctaatggtggtgtttgctggtctttgagataagaaatatttcttttctttagactttccatgttttggtaacagagcacttatatctaaatcagaattattcctaacacttttgggataatttttgttttcaaatatgattcatttaaaagtaatgtgtattattgctcttctcaaggtattttaaagtcatggatcatatgtaaatctttcattccccaaatatttactgagcccccaagagaaagactgtagctcacagctattcagatcctgggggccagattcttagactcaaaacccaattatagtactttttggttgtatgacttttggaaagttacttaagtcaggcctttccttttgtggagctcatagcctcctaggaaattgaggtgtgaatactcaccaaataccatagaatgaaataatttaatcatgatgtgtttattaaggcatctgacttagtaggttctcaaatagaatttgagaatagtatttgagaataagtgattgaaataaataaatgaaaaagaattggtttagagagtcttctccttacagaagactggttggttctatgggggcatttatgtgtgcaattaataggctgcccctgggtgaaccatggaaagtagttatccattcactcattcattcattcattcattcattcattcatcattcagtgcttaacaagtatctgcatgtgtagtgataggcctgaaaaatctctttctaatgccttttctttagaaaacacattttaattcaaataggaaaacataacatgcttaacaattggtttcccaactgggtgcaaatgtagttgacttcaaggtactagggttgaattcaggtactcgtggctatgctcagtaaggagaacttacagaaacattcaggtaagctgtatctgagactaatgatggcttggaattctgtttcaagttaagctttacccctttaaagaagaggaaaaataagtatgaagacacactccttgcattgctgatttttgtttgtttattcctttagctgcaatattcttaataatggcacatcacaaataaaagatgcttttggtttttttttctttctcttacattttcactccccttttctccatacccctctcctctccctcccctcttctccctctttttgtgctcaaatcatgattcctttgagtattttgttacaatcccaatattgcctcagaggctgagactgtgagtcttaccagcccctctggacttaggattcctcaacttttgcctcggatctgtcactttcatggtgtgaaaggcctttaagtctttcttcccttctctgctgtgccagtagctgataatacatatttatgaactagcgattccttcttgatgctgtcaaagtattataaacgacatcaccccaatttaagacgtgctttaaaattaattgatttaattagaaaaggaaactctaaagcagttagcatggcctctccctgtcagacaactagctgcttagtgctgccagacaatgatgactttctcttttgaatgtcaggtttattggaaagaatagaaagtgtcaatgtgttttgcttaggattaaacaaaccatttttttttctttctctgtctagggaggttgctctgtgcttaccttgctgacttttttcatttttctcttttagcctcacgtttccttccatgaaatgacttttttcttcctctccttcatttccacctatctcacttccccaccttgttttctacttggccctcatctgaagtcccaccgtttttggaaaagtcttctgtcttagtcagcctcggctgccataacaaaaaaaaaaaaacatatagactgggtggtttaagtaacaacacttttttttttttcttacaagtccaagatcaaggtgccaggagattctgggtctagtgagaagcctcttcttgcttttgcagatggccaccttcttgctgtgttctcttatggcagagagaggaaacgctggtgtctgttcctctccttataaggacgttaatctcattatgggggcttcatcccaaggacctcatctaaacctatttgcctcccagaggccccatctccaagtaccatggcattgaagattagggtttcaacatatgaatttcgctgggacacaaacattcagttctcagcaccctccttcatctgaaccggaagtggttccacctttctccttcattgagggttcaatcaagtgccagtcatgaagctctgtggttttatttttctctcctctgcttctctctaaacaggataagctcaggaatgccagcatttcgccctctttctgttgtgcagtgcctagcacaatgcttgacacatgttggcactctgcttcttgactgagtcagtgactgatgcatgacccattgtgctggtacctctgggctgtacatatgacactttctggaggataagacagggctagcagtctaacctcatgagaggaaccaggtattgctcatttagcttggaatgttgataactattaaacagtcatgctttcagggctggaggggaacttcgtggttcgttattcaacacctacctatttccaaataggaaagatgaatataggagaggttcagtgacttgctgagatctcacatggcagtggccatatgcctgccctgttagtttaaccacatgcctgctgtgggtcttggttactggcctgcaaatactgacatttaagtgcttcaggaaaggctaagcatctgttgatgcttcattaaagataacttttcctagtgaaagagttaacttgctttaattgaaagcatgggtttttaaagtttcctgatagcccaagtttgagagaacaagtaataaatataacatatcatttagccaatggcagaggtatcacattctgattctagaaaataaaatagccagacttcagcctcaccccagaccaaggaaatcagcatccctgaggatgggcctagtgcatcagtattttttcgaagctacccaggtgattgtgctgtgctgcagctagccttgggaaccaccctaggagtggtactcaattcaaaactgttgggaatgaggtaggctgcaaacaacacaaaataaaacaaacaaacatgcattgtgctactggcttggatttagaacaagttctcttcttgaacagacataacccatctagcagtgctgtctggatgagaggaatgtggcccaagtcacgttgtgctactgataatactgcaaagatgtcagagctttactttctaaattcttgtgccagctagcttgcactgtgtaacaaaccatcccaaaacttagtggctgaaaacaacaaatgtttatcatttctctcaattccatgggccaggtgggaattctcctggtctgggctgtctcagctaatatcaactgaggttgcaagtttctggggctggatggactgataggtggttgattcgctattggctggggcggttgggatgagatggctgtgtgtactgcatcatctaacaaactagcctgggtttgtccacagagaggagggcccaggattcttaagcaaaagaaagtataatcatgagtagggacttttcaagcctccgcttgcctatagtttgttaaattctcattggccacagaaaatcacttggctaatttcaaattcaagggtggagagatagccttcacctcttcatgggaggagctgaagggtcacactgcgaagcagactgcatacaggaaatgaaagattttgtgggcctttttgtaaccacagtataccaatgagcagaattccatatgaaacagaagaattatctgtggatgccacttttgttttatcatattgctttgtgcttcaagtggactggttaggtgatcccagccactaatccatgtatacaggcgccataggtgtcagctgcaagaggagcatgatgggatctcctgacctgagatgatccacaaactcggcatactgaagcaggaataggttatcgaaagcacagatctggaattctagtcccagttctatcacttactaattatgcgacattaggccaattactccaacctataagcctcagttttctcatctgtaaaatgggactagtaatgtacctatattatagggtatttgtgaggcttaagtgaaataaagcatgcagcaccgtttttggcacagcataagtattcagtaagtgaagttgtgaaaattagacatccccaagtgtcagagagacaaggtggaacttccatttgtttctatatagtctgactcagggatccagctggtcatgtgagcctattgtcagtgagggctgactggggtgtattgctgggatccctggctccccattccatcgggaaacccagtgtgcctgactttcttccaggacattctgtagaaaccactgtctgttgttctccggcctaaaaattagatttacacctcatcgtccttcatctatattcaccttgtgcgggtgagctgtaaatgaggcagtcctttgactgctctgttatttgctgttgccataatcaggagagaagctgaagtaatacggctgggtaactggttgtgatttcagtagtgggcctgctgggtttgcccacaggccgtgttacaaaatgctggcagctggcaagctgcacactttgtgggtccctaggaacctgagaaggctggaaaacacatgaattatacagtttgacaacgtgaacatggaaagggcatgtcctttgtgactttagtttttcattaaatgaactgttcttggattcagaatctatatataaatttccttatgtctcactgtttcctgtttggtatgttgctgccagtatagattaaaaggagtgactacaagtagaagaatgcaaaataagcttctttatgcaggtctgtttcttatatacgtgccaattgcaaaaacaggagactgttattttctttcatcaattgtcactctagatgccttttgtccccatgttgactggcctgggtcaccggagtacagtgtgtcagcaggatgtgtctcaggacaaatgctgaaccagcatcagcgtctttctaaggcaactttcttcgagataggaaaattgttacataacatgttgttttatatctcttaaccaacaaacattccattaaaaggaaatgctttatgtctttcttaaccaggtgtttactaaccacctcctccctccttcccatcattattcctgtctttcccaccatcttgcagactaaaaatagcattaatcagtgtttaaaactgttcctcagatttaacgtttggcattggagacaactccttaggtccagaagagtttcaattctctgagcgagcaaagatgcagtataaaaccagacccctaattgcagagctgcattgccaaaggctctctctttggaatcccaagcaatggattttggccaggtgcactccacctgcttctgtcgcctgtgggtggtgcagaacccctggtatatggcagccccaaaccatcagtgcattgcccttgagctgtgtgttgtggaactagatcaagaaccatctgttatgtgctcttgattagatggactttctctagaaactgtgcttagagtgttcaggaagattctttactttagcactgaagtcaagatggagcattctgaaaattcataggcagctttgtggttactttgtcttgcggtttttacctcttaaatgtttcatggatctttctcttttttcctttcctgtatttttcttcatataacatgaaatacttttttttttttgatacagggcttcattatcacccgggctggagtgcaatcctcctacctcagcctcctgagtagctggggttacagcgtgtgccaccatgcgtggctaatttttttttatttttagtagagactgggttttgctatgttacccaggctggtctcaaactcctaggctcaggcaatccacctgcctcagcctcccaaagtgctgggatgaattactatttaaaattattttattcaattttttttaactgtctctcacaagagaatataaattccatggaggagggcctttgtcttgttcacagccgttatctccagagattacagcagggcctggtgtgttagtctgttctcatgctgctaataaagacataccagagactgggaaacttataaaggaaagagatttcattgactcacagttcagcatggctggggaggtctcaggaaacttacaatcatggccgaaggggaagcaaacacatcctgcttcacgtggcagcagcaaggagaagaatgagtgcccagtgaaggggaaagccccttatacaaccatcagaacttgtgagaactcactcactatcaatgagaacagggatagtgggaaaccgccctgatgattcaattatctccacctcatctctctcacaaaatgtgagggttgtgggagctacaattcaagatgagatttgggtggggacactgccaaaccacatcacctgggttaggaactactatacccatggctgtgataactactatagctgtgtcactttcatgtaatcacgtgtagtttaagtagttgtgggatgaatgagtggatatagctattcccgcgcctttgttcagtttctctttcttgcctgctgttttgtcccatgcttcccttgtttcccaccccaaatcagtcctctacacagctgtcctggaccatatcatccccttgtcctcctcaagggatccctgttgctcttgggaatttggtgttgtggtccgaagacaatgaactgaagcatagtattgttctacgctcatgcttctctttcttgcctctctttcattcattcatccaagtcaatttgcttaagcatatgtacgcccagatactgagcatggtacccaagagttagttttcccctcttgccatcctccgtccctcccactctggtagtccccagtgtctgttgttgccgtctttatgtctagcacataatggggatagcggtataccagacaaagccctttccctcatgaaacttacagtggaattgggaaacagataccaaatgaggaaacaactacataaataatgtagtgacatttgctgtgatgaaaaataaagcagagcagggggcagagagtgcaggagtggagggtggtgtgaatgatgtgctttctcctttgccagaagcaccttttcccttcccttctgcctgagtcgcccccagttatcctttaagaagaaggctgaaagccctccttgactgcgggactacagtgagtgagggccttcgctggtatctccccatatctggtgagtgagcccgtcaggcacactgggctttacacttacttcatttctgaaaccccatctcagctgtgagctcctgaaggcctgggcagtttctcattcattttttttcctcttatgcctagcagggtctggcatacagcaggtgtctaataacagtaaaattatgcaatgctcacatcagtgcttcggctagtattttctttaggggaaccaaaagatagcaggaattcgatcacatttttttaaaggttgggatgttcttttcaaggctgttttgttgaatagctttctttttcttttcaaattaaaacaattaattttatcttcttttgatttttatttttaatatttattttatttattccagttttattttagactcagggggtacatgtgcaggtttgttgcctgggtatattgtgtgatactgaggtttagggtacaatggattctgaacatagtacccaatagttagtttagcctcctccttccctcctccttccccacaagctctaggagtccccattgtctgttgttgccatctttatgtccatgtgtacccaatgctcagctcccacttataagtgagaacatgtggtatttggctttctcaataaattttttttctaatatctaaagtatatatgcttatagaacatttggaaaacactacaaattatgagaaaaaagtgggaaaacccataatttgatccctgttgactttaggcagtggaaacatacttgctcatagccttcagatctatctaatttttataattttcttattatcatacagaatttttcacatagtaaaatactgtgaatattttcctgtgtttatgaagattctggaaatgaatttattattaagcctagcattccttattataatattccttagaacctaacacatgggaattctttgaagatggggctgaagttaaattcctccagaggagatttttgtttgtcaaggccagcccttgcaggtaccatcaatgaggggactatgaattcatcagctcagaactgctttattatttatgaatgtatgtatttattatttttaaagacagggtctctctctgccacccaggctggagtatagtggcatgatcatagcttactgtagcctcaaactcctgggctcaagcaatcctcctacccacagctgggactacaggtgtaagcctccatgcttggctaatttttttttttttttttaaattgtgttagagacaggttctcactatgctacccaggctggtcttgaatacctggcctcaagtgattgttcactggtctcccaaagaactgcattaaatgaaattctccacttgagattctaactcttgccctgacatgggactgtggacctcaaatgccatggccaagttgtgctcaccacttcaaggaaagggtttctttccacttcccccaatagccaggtcaaaacaggcaacttttctttatgctctccttctggggacaggtataattctaattcaccatttacaggtaccttaattcacattgaaagtgtaaccccttggggtcttaaccttatgcaggttaaggttggggagaagagggtgtgcatctcctggtagacttctcactctggcttagccgtatctaaactttatatctgattggtcccaccagtgcagctgtcaaaacagtggaagatgccctctgggctaaagcctcccacaccattttattggccttgtggaattcctgactttctgctagctcagcaatgcattgaaaacaagcttatattttgtctggaaattttgagttggagagttgttctgggtttctagcccactcataatttaagaagtggaaatgccagtaatatatttaactaactatttttggatatttagtttgccattactgttttgctattataagtaaagtatttataatgaacattcttgtagtcttatctttgggcatatctttgattttttttaaagcatatttatagaagtaggattgctgggtcaataagtatagacattttaagggattttgataaatgctgccaaagtgtactccagaaaggctaaatcacattgtgacttcacaaaaacgctcatttactgattttagccttctatagaacatgattgtgaattcttctgagacatacacatggagcagacaggaaggcccaggatgcatttggagttacttgagtttcagatttacctggttatctgctgaatttgggaagccaccagaaatcataatgtgcacaaatccaagattcttcatgggcttcaaagggaaagaggcttgggtaggcttgatgaaaatgcccagaatgtggctctgtgcatcttcctggtgtcaggaagctagtcccagccaggcaggggaattggaggagtgtggacaatggaatgtgatgtggcagaaacgatgtagctggggctgcgggtcactaaggcccccagcaccttatgaggagtgctcttttggaggcagagtctagtgatgcttaaagagccccagctctttggttgtaaattctctaataagctcaatactcctaacaactctggtgaaaccaggaaatgatctgtcttttttatctgtagccaaaaccaaactcttttttagcctgcagggttggaggatgagactccaagcatgtgattccagccctgcccagagggctttgctgtgaaaaccaccaggctccaatgtgtatcaatttgagttttggagttttattttacagaaatcaaattttggcaatactcaaggccccatgaagtgtaatgaaagctcaggaggacaatatttaatctgaataaatatctgttgtccttccttgggtgcaggcttgttttgcaattaggactttagaattttaactcagtgtaatgtatatttaaatgcacactgcttgatgtgctttaaaatggcacgtgtaaaccctcagtaacctatttccagacatcgttttttattccgtgactatgtatatttgcatgtgtgttttaaaactacaaaatggttgtctgcagcccccttgggttcaggatgggtacactggaacagtgatgatccccagggccagagatggtctgggactctatcagccagagctcggcaggcaggaagcagagttcagcacagatggttcaagaggctttactgcatggagtgtttgtggaagtgtgggaagtgttaagggaatccacagtggagttgaggcccccaaagaccagtaacaatagcatgaagctataaccactgcaaggccggaagaggcaaggagagaaaatggtacaactggtcccagtgagatcagaagtcataaaggagaggtctccagacaggtatgaattgacctagggactgccagaaatagttcaaagcaggatggagcagggcctgacctttcctctcctgctggtgcctctcccactggcttacaggaagttaagatcaagggaacctgggtaatgcagtccattgggtccgttcccctgggcacagggaacagcagagattggatttggggctggcagaaggttgcatctttgtctctgggaggtctcaatgcacatgtatttcacagatagttttatttaattagttgtcacttgcatcatgaaagagcgatagagaaagagaagaggaggagatgagaaaactttagcttctacttggcagaacagggtcaaggtcatgaaccttctccaaagctcttcccttcccttatttgagcctggctgatattgaattatttacatagggaaattaatggtgctgatgtgtgcatcccagtaacctgacatacacctggcagggattataatgtagagattgtgtttgggcacaagtggtcttcaggaccctgattggagatgcaggtcagtaaacagaggaggaaaggaggctcacagagccttggtgacttattccaggtgatagagcttgcacttggtaaaatcaagacatctaattattagttcatgttgcttacttctgggtgttgtataaattgggtattaaattaaaataattactcctatggaatatgcatagggatttgcccatatctggcaaatgagagcagttctggtgctcatccaaatgatctgtgcagacctcctgcatcagaagcctgccagctggtccttatgccagccaggccaaggagctctgtttctgaagtgcagggggtcctggggtctggatctctatggtgtggcccagagttccctccaagtccatttggtacagattagtcttgcaggatactcatttttgacaaaagggttctcttgtcagaaaagaaaaattggagaacactgcattctgcatcttcctcttggagattcaaaatgtacttggcatattaagtctgtatgaagttttctggtttcctggataattttctttgagagtgaattatttaaatttacactttttatcttttgtttttccaactagttatgtaatcctttagtttggccttcaacactgaggacagtgtatgtccactccatattctaaattacaaaggaatttaggaatttaaaaggaagtgcatttcagttgctcttgcacccatgttaattcctgagtgtcatgcagacatttctttacttttccaattttctaacagtttgttgcttaacatttcataggcagcctacctgggatgtgcagccacggatgtttctctccctcattctttctgtttctcttttcctctctcctctttccttagcatccctttggctctccactcacatccctgggtccatgggccgtgggggaaggtatttgcactatttaggtcctgggcattcttggaggatgtgtagcccttcagactctttagacagacacttatacaaaatgaaagtttcttctctaatactggccacttttcgcagcataatttaaatatactgtatgctaacaaagtctggggactcctaataggaggtgaggagggaaaggaaaaaagaaagaaggcaataaatgatggggagagaaaacctgcatttacttcaactgtaaatgtgaaagaagcattgactattcttcctatttgcagatgatcagaacagggcagacatggtgccttgttcacagccacttgctgaggagggatttggttgctgattgttccttaggttttggaggaagaagtgaagattggttcattgttaatgatgctatggcacacaagatagagttaaagcctatttcttattttatgtaaaaagtcatcgtaggaaatctgacatagatttgcctgatgttaaaatcccctgcttgtaatctgagttgcttgaaacagtggtgctgaaatccaaaaccaggtgcagctcatctggtttcagttgttgtttccacatgaaagggcaggatcatccacaggggttttgagcaagccactgatggtttatcattttgggtcatggtcaggaatagcttcatggatgttactgtttcatttatgtgaagtttttgagtgtcactgagccagatattcaaatttaattcacatttttacgacaaaaatgtgaaaaatgtgactaatcagaatgattccacttcctgtggagatttgcggaatcatctttttatacaaatctaattgtgatggcttcattaaaatgcaaattaaactacaaacaaccgaaacccagccaaccatccaaaacacttaagcatttggaaatatttccgtcctctgcttaaatagacattggagacatagaaaggtgagtggtgggagagggaggagggatgataaattacctaatgggtacaatacacactatccaggtgatggttacactggaagcccagacatcaccactacgcagtatatccatgtaacaaaatgacacttatatacccaaaatctataaaaataattttaaaaaagaatgagggaaatgcgaaacagagatcatgcatgtattttaataaccagcatttgtggtgtatcgtgtgatcattacagcttcaatttgattatctgatctttgtctgcatcaacatcaaatgcccagaataatgacgttggttcctccatttacctgtagggcttgacattgagtttgtaatttagaacaggctttccaaactttagtgcacagatgaattgcatgggaatcttgttaaattgtggattgtactgtgcaatagggcctgagatactgcatttctagcaagctccctggtgaggctgatgctggtgtgaggacccactttaagtggcaaggatttaggggaggaaatgtaagggaatgaaaggatttcatccaataaagaatcagcatacttattgcttcatacattcatcaagatgactaacttattcttggaagctatgctataacaagagttggaagtgtttactcctttcggataaccaggatgttgtattgatcagacaacaacattctttcaatgttctaactaataaaatattaagtgttataaattatggctttaacagatacacaggagtggaataacaaaacctaaagttttagaaagcaaacatatctcgatcattttaaatagaaggcagagaaatacttccatattatttcatataataagatgtagaaccagtatatctggtgaatctaaagtaattatcttgtgagaatgcagtccatagagagaggttttgtcttagtaacatggttggtcatttttctgaaaacagtccagcttttttctacaccgatttttctaataccttacagcccctgtgctttacaccaagaccatatgtgggatttgatttccctgtggacatgaaataaggctcataggaagttagttgtttgttgttgtttagttttactatgcttagtcttttctaggtattagggtcaaaggttttgaatgaaactacctttttagcagggcagaaataactcatcacattttcagttttgtattctgaaggttgggcttcttgtctctgaagagctttggagtgggatgtagcatcctttctttattctcctttttcccaaaaattgttttgactattctgcatcttcttccttttcaggtgattttgagaattagcttgttaatttcttcaaaagagccagatcttatgtaccttgtctcttatgtacctatgaaattggttgtgattgccttgcattctcaatggaggaaaatcaacatcttaccaataatgatgaagctatgttgtgtaaacttttgtgataagtcttgcagtcattaaaaggggaaaacaacttctgcccttttgatacagcagctagaaataaattatttaggcagatagtgagggtaaaggagtcctcagcaaggcttcccttttaacaaaaaacaaagcccctaaatcattgcttttctaaaaacaatcagcctgaaaaattgagctgccaacatagataagcaagctggaagcttgcacaggtgaatgccggcagctgtgccaatagaaaagggctacctgagaaccaggcatgttcaacatggaggatccatcttctgtttctttgttaccacagtgaaaaagcagacaacatggcactggccacgtagacaactcaactgcgtaataaaagattagggtgaggcagccagcttgtttgtgcactatgcaaacggcacacctagtcctaaccagttcttcacgtgtgcaagtggcacaccttgtccaaccaatcttttgtgccctatgtaaatcagacactgccttctcaagctcatctataaaatctgcatttcactatggaccagaagacctgctcgggaccccctctctctgcagcagagagcttttctctttctttcgcctattaaacctcctctcttaacctcactccttgtgtgttcataaccttgatttccttggcatgggacaatgaaccttggatattaccccagatgaatgatgccacttcattttagatacctccagtcaaaggacatataaaaggaaaattaatcttgggaccccaaaatcactaagccaagggaagagtcaagttgggaactgtgtcaggcaaacttgcttccattttattcctaaataacatagctgtttaatacaaagataaaaaggctgcatacctccctcaaaatttgcccacaaggggccgggtgcagtggctcaagcctgtaatcccagcactttgggaggctgaggcaggcagatcacgaggtcaggagatcgagaccatcctggctaacatggtgaaaccccatctctactaaaaatacaaaaaaattagccgggtgtggtggtgggcacctgtagtcccagctaaacgggaggctgaggcaggagaatggcgtgaacccaggaggtggagcttgccgtgagcggagatcgcaccactgcactccagcctgggcgacagagcgagactctgtcacaaaaaaaaaaaaaaaaaaatttgcccacaaggaaattcctagtaggcaaaggacagacagaactcaaagtcatcaccctgaggctcacatgagacaaatgcgtatatctggttgcttccactgccctattgtttcactaagccagtgaaggcgtaagtgactatttctgtaagttgtatattcagtggaagtctaatcagaaactcaaaagaatgcaactgtttgtctcttctctacctatgatctagaagccctcttctccacctcaagttgttctgcctttccagaggaaccaatgtacatattacacatattgattgatgtctcatgtttccctaaaatgtatagaaccaagctgtgccccaaccaccttgggcacatgtcattaggacctcctaagcctgtgtcatagcttgtccttaaccttggcaaaataaactttctaagttgactgagacttgtctcagatattttgggttcacagctgaacacatcctactaaacactttttaataattatcctttgtcaactgcagggcttatgttcctgaaaagtgtgtgattggcagaccccattgttgtgggattagtatactcaggcttgcttagcatgcaagttgtttttggtctggtgaattgtaccagtttgtttctgcaccgtttctacaccgtaacgcacagtgatgcttttttaggagtgtgttggattgttttaattcattacttctcatagtttaagtgtacaaaggtagtggaagattttgagctaagaattttgagacccaaattctatttctagattctctgtggggagggttatgggaaaccagcaagggatttaggggcagtggaggctgctggggacatttttccccaggcctaaaagcaaggggagggagcttttatcaaagcatatggagaggagatgcaattattggggccacctgaaaggcaagaggatgagatggctgctggtggtggctggctgggagatagccaggggaaccagaaccccaggctctccctcctcccacctttgcccgcccttgcatctcttgctgatgcttaccattggttgagactagagggaagccagagggtctgggcaggatgcggttcttagggattagcttcctggagcacccagcagtgtggagaagggtggagaatggatctggaggggcaactggagagaatgcagcatagaagtgtctgccagtatttacagatggtgtaaatagctagtgaaatgcaattccagtatcacgttttacttatctatatgcaaggctggtaggtgtgttacccagggtcaccagaatagaattctatccttcccacccatctatcatgcagtcattcttatatcccaaacactgcatcgtaaaacatacccctccggatacccaaatagcaaacaagagaatgtgatgatattgcccaaagcacatactggtaacacaatatttctttgaagtcccaattttatttaaaaaattcctgcaggttttgtatccaactttttattataaaatatccatgttaatcatatgaacatggaaatttcagtttgagaagctcagattaaatctgaaacataggtctcctacaaaatagtgtttaattttttttttagaaattcacttcatgcagatcagactttaaaacagctgtgtaaagtggaaaatcaaagcacagatcaaagtatagaaatgtatacaaaaataattagtgcttcacaaattcattcatttgtctgtttattcatttgtgttgattgcctgttctgctggtgagaagtattttcagcttttggtacttccagagctggaagctgtgtgctctgacataggcagcctcagatagccagaaggggcagcatctctctgctaccttccgttaccctctgtccaggttctcaaggaaggttatgaaggcactcagagttccttcttgagcaatctttagaaaacgaccacgtggacaaactgaactgaaaatactgtgtccagccttcaactaggagtcattaccagaggaagtagggtttggttttttggtctattagcaatcatccccccctgtattttttaacttccattcaaacctgcaatgtatgtataatttgttttgtatcaggttatttttatttttggatcaataaacattaaatatagaaaccatcggtgaaattgcctttgtgatcacgcacatcctgctggatctgtttgaaatccttggtaattatgtcctggcagttggggcatattgcatgccttttgggggaccacttaagaacctgtggaattttggtggtacctcactctgagattgtgcagaacatctaccaatctgagattatgcagaatgttttttcaaaagttacgtaagtaccgtgtagcctatctctttttcttcatttatgatgtgtttgtgaggcaaattaccaaaaggcatcatttaataaaaacaggaagaaagtttgctcaaagaggatgggtggccctcctgatgtcactcagtggccccaggtaggactgcagtggaaattttggtgtgagaattctggtcacactattctttccaccaaaaccaaaccaaatcacaacagccccgcctctgccacaaacaaactgaactttcaaatagctttaagtcttgaaaataaaccttaagggggaaaaagcaagctgttcttggtgtaaagccggatccacccttattccccaagcccagattttcctgtacaggaagacaggtattagcagatctgatggagggatttggtcaggtttgaatggggtcacatggaaggattccatttcctgctgctacaaaagtctgctcaaatgtgagaaaccaccagtaaagatgatttctaggaatgtagaccaccactctaggctttcttggttgcattggcaacattgctggcacatgtatggttcttgaaattatagaattgctcaagagacacttaccgagctgcagaaagagagttgccagaaaataattctctaagcacagatgtttccatagactctacagtatccctttagctctaaaagatccatctgtatcatagaaagtcgaagatgtgagcttggccaaacacgtaagaatctcttaagaatctcttccattggatcaactggaagatctaagttccctgtcagacctttgatattgcaacttaaagtgaagatatgaagtcaaggagaaaagaaagaataaaccctcattaaacacttttcagatcaagctaggagcttttgcttgtgttctcacttagtcttcctagagttggtatcctcccatttctaaagatgaagaaactgaggctcaaccaagttaatcattttgcaaagtttatccagctctcaaaagtgatcaagtgaggcccagttttgtttgatattagcacttattttctttccacttgtacccatgaagtctcttaaaattcagtggttcttcaccttacagaaaccaggagacccttcctcccatcctgataaaaggcacagccgtattatattagccacaattccaggcaattcctggacatcttgggatctgttcatggaccccagatatagaacccagtatctagagaaaggccatggtcatttgtgttttcctgctgctcctatgggacaccttggtggcctgatccataatattcttacaaggaggggatgtcctctttggccttttgctcatcagaggctaattaggttcctctaagtgatgacagagtagggagaacatacattttgtataacttgcttcctctcctagggtatttgaattaatacaataacctattttgggagggagatgatgtcatatagtttccatttaacaaaagtatggatcaagcagttattacatttgagttcctgacaatatgatatggttagtcagagtagaatctaaaatagaggaaaatgacttaattgtcaaggggaaagtagaggagtgtggtcaccaggctgtgtttctttctctgctcctgtttttagggcattatagtatagtggttagaatcttaccagtttcctcattaattaatgagtaaaaaattaatcattgattgatacatcatgttcacattgtactttatgggtattgcgatttcttcctttttttctttaacagtattctttgagactctgtagatggatatatagtctttggtatttttcaaacagaatcgcctggatttttttgaatagagattcctgagattatttcccatggaacacattttgggaaacactattccagaaagatcatggtaaatcagaagggtagctgaaaaccaaatcctagccttacataaacttggttacataccagctgtatgacggagatcaattacttcacctctctaattttcagtgttctcatcagtaagatgaacacaatcatagtaacctaactcacaagattatcaggaggattaaatacatttttagatataggacacttagatctgtgcttgatatattgtaaatttccataggtcatagctaataaattagagaattatagatttagtaaagtgggcattttttataagaggaaaaaaagcaagaacatattctatctatcttcttcatctgtttcatacccatcatcacaagcagccccttcttgccttagggaacttacagctcccatttgaaatcctgggtagagttttgtggaatttctgttctacctgagtcaacatcttctttaatatttgtacagcaggtcagcgtttttttattttttatttttttgagatagggtcttgatctctcacccaggctgaagtgcagcgatgcaatcatagctcactgtagcctcaacctcctgggctcaagcaatcctcctgcctcagcctcccaagtagctgagaccacaagcacatgccaccatgcctggctatttttttttttttgtgggacagggtcttgctctgtcacctgggctggagtgcagtggcacgatctcggctcactgcaacctctgcctcctgggttcaagtgattcttctgcctcagcctcccaagtagctgggactataggcgtgcaccaacatgcctggctaatttttgtatttttagtagagacagggtttcaccatattggccaagctggtctcaaactcctgaccttgtgatccgcctgcctcagcctcccaaagtgctgggattacaggtgtgagctactgcacccggacaatttttcttttttaatttttgtagagatgaggtctcgccatgttgctcaggctggtctccaactcctgggctcaggcaattctcctggcatcgcctcccaaagtgttgggattataggaggtcagtttttacattgctaactcatcttttattggtctaatggataactgacatgaaaactgcctgaagaatctgtataaagcaatcaggaacagacccgttctgtggcgaatttcccaaatgtagaaccctctctggcttttgtggtcacgtatgtttacagcagctctgatgcaggatagattactaccagtgtggcagatgtaagctttctctcaaacatctggctggtagtatatggaggatccctttgcctagctaaggaacatgaggactaatttacatgatctaaagaggttggagattcattgcattattctgtgcaataatgacatgagacagtgctctgtttgtgaatggggccactggagaaggaaaatctggtgtttatccgagtctcatgggatgactcacaggctttagcagacttccactggattttggtataattattatactctgggttggatactgaggatatcaggttcatgaaaaagtaattctgggacaaggtgactcaatctggagggagagccagcaggcagcaactcctggagaagaggaccatcttggatgctaggactcaaatctttgccagatcaatattcctcaagctatttttccccaccaatatttttttttctcttgaagtcagaggactaaatgtcctgaaattgaaagggttaggaaggagagaagagagcagcattctgcaacatgataccttttcaggtagatgtgtgattggaaagcagccttggcgggtgcttactgcactgccttttagggcccttctcacttacctctgttcccatctagggactaaattttcttttttccctagttttctaattcgcagttgcctctgtcctttctccctagttttctaattcccagttgcctctgtcccacttaggataaacctactcatgtatgagacatgtaattactgtatgtcattctcaaccttttaaagtctgaaggccattcaaatgggacagaggctgtgaatattctctcttatctattcttgtttactttcccagaagtgtttcccagaattggcaggaaggctcatgccagcctcagaggctttgatgacgtgatggctaatgcactgttaaaatctactaaggtaagaagtagatgtcatagtggtatagaaataaatcccccagaggggaagctggaggacaatgtgaggaccttaaaggcccatgaaccacaccgaaggatgcatttctagtgtttcatcttagtcctctcacattagggcaaattaaatccacttccttaagtcctgacacacactcggaaagaggtcaaaggactagtaccctgaagtttgggaaacttacctcccctgatggcctctccagtcataagttatgggactttgtagtgttagggtgagcacaggataagaactcttgatggataggtgggtatatggactgatgaatgaatgaatcatctggacatgggcacaagtagaagaccacccctccatgtcctgttcagaagaggccatggccttctgatttagtttactcctgattaactacatggagaatgtacacattattttatgtgctcttctttttttttttttttttttttttaagaacagaaagtgtgaagagaaaggtgtctccttgttaaagaagactaattaaattgtgtgattttattcttgacttttagagtctggctcaaggaagcgtgagtcacccagagttgaaaatttgtctagttggagccctcatcaaatggatgaatgccactaaggcatcttggtggccaaccctgccatcattcttgtctcagtaacaagccatgcctggccttcaccttgaactgctttgtggcctgcagcctttcctctcgtcaactgccccatttctgattgtaggactagctttttttttttttttttttttttttttttgcttggggtcacaccttctcatagcttgacttttctttgatcttttcccctgattaacagaagttatttctgtgtggaatggaagattgtgaactttatctttgactttaaatgccaaccacttttttgaaagctgccaacacaatattccactcctaacttaaaatggtaagagaaggcaattaagatgaaatattccaagttaccatattcctgcttttccttcctatttacttttttacttgcctatgtcatgatgtcttttaggactagatcacaacttctgagcttggggtgagggttggaggaggagcacacatccctaacagaatatgtcagaatctcactgaaaggaagtggaatttgaaaagcttagtcaacatagtgtattattttgcatttgaaaaacagcagcactaaaagtaacaacaaaaatcttactgtttcaaaatactaacgtgtcaatgtagatgaaattgtctttgaagaaaaagattcaagtcttaaaccaaaatgcacgaggcactgaactttcttccttttgcctgtaggtggaagatgtgtcatgttgatgtcaaaatctgcatatcaaatacataaatacatagtaatcctcctgtaatatcaatagtgccacactgttcaggtttaattggtgttttcaacactgccaaaggagtggttaatgaaagaggtcatttaaattatcagctcactgtcaaatactcgtgacatagagcaaggcaaaagatgtttttagtcatctcagttctaggtttcactgtctttggtgtcttaagatcttttctatatagcagatcagtcttcccacctccattgaggctgctggagaaaaatcacaaaactgcttacatgtaggcaactgcacatcatggtctttgcctcagtggggcctagagtttcatgtaaaattcatgtcatgtgtttctggttctcatcttttccagttccacatctgaatcactcccctctcctggggacctttcccgtgacctcaccccagtgctgctcagcagatgatctggtcatttaccccacaggagagatggatctgctgtgtgtgcattccttccaatttggcctttacaaaggcaatcttccctgccttctcagaaatccttcatgtttctgaggaatggctgtgcctcttcctgagtaagatgggtcctttctggtgaatctgagttgccaccccctttgaaacttttcttactgtgtgacccccttatagctcttgcctcctctttgatcagttccctctggcctagaaacagggtcaagtattgctcctttgattcttcatgcccccaagttctggaaagagtacctacttgctcttctgattcctctcctcctatttgctcaatctactgtgatctgttttctgactgccattccactaatagcccttgggaaggatcccaggaaccttctggttcctaaatccagtggacactttcagggcttttggtttttaacttgcttgagttctctgtagcaattgaaactgtctcctttggtttctatgaatttgctcctggtttgaccatacctctgggtccccagtctcctgtcaaggattctcttcctctgcccgttcttcaaataatgatttttctggactgtcttcagctcacttctttctgaacctcatattttctctgggctttcttatacactctagtagctttactaccaccatactctggtgatttccaaagtataagtgtagctcagagcatctctcagaaccttggccatatcatgctatttaccatatctctacctggatgccacagagctgtctcaaaccctgcatgtccaaaatgatgtctaatttgtttgaaggaatcaatgcctactcagtctcccccaaagaaatctgaggtcatccttcactctgttctgtccttcatctttttcatcccataagccattatgtactgtgcattatgtttcttaaagactgatctgtttcctagctccggttctgtcgtttattgcttggactattaaaaagcctcttaactggtctcattattcctatcttgccttcttctaatctgtccctaacattgtcaccaaggaatgcagacctctccatgtggcttcctccagagaaacacttcattggctctccatggtctgtacaagaaaatcaaagttctgattcttactgcctaagcctttctgaaatctgtcctctgcctatcatgccacccttgtccactccagttccacacctcccaccctgggcttgaatactattgaaagatcacagtccctagaatgcagcctgttattcctgcagccccttagcccagtgtttgacacacagtctttagtaaatatgaagaggatttcttctttgctactgttcattgtgatttgcattcttcactagggaaaatgcctaatgtaatacatttattatggattctcagaatgtatttgaaatgtgacttagtctatttacctgtttgatgagtaagtctcttctctgagaccctaactattggtgaagctcatgtaacttctggaatggtgagcgcattaactctagcaacaaactatttaatttctaggaaactatgatgaaaactttttgtgaaaacaaatttttaatgcactttttgcctgctgatgtgagttttgggtcttcctggcagagcaagtttgatccttctttactgtgatggtccttccagtgtttgaggatggctgtgctcttttccttgggtcttttcttctccctgctaatataccaaatcatatcaagtgttcttctcatcacatagtatcaactatctttgcctttttgagagctcctttttttggctccagattttctgtgtatttgtgcgtttaccaacttgtccacctctggaagcgtccaggaccactttcctgatagctgttaagttttgttagtgcagactgagattacgttagatgctttggcagcaacatcactttgttggctcatattgacgatctgtttaagtcatcccttacttctacttaagggtggaaaccacccatccctaacacctgtcttgttgcattttggttgcaagttgagtaataaatctggtgcttgtatagttaagtttttgtcctaaattttatccttgttgaatttcatcttgttaaagaaggtcttttgtgaatcctgattctggtcatgtaacattttcaacattctccctggctttttctcagtataagcttatacattggtgaagttcagtggggttagataaaaataactataataataatagatattatttattgagcattaactatatgctggccatcatagcttagtatttccatgtgtatccttggtggttccatacaacactgtgaagtaggcactattaatatctttatcttacatgtgagccactcaatcagatataggtccctcatggttgcctctggaagtcttattttcagtttatattaatttgcttatcaatattttttgatgggaattttttttgctgggagtttttaaccagctactaatacatccacttaacttgtactaaaatctaatgtgtacatttcttacaaaaactttatagtatgttaaactcttgcgtatttatgttaatgaattttcttgttactttaaccattgagaaaactgtggaaaatatagaaagttataaagaagaaaataatgatcactcttaatcttatcacccagaaatagccactattaactttttaacatagttatagtctttttacatatatacataatttcatgtttcttatgtttatcaattcttccctagttataatgccctattcttccaaaaatgcagtgtattctgctccacctttcaaagaaaccctgctataagtgacaggagagtattagttaatacagtgattatgtgtccttttaatatttatgatactagattcctgcagcttctgaaaaataatacatttacaatggaaaatagcatatttcatattacttacatgtagtattggtttgtgaaatgaaattgagtgatattgtataattggtaatacatgtgtgaatctgtttacaattttatttaaaacatatatctttattaatgacagtgaaaaggaagaaatactagcacattttatgaacaactatttttagaatagaatacaaaatcatttttcgtttagaataattacttttgctccgaagaaaattgacctcttgaagaaatctgcatgaactctgacttattgggtaactactttgatacttaggtttatttattaatataacattataaatgtatcttggggaaaatatacgagctatgaaaatgtctagttaaaaaagggatgtgtattgtttattttgttatgcaggaaaatgagttcttgtattcctaaagtatattagttatcttccttctgccctactttttaaaggcagcaagtacaatttgttacttatgtcctgtgtcccaaagagactctatgctgtgtctttaacttatccttgatttgttatttgtggacctgccttgtctattccgctaaaatatacattttttaggatcaagtgttggggccttgttttttagtatttctgggtgacccgtgtttagcatggggccttgagtatcccatgatttctttgagtgtttattgagttgaagggagtatcagaagatggtgagacggaacttaccatcatcctggcttctaatactgtccctatgaagtagatcaagggtccccaaaccctgggcttcagactggtaccagtttgtggccggtgaggaacccagccactcagcaggaagtgagcagcaggtgagggagcattaccacccgagctccgcctcctgtcagatcagcagcggcattaggttctcataggagagcaaaccctagtgtgaactgcacatgcgagagatctaggtttcaagctccttatgagaatataatacctgatgttctgtcacagtctcccatcagccccagataggaccatttagttgcaagaaaacaagctcagggttcccactgattctacattatggtgagttgtataattatttcatgatatattacaatgtaataataataatagaaataaagtgcacaataaatgtagtgtgcttcagtcatcctgaaaccattccccccgccaccctctggtcagtggaaaaattgtcttccatgaaactggtccctggtgccaaaaagtttggggaccactgaagtggatgaatgctttagtcagacagctttggtctactgttcacaagcagttgagtaccaattatgcattcagcattgtgccagatgctttggacaaaaagacaaataaggcatagcttctgtctctaagtcacgcacagcctgctaaaggaaacagttatataaagaaataagtgcagtgtagcacaacacttgctcaaagccacacagcctgtgaggggcgggactgggattcagttttttttttttgttcaactccagagctgccaagccaagatgcttccagaacagaaaaattagaagtgctgatagttttgctctactcctcagagcaaaacaacagccttgctccattaacagaaaatgcacatctttctttgaaaacattattaaattaaaccattttgttttatttgcaaattaggtcctccaaaagctggggaaagctgatgagacaaaagacgaacagttcgaagaatatgtccagaacttcaaacggcaagaagtgagtccatttgtttagtttctggagtgggaaattgtttaaatgtgtttgtgtcttagtatgtaagtaaaatgcattaagattaaaaaaagactagatggagttggcactaacttgagagtaacacttgctaattctgtagaatttcctattgaagacggggaaagagccatagagagtaggttttggaatcccaggagataaagactctgctgtcctggactgctttagctttttataatattttagtttttgaaacagggtctcattcagattgcccaggttggcgtgcagtgacacaattttggctcacttcagcctcaacatccttggattcaggtgatcctcccacctcagcctcccaagtagctgggattacaggtgtacaccatcatatgtggctaattttgttgtgtttttagtagagatggggttttgccatgttgcccaggatagtcttgaactcctggactcgagcgatccacccacctaggcctcccaaagtgttgggattacaggtgtgagctaccaggcccggtctccgaccactgtaatacagatgacggatctataggaatgctggtgtttctgaagatttatatttcattgaacattagaaaagcagtagtttaacacttctggtaaaatgaccttaattgttgcatgcttcaagagcatgcattcgcaacagggattatactaatatcttccctaaggggctgaaaattggttcttggtgggtgaagaaaacctttttagtgtataaagcatagataaacatatcttagataagcagacatatagtatacttacggtattaaaattttacagggggtgtaattcagaaaaaaaagtcttaaaagactccttggggagatgacaatgaaaaagaggttgagaaacagattgtgatgtttgttcctttagtgtatgtgtttaacagacacgtggatatagaaactatttttaaactatgtcttgatctctaaggcttggataattggctagaatatctctctttaggtaacacacgtaagggctggggaggggaagataggagtggggccgtctgaggttagaagcctcaaatctagagatcgtcttagaggtggggtaggaagaaggcaggctgagaagggcttgggaaatggggtttgcgcattataaagtcagattatgtggggaacaatataaggacatggatttcttttcctgctgtcagtggagttaccagtgtccacagagggaattatagcctcagagatgacaccaataatgggaaatcatcacaggttttattttgctccctttgctcctgaccttggaggtttctttcttccatttgtgtatcagggttcctgctctttctctcaccaagacattctatttcttttcattaccaagagggattatacatttcagcaggtatggagccaggtagatcagttttgccaaaacgcattcctgaatgtctccagtttcatcccaagactaagtgttggcatgtgcgataggtagtcagtttaccatgaatgggatagcaaacgtgttatatctgaacatgagaaaagggagaggggagctagagaacaaaacagtaacggagagaaaaattgatcatggccaaatgaacaaatattacagagagctttggcttaataaaggtagaaaagagaattcctagagaaatgttggacttgggcccacagaataagtagtctcctagtctcctctaggagaagagggtcttcacatcaacttctgttctcatttggtgatttttcacacatctcctgcgtgtgggtagctctcaaatagatcattgtcttggattgcaggaacttcccatacacaaacttgtccatcagtgccctgtgactttgcaggcaatcccaaatgtctgctctaaaatattggatttagattgaagaagtgattcatgtttacagttttccctacctaaggattcacactgtacccttcgaaaccttgttttcctgtctggcatgtccccatggagctaattaattctttgctcttggagtttttctctatcacttttatggcactttaatgttgttagcaccctagaaggttaactttggaagcatcaggtttagtaatgcagtcatgccaggaagcactttgcattttccgattacagtgaattttcattgtttttttttttttcccagctttcttgactgccccaggtgaggattgttttttgttgaaggtactagagaaaagtgcaatttgattaaatcatcaactacattggcagaatgatttgtgccactagcagcagcagcatgtggtgactttaaactgctgtcctgctatctattttggtcactatatacaatactcatcttcaaatgttatggggcatagtatattagcacccatgcagactaccaccttagttctcccaagaaatattagcagattttaaaacgtgtgaaacttcaaaacttggggaaatttgaacaagtaattctatttcataagagtaaggcaaatagactgttaatatagggaatgttatttctcagggagtctcttgaccccatttggttcactttgaaaatatttttgcatctaaaatatctagcattttcctatcctcattttgatcttttttaattagaaaaagaaagtttataatcattatagtggagtgaggaaggagagtgccttacccctgtttgtatattaggagagacaaggagaaagggaaggaggatagaaggaagagaaggggagggatttattaattttcttttgaaacatattaaaggttgagaagtgtagctgaagactgattttattaatgctctacggagagaagaatcctcttacccccaatatgtattggtgatcaatttgcatgtgttgggtatgctgaaaaaggagtggtacttatgtagaaacattaacctagaaggaaggatctgccaagattatggttacatctgcaaggtctattattcttagtattaatgtgatggtgaatcagtactctgaagagacaaagcattatctaaaggctacatactctaaaggcattatctaatctaggaaacctagattccatattttttctacgagtatatatattttatatcccaaaagatactattgatagtataaaatgaaaccatatttggatttgtgcattgtattatagtcccctgaccacactcaagtagtgcttaataaagaagtagaccattctaggatgttctagaattattcaaacatttatgggggctcagttatcttgcttttagattccttttataaaatcataagatccttatagttattgatatattccttgcttgttcatgttggaaacaaaagtggcagaaaggtctgtgtttgaactctggcttggggcttttctttattttattccaactctaagttttccttttgatctcaaacttcttttccttcaacatggtttgtgtgagactgagagcatcgataaagggtctgtacatactttgttttgtccattggactcccaattgctgtagcttttgtggttcatgtttcataaactacttaattaaaacaaggagagcctggtgccatggtgcgtgcctgtagttccagctactcagcagggtgacgctggaggatcacttgagcccaggagtcctgggctgttgtgtgctatgctaattgggttcctgcactaatttcagcatcaatatggtgacctcccagtagcggggaaccacgaggttgcctaagtaggggtgaacctgcccaggttgaaaatggagcaggtcaaaactcctatgctgatcagtgctgggatcgtgcctgtaaacagccactgcactgcagtctgggcaacacagtgagacctcatttcgaaagagagaaagaaggaaagaaggaaggaaagaaagaaagaaggaaggaaggaaggaattaggagtagtacatcagggaatagaatgaactcttctacaaaaaacttggaattttccatgacaatgcatgctaaggagagcaaggattttagaaatccagcaggaagaacaaaatctgatttcatttcctcctcagagggcctttcttccccgttctatttttggtctcttatcaaagctgttaacaagtagcaaaattgactggtgtgaacatcacctgctttcagttctaccagttttctgctgacagatctgttaatgagcagaaaaaaaggtcccactgtggaaagaaggtccttggtttctctccctccttcctgctaataaactcgcccagtaagatgctgcacctgtggcaagtgtgctaattaaaagaagataccttgagggctggttgagcccagataaccaactatttggacacattttagtgagtgcaggtgggagcaccctcatccaggtcccatctaagaacaatagttcaaataaaggagagagagccttggttctccttctagcatctccataggcttccattccctcattgaaataccatagcagtgttgtgcagctcctccatggccacgactgagtgataggctaacttttgtgtaatatgaaccaaaaagagaagagaccctgggaccctgaaatcctctccagtggtgagaattcagaccagcctcccatgagttggatgctctagcagatgtttaaagctgggccacgtcctctccttagactgaactcacacctcctggacacagcgatcctgttttgctgcttttatgtttttatttccatgggagctagtgctttgcaagtaaacttaacaaatgcttgctaaacttgaagctgaactagtggcagaaattatcactttgagtgcattcctggagtacatttttatttctgggatggaagagatgttgtatatggtatgtatttttgcaagcggtttcgtgacatttttaagaacctagtatatgtacatataaatgactaaagagaaaaattttagaagttttaagaaagagtgtaaaataaaaatatactgccacagtatatatgttaatgtgtggataaaattttaatttacgataaattatacttaccttcagaagctttttgcaatttgcttgagcagataggcctagcatataccttagaacatttgtttttgccacagataaccatgatgtgaatatattaatgtatctacctttcattaaatattaatcttgaccttcttgtgagatagccactgccttgattaaatgtgatcccatcagatctgttttaaataatgatccaattctaaatggcagtatggagagcctcagttgccctacacagcatcctgtcaggttactagaccttctggattctgaataagaacctaagctggcaagttttgtgccctccagagcagtgtttttcaaacattagctgccttgaagttacctggaaggtgatggtacagcaggtcgcacccagcagcctgtgctgtaccaatgccttcaatgcaggtgatgtctgaggtgaggcctgagaatctgcatttctgacaagttcccaagtgatgccagtgatgctgatccagggacaacacattgaggactaatgcattgtatctactcatgcaagtttttacaagtgcttcctctggtttgtccttgaaacttctaatcctatgtttgatgtctatctttagtgtctataaatatggatataaatatggataaagatttggtggtcatgttctggattatctgtgatctgcatagatcaaatcaactaagatgatctgatatttaacaggcatgatttttgagtgtagtgatggaactcgcttcttccaaggttgtagagccgggaggctggatgccctgttaagaaatgaaagtccctgctcacaccttaatgagaaggagtttcatgaagctcttttaagatagtctggtgtaataggggaaattatagaaggcattagaactctggacttagggtcctgggaaaaaaattgattatctggaaaaccaggttcagcgaatacaaagccttggaaatgaaagtgtcttgtccagaagcagccgaggcaatgctggaagggaaatttatagcattaaatgcttgcattagaaacaaggaaaggtcttaaatcaataatctaatttcctacctcaagaaacttgaaagagaagaaaataaacccaaagcaagcagaaggaaggaaataaaaaaagaacagaaatcaatgaaactgaaaatggaaaacaatagagaaaaaaatgaaacaaaagtctgattctttggaaaaaagtcaataaaattaataaacctctagcaggactgacaacaagaaaaaagacacaaatcacccacatcagaaatgaaacaaaggatattactatagcctctgtagccatctaaaggataataagggaataatacaagcaactttatacttacagatttgacaaccacaggggatcaattcctttacaatcacaaaccactaaaacttaatcaaggtgaaatagacaatttgaatagtttaataattattaaagaaagtggatttgtgatttaaaatctgaaaaaaaatctccacaccctctgatagtttcactggataattctaacatttaaagagttgatatcaattttacataatctttttcagaaaatagaagaggagggagcacttctcaattgattttatgtgggctgtattaccttgataccaaaaccagacaacaatagtatgaaaaaaagaaaactgcagaccaatatgtctcatgaagttacatgtaagaatccttcaaatatcagcaaatgaaatctaacaatgtgtaaaaagaattatacaccttgaccaaataggatttattcaggatatgcgaggctggtttaacattccaaaatcaatcaatgtaatttaccatataaacaaggtaaggaaaaaaataatatgatcatataaattgatgtagaaaaaatttgtgacaaaattcagcacccactccacaataaaaatgcccagcaagttacgaatagaagagaattacctcattttggtaaagaacatctacaaagaaacctaacgtacagttaatatcataattaatggtaacagactgaatgcttttctccaaagattgaaaacaaggcaaggatgtccattctcgctaatgctatgcaatgtagaagtggaagtcctagccagtacaataaggaaaatgaaaggaaacaaaaggcgtatagctcataaagaaattacactcatttcgtctgcagatgacataattatgtacatagaaaatcccaagacgtcaacgaaaatactactctaacagataaatgagttcagtgaggtcacaagatataagatcaacacataaatatcaatcacatttctatatactcacaatgaacatgtggaaataaaaattaaaaacacaacttttataatcactccaaagaaaaagaaatatatatgtgtaaatttaacaaaacacatacaggatctatatgcttaaaattataaaatactgaaatcaaaaagaactaaatacttggaaagatgtactatattcatggatttgaagcctcaacacagtaaacatgttggttgtcaccaaattaaccaataggtttaatgcaatttcctgcaatttctacagcatgttttttatgaccatagataaacttattctaaaatttacgtggaaatgcacagaccctatcataattaaaacaatgacaaagacaaagtaggaggaaaaattcttttcaatattaaggcctaccacataggtgaaataatcaagacattgtattggcagagagatagacatgtagattaatagaacagaataggtaaccaagaaatagacccacacaaatatgctcaactggtttttgacaaaggtttaaaaacaattcagtggaagaaagataacctttcaacaaacggtgccatagtaactgggcatccataggccaaaaaactgaactttgacctaaaactaacccttatacaaaattaactgaaagtatatcaagaacttaaatataaaacataaagctttaaaacttttgggaaaaaataggagaaaatctttgggatctagggttaggtaaagagttcttagatttgctaccaaaagcacaatacaaaagaggaaaatgtgataaattggacctcatccaaattaaaaacttcctttgcaaaagagctgttaagagaatgaaaagacaagctatggactgggagaaaatatttgcaaactacatatccaagaaaggactagtatccagaatacgtaaaagaaacttaaaactccgtagtaaaaataagttaaacagttccattagaaaatgggcaaaatccatgaatagaggccgggtgcagtggctcacgcctgtaatcctagaactttgggaggccgaagtaggtggatcacttgaggtcaggagttcgaaaccaacctggttaacatggcaaaactccgtctctactgaaaaaaaaaaaaaaaaaaaaaaagccgggcatggtagtgggtgcttgcagtcccagctacttgcgaggctgaggtgagagaattgcttgaaccctggaggcggaggttgcagtgagctgagatgatgccactgcagtccagcctgggtgacggagtgagactctatctcagaaaaaaaaaaaaagaaaagaaaccatgaatatatattttattgcagtagatatgtggatggcaaagaagaatatgaaaagatttttaatacctatttagccatcggagaaatgcaaattaaaaccacacaagaaatcaccatccatctctcaggatggctaaaataaaaactagtgacaatgctaaatgctggcaaggatttggagaaactgaatcactcatacattgtgtgaaatgattcatagccactgtgggaaacagtttggctatttcttaaaaaattagacatgtataccatacaacccaaaaactgcactcttatgcatttatcccatagaaatgaaaatgtatgttctcacaaaaaaattgttcacaaatgcccttagcagctttatttatagtagctccaaattggcaacaccccagatgtccttcagggggtgaatagttaaacaaactgtagtatatccatactatggaatactagtaagcaatgaaaagaaaataactacggccacacaccaaagcctgcttgaatctccagggaattattctgagtgaaaaaatccaattctaaaaggttttatactgtgggattccacttatgtgactctttcggcatgacagaatttcagaaatggagtaaagtttggtggttgccaagagtgagtgatgggggtttggggtcgatgtggttataaaaaatcaatacaagggattcttgtcctgactggaaagttctgtatcctgactgtggtgatggatacatgaacctacacatgtggtaaaatcgcataaaactaaacacacacacacacacacacacacacacacacacacgcacaaatgagtacaggtaaaactgggagaagctgaataagatgggtaggttgcatctatgttgtgacattgtacaataattttgtaaaatgtcgctgtgaaggaagactgagtacaggatgcaaaggctccctctctctctctctctctctctctctctctctctctatatatatatatatatatacacacacacacacaactacatatatacacaactatatattatatataatagatgatatataagattgtgtatatatatacacaactatatatatatatacacacaagtaacacaactatatatatacacacacacacaactgcaaatgattccataattacatcattgaaacttcatttaaaatatatcccctttcataggcttacctagaaaaagcatactgcctcactgcctctgtcagaacaaacacacttgaaggcagaagccacagactcacattcttgccaagatgtgtcagggaacataaacaagctgagtaggcaaggtataaaacagtaaggagtggtgaggactgtgctgaattataggattcatgggacctaaagaagcagctgtcaactccagtgcacacgaatctcaggaggatgtgggccccatattgccacatcagattttcaagaaaagattaaattcatattgtaataaaagttcccaattttattttgtatattttaaatttagaagtaattttaaccttacaaaaagctataataatagtatacagaactgctgtgtaccattcacctagacttcccaattactgtatcattctatctatatatgaatgcttccatgcctccatgcctccaaccatctattcatccatccatccatccattagtatccaaaaacgacactatcctacacagcagtagttccttctgtcaaagtcagtgaattacctttgatcccgtattaccatctaatttgcagatccccaaattttgcctatgacaaaacttttgctatgcagaagactctgtgaaggggatgaaaagacaagttagaggcccagagaaaatgtttgcaacatatgccctaattgtgttttttaaagggcctgtatccaatccagggtcacctgttgcccctaattgtcaggtttcattagtttctttaaactaactctgttggaagagtgtttcagtgttttcttgcctttcatgatcttgacacttctgaggagtactgcccagtgtttatttgtagagtgtccctcactctggatttgcccgatacttttctcataattagcttcgtgttaataattagcttctgggaagattactacagaagaaagtgatgcccagtgtatgctgtcagaacacacatcatgttaatttgtgccactgctagtgatgctaacttttatcactttgtaatggcagagctcaacagatgatatgcaggtatctctagtaagataagatgatatctgccaggtatctctagtatagagttaatacataaatattttctctcttaaaattaataaatatttaataagtaatattaataaatattttgtggggatatagtttgagactgtacatgtcctgtttctcatcaaactgtcacctactagttttatccactagtgctacttctttaaatcagctgttactctgatgcttgctacatggtgaattattttgaattccttctaaacttattaattagcattctactcagtggtaaaatttttgagtattgtgacattgtacaatcatttcgcaaaatgttgttatctctgccctcactcctggtaaaaatttttctttcttaattaattaattatatcagcatgtacttatggattcctatgttattcactgggttataatacattactattcgtcattttggagtgcagttcctccaaatttagccagtggaagctcctaggagttgactcctttgtccttttgacagacctgcatcattctctgacaacatttttacctttttggtacaatatgtttcaggatcttgttgtgctttcccttgccaaaatagcttggaatcagttatttttccaagaaatcctggtttcttttggtggagactgggatttagaaaccaagatctgggttctaggtatattctttgtttctagggtatcatacttctaggccttctaagtggacaggatatatatgtgtgtatacacacacacaacacgtgtatatacaagtatttatacacacagacatctatattatctatctatctgaaaccgtgacccttccaactgcagttcagtgtctcctgctttatttgggctctcccccaccctctttttttttttttttagacagagtttcactcttgttgcccaggctggagtgcagaggtgcgatcgccactcactgcaacctctgccttctggtttcaagcgattctcctgcctcagcctcccgagtagctgggattacaggcgcccaccactacgcccggctaatttttgtatttttagtaaagatgggggtttcactatgttggccaggctggtctcgaactcctaaccttgtgatctgcctgtctcagcctcccaaaatgctggattacaggcgtgagccaccacgcctggctgggccttccccctttctagatttgtacttccctctttgagagtgagaaacctgctttcattatcttcaatatacgtatatttatttgtgcagtctcccttatgtaaccagcctcctgaccatgtgggccatctctttgtctcctgtgctgcaccagtccagggtcccctgctctctagctctctagctgtaggctgattcatacccacctacactttccccttctctcccctctggaggcctgctgaccaagaatctctgcccgcttagcaccgtagctgagttcccacttgctgatggtatgcctgctgcattctctctgccctcactccttgcaccatgccttctgagagtctccccgctatactcactcactctgcctgtgcatcacaggaagtatcccgcttgtttaaaatactggcacctaattcaatttcataatggagtctgtaaaataaatcaatgtcaatagaacaaatttgacccatgggctataacaatactaaacatacaaacattattacacatataagtgtactaaaggataagcattattaatgccccgaggaaaaggtaacagttaatatatggccatattaacttagcgagcagtttgctttttaggctttaataggatggcagttatcaatataaaatgtatggtttggttgcatttactctaaaagaattaaaatgtggttcttggtttttggaagtacaagatccttgcttgaggtctcttttttctccacctcatgcagtgaccccacagatcccaagcagctcattgtaaccagtgttactctacctcatcaggagtttcctatgatagctgtagtaatacatttcacagggtggtagatttggccttaattacccctgttccactgagggaaatctcagtagaattttcaatgtctggtgacatttcagcaaagagtgtacatgggaagcgcctactgaatgtcctggtctcagatacatagatacacagctaaattactatcatgtaagaaaactggataataaagaatgtactactgaagtatacagaggaagagagactcctgactgaggggatgggaatccctccaacagagaatgaaaattctgtagatcaagaaagcaacataggaatggggtggatgataatatttcctttcctttaatgaagtattaaaaaaaaagagatgatgcatggaggggtatgttctactcaatctgcacttttccaaaaatctctctaccttttttcatttgttaaaaaatgtatctggctccacatatacttttttgtttgtttgttttgagacagagtcttgctctgtcacccaggctggagtgaagtggcgctatctctgttcactgcaacctctgcccgccgggttcaagcgattctcctgcctcagcctcttgagtaggtgggattacaggtgcctgccaccacgcctgactaatttttgtgtttttggtagagacaggttttgccatgttggccaggctggtctcgaacctctgaccttaactgattcgacctgccttggcctcccaaagtgctgggattaccggtgtgagccaccacacccggcccacacatacatttttacacagaaaaatctctgacctcttgtctggggtagtttccttaagataccctcttaagaatatatatttacatgacttggagcaaattctacttgtttggaatttttctgtattcagtgcccactctataggacacaaattatttgtacctagagtttgctttgggctttctctcacattcatagtactaaatctttctttggccatccctaaggatttgatcacacttccccttttagtttttggcagagctcaactgcttatcagccaagtaaatggcttttctctttagggatcccgttaaggaggctgatttgaattaagatgctctgatgtaattaaaggcagaaaggaagttggtgcagtgaatagttggtggtctatgtctgatagtgtaattttgggactgaattgctggctttcaaactcttttccacttccctcactgcagctacttccatatgatttgactgcccttccttcccggatctgccatctccttatgttcaagtcccatcttctttaaggtcaactcacaaggaatattctagtggtattttccccatcccctcagtcaggagtctcttttcctctgtttacttcagtagtacgttatttgttatctagttttcttacatgatagtaatttagctgtgtatctatgttctcattcaattgtaaaatatttaaaggaagactcaacgtttagtcatttttacaaaccttcaatggcttctagtacttgctaggtgcctaataagtacatcccagttttgacttgcctgcttgtcacacttattctctgtatttaccctttgctttgcatattatgtgcctcactcgtttaatatcaaagccctctttttaaaaactctatgtaaactttatttatgactatacatgcaaaacatttataaatgaaactttgaagattgaagtcatcactatattaagaggataatatactatgactagggagagtttattcctggaatgtagatggtttgtttcccagatgaatacactttttttgataagttgatgtctaatagaatttaggccatataaatcataattccaacagaatgttttatagatatagttaaactgattctaagattatatgcatatacatatatatacatacacacatacggggagagacagagagagagagaaaggcaaaggagttataatagccaagatgattttttatttttttgatttttatttatttatttatttttcaacttcttagattcagagggttcatgggcacaattttattccttttatggctgcatagtattctgtggtgtatatgtaccacattttatttatttaatccacaactgataggtacctaggttaatttcataaatctgctgttgtcaatagtactgcaatgaacatgtgagtgcatttgtcaacacccctctttttatattgtcatttactatacctcttttatccattggagaatgcctgacatggcctgggcttgatcctaacctggactacagagactagagcaaagttttggtcactcctggttcaaaagctgccctagttccatgatgcccataggtatctgtggacacagttgtttcagtcttctaagaattttacatgcatttacaaacaataaaataaataattttaattatgcctaagaatgtttttcttgtctttaagtccaagttatgttcttcaatttgtacaattttaaaatatttttaatatactgggttttggagtaagactatatgggataatatttttaccagagagccttaatatatttaattgatatcaattaattggtatgagaaacttcttttgtaattatgagttttgttgcctgaattcatactggatttccattaatctttaaactcaataattgcgcagtattctataagtgaattggtgcatgtctgcatcgctggaaataaagtttacctagagatgctgtcttagtctgttttttgctgctgtagcagaataccacagagtgggtaatttataaagaaaggaaattcatttctcacagttctggaggctgggaagtccaaggatgtggtgccagcattggctctgccatctgatgaagaccatcccatggcagatgggtggaaagtagaagcaagttaacgtgacacagaggaaattgggttgaacttatcctttttatcagaagcccactcccatgataactagctcgctgccatgataatggcattaatccatttatgagcgtgaaacccgcatgacctaatcatctcttaaagatcctgcctctcaacactgttgcaatggtaattaaatttcaagatgagttttggcagggatgttcaaaccatagaattccttcctggtccctcaaaactcatgtccttctcacaattcaaaatacatttattccatcccaacagccccagaagtcttaacttattccaacatcaattcaaaagttcaaagtccagagtcctgtataaatcatatgtggatgagactgaatgcatgattcatcctgaggctaattcctttcagctgtgagcctgtgaaatcaaaacaagttatctacttataaaatacaatggtgggacaggcgtaggacagacattcccattctaaaggggctaaatagacaagaagaaagagataactggtcccaggtaagcccaaaacccaacagagaaaacattaaacgttaaagctggagaataatcacccttgactctatatcccatttaccggatacactgtggctggggttgggcccccatggcctcaggaagtcctgcccccgtgactttgctaggctcagttcacccagctttaatgggttggagttccatgctggtggccctacaagttctatgttttcactggcagccctgaccccagggctccactatacattgccctagtagagattctgtgacacctctgcttctgtggcaagtttctgcctgagttccaagctttttatgaaatcctttgaaatattatgggaggaagaagccatttcctcaaagttcttccattctgtgcacctgtagaattatcaccatgtggacactactaaggcttaccatttgtaacatgtggagcagtgggttgagctgctcttggggccacttgagccacagctgggctgggcaaagagtgctgcactgagaagtggggagcagagtcccttggttgtcctgggcagtgagcctgtggagggtggagggtgccccaggcctatctcccaaaactgttcagcccttctagagcgctgagactgtgatgagaggggcagcctagaaaattttcagaatgattgtggggtctttcattgtcttgatgaatagcacttggcttctttttgttcatattaatctctttaacaaatgatcacgtggctatacccttagcattgtctctctgacatgctttttattctttacatagtcaggctgtgaattttcaaatctttttgttctgtttcctttgaattataaattgcatatttaagtaatttcttttctctagcattccactatatgtagttgaaagtaaccacacagcaacctgaatgctttgctgcttagatatttcttccaccagagatccttgtgcatcactgtattagtccactctcacactgctataaagaactacctgagactgggtaatcataaagaaatgaggtttaattggctcatgattcctcaggctgaacaggaagcatggatggggggcactcaggaaacttacaattatggcagaaggtgaagaggaaggaggtacatcttacatggctgaagcaggaggaagagagtgaagggagaagtgctttatacttttaaacagccagatctcatgagaactcactcactattatgagaatggcaagaatggcaagggggaagtccacccccatgatccaatcacctcccaccaggttcctcctccaacacttgggtttacaatttgacatgaaatttgagtggggacactaatccaaaccatatcattccttctctggcctcccaaatctcatgtccttctcacattttaaaatacaataatttcttctcaacagtcccccaagtcttaactcatttcagcattaactcaaaagtccacagttcaaagtcttatctgagacaaagcaagacccttccacctatgagcctgtaaaaatagaaaacaagttaattacttccaagatacaatagagatacaggcattgggtaaatatatccattccaaaagggataaattgatcaaaaaaaggggctatgggccccatgcaagtctgaaacccagcaaggcagtcattaaatctgaagggtccaaaataatctcccttgaccccatgtctcatattcaggcgacactgacacaaggggtgggctcccaaggccttgggcagctctgcctctgtggctctgcagggcacagttcctgagactgctttcatcggctggtgttgagtgcctgcagcttttgcaggtgcagggtacaagctgtcagtggatctgccattgtggggtctggaggactgtggccctcttctcacagctccactaggcagttccccagtggggcatctgtgtaaggagtccaatcccatatttcttcttggcactgccctagtagaggttctccatgagagctttgctcctatagcaaaattctgcctggaccaggtgtttccatacatcctctgaaatctaggcagaggctcccatgcctcagctcttgccctctgcatacctacaggcataacactgtatggaagtcatcaagccttatagcttacatcctctggagcagtggtctgagacttctctggggcccttttaaccatgactggagctggagtggctgggatgcatggagcagtgtcccgaggctgctcagggcagtagggccctgggccagcccacagaaccattctttccttctaggcctcagggcctgtgatggaaggcgctgccaagaaggtctctgaaaaaaaatgccttcaaggcattttccccattgtcttggctcctttttacttatgcaaatttctgcagccaacttgaattcttctccagaaaatgggtttttcttttctaccacatggccaggctgcaaattttccaaacttttacagtctacttcccttttaaacataagttctagcttcaggtcatttctttgctcatgaatataagcataggctgctagaagcagccaggtgaaatcttgaacattttgctgcttagaaatttcttccaccagataccttaaatcatctctgtagggcaggggcacaatgcctgccatctctttgctaacaaattacacaaatgacctttgctccagttcctaataagttcctcatctccatctgagacctcctcagcctggacttcattgactatatcactatcagaattttggttacaacaatttaatgagtctctaggaagttccaaactttccctcatctttctgtcttcttctgagccctccacattcttccaacctctacccaatacccagttccaaagttacttccatatttgcaggtatctttatagcaatgccccactgcttggtgccaattattcatattatttcattctctcactgctatgaagaactacctgaaactgggtaatttataaagaaaagaggttaaattggttcacagttccacagtctgtacaggaagcatggatggggaggcctctggaaacttacaatcatggtggagggtgaaaaggaaggaggcatatcttacttgtctggagcaggaggaagagagtgaaggaggaagtgctacacacttttaaacaatcagatctcatgagaagtcactattatgagaatagcaagggggaagtccacccccatgatccagtcatctcccaacaggtccctcctccaacattggggattattgtttaacatgagatttgggtgtggacacaaatccacaccatatcaatcaccctcaatttctacattccataaagtccgctgggcatggacacaactcagctaaggtctttgttactgtataacaaggattcccttttcttcaggttccaatgccttgttcctcttttttgtctgagacatcaccagaatggcctttactgtccatatttttactatgattctggtcacaaccacctaagtaatctctaaggagatttaggtttttcctatagctctcctcttctgagccctcacgagaatcacccttaatgctctgttcacagccataaatgctctttttagcctgctccaaactcttccatcctctatccattacccaattctaaagcttcttctgcattttcaggtatttgttatagcaacagccccactttctggtataaattttccgtctcagtctgctgctacaatagaataccactgaccaggtaatttataaagaaaaatttatttctcacagtctggaggctatgaagaccaagggcgtggcatcagcatctgctcagacattggcagaaggacagaaggtgaaagcaagtacacaaaacggaaaagaagtcaggccaaactcatctttaataccaggagcccactcccatgataactaggccactcacatgataatggcattaatccattcatgaaggtgaagccatcatggcctaatcacctcataaaaatcctacctctcaacactgttacaacggcaattaaatttcaacatgagttttggcagggacattgaaaccatagcatatactcttagttgtagctgtaaatttctgcaggagttctttaatgttgaaaaccatcttattgtgtaaatattttccaaattttaaagtgtttcatcttagtattaacttttaaggaagtttttaggttatttgatagatgatatcatgtggaggcccatttaaaacaatagcaggtaactattgaggcatgaatttgctatggatttactgagtgtgttctgcatgccaggaattgatctagctattccagaaacttcagtgaacaagacagacaaaggtcgttgccattgtggatcttacattccaaaacagggaggcagacaataaatagagcacaattactaagtagattatactgtctgctagaaaatgatgagagctatagaaagaaaaccaagtaaggcaagaataagcagagcaaagggaatggtatttagaggcctggaggcagcaattttcaagttttgccttttgaagcaaaggggggtcaaagaccaagactatagctgggagaaggagtgagggtcaaaagaacattttcttaagaaggcagaaatatgtgaaagggactcatttagaccagaatgaaaatgtggtgattcatcagacaaagggaagaacagctgatctgttcccttgagtaggcaggaggagaaagtatctaatacacaactgaggaattgacttgagctaggagcaggacactttttttaaggtaacagagaataaattccctatacacaaatctttatcaaaaggattcttcattgactcaaggcattgtacaaggcactgaaagaaatgaacaatttagagaaaaatttctgttttggtcaagcttgtggtctagtgcacaaaagtcttctttcttttgaagcaattaaagtagtagggaaaagatacagaatctcttgatgatgtcactatacttccataattatgatatattttgatatcctagtttcatcacttgtcatttgtgcatgagtattctctcaacccaattggtattctttgaagaaatgatttctatacctttccacaatcccattttcagctagacttcccaggttcaatgggtgtctcctgttcgtttctgcaaaaatcatcaccctgtaaagctgttcacatagcttgctaaatagtatgaaattgttgtgtgattggctatgagattcttagtttaatttagatatagttgtattcattatatggcaaaaaacaagagaatgtggccactgagctcttagttaagactgccactctccttggtaatattattcttattggaaatatgtgttttgattacacaatcttgatttaaagtttttaaaatataagtataaacggctatgattgccaataaaattgacttctgtgggagggagcagatagtggaaacctgtaggtgtcaaaagaatgtaacggcccttgcttttcaaactgttctgcatttatctatagtctttctatttatttcatttccatcacatccaataaatctcctctttcctcactggcaagtaagtctgcctacttcatgggaattgtagggtgttgctgtccatggtgccagacaggaggaagaaaacaaaaacttgttacatttgtttaacttgtttatctgttaacctctttattcttatttattttatttcatcagtaagagcatctcttcagttctggcctatctaaatgaaaagccttaatttaagcggaactaaaaattgacccagtcaaattgcagatgtcacaggcattactgtgccatttcctatgaagcctgtccccagtttaagaaatcactcctagaggaagctcttcatgttatttctctgatggtttccttttatctgtcctattctgttacccgctttagttgcattttaccctacaatattaattaaccatgccaactagggagggtttagagtcccattcctcagcatttatttagagactaattccatatattttccacttccccttgtgaattaaactcattatttagtttggatgcatctgtctcaatgattcccaggttgactgtaccattctggtaatgggatgcagagaatgaggcatatctctcatccaagcccagggagactatcggaaatggttttgaacaactgcagaaatgagctgcagttggttttcagatttgcatgagttttattggttcccattgatggtgattctctcttataagtcaccttgtaagccccaacatggattttgccattggcatagcaatctaaaggaaggacatacactagaaggaatgtcttatggtgactgactgaaacctggaaccagacatatttttaagtgtctttttagggatctcatactagagctacatacacacttaagtgtccattaagtgacagacacagtgaaaaaaattaaagtttcccaataaccatcacctggaggctttttaaaatacagattcttgggtcctatttcagacttatgagtcaagtcacacatttgacttgtgtctctaaagagtcgttctatgatgttaaccacttggatataagcctgagattgcacacatataataaagataatggcttctttgattgcatatctgctggaatatgttcccaaacctgattagttataagaatcttccaaggggctttaacaatttccaaatttccaagccttatttgactggcttaggcaaaagcagtgacaaagtatttttatattgaagactttctacaaagggctttgacatttagaaagcgttttgtatattatctacttgattctcatggcaatccataattacaattctgttttacgtgagaaaactgagtatctgtcataaaaattttcattttggaaatgaacttattcttttttcctttagtattcatgctttcttgtttcctcaggcagtagtttatcatattccgttgatttttctcatatccattgttagttggttcttttacatctgcataaattgttcttgtatactctgggagcctctactactgcaatattcaaagctataaaataactttctgaaaaatataactgtgtctttgatacttaaaagtacaaatgaaaaaacaaggaagcattataaattcccaagtagcttgttttgggagggtttttcatcatgcatcttcctcatgaagatattcgtttgcagtatgacatgtagcagaacttcggtcaatcaagcatttatgaaacacataccctttgcataatttatcatttacaaagtgttagttgagtgataatagtgttatccagcatttcctgagtgcatgatatgtgccaggcactcagcagatactttatgtaactcgtctccctcaaccttcatgatagctctaggtggtgggtactgttatcatcctcatttaatagatgaggaatcggaggcctagagagattaagtaacttgccccaagttgcatggttagaagtggcagagctcagatttgaaggccaggaagtgtgatctcagagcccgtagacttaaccactctgtgatatgaatcacatggaataaactccatggaattatgggactttgagaaaaactagtgaacaattgatatctttattcacagatgaggactgtatcctgagagcatggagaatggtgcctttagttacattatcctcatttatcaacagttgcttcttgttgggcagctttatccttcatcatcctttacagcctggggcacagaggtgggagagcaggggtcaagctggtgggctcttgaggcggatcatagggctaaaataactcagcctgcctgaattccaattctggcttaccacctattagatgtgtgactttgggcaagttctcagcctctgtgcctctgttttctcataataatgtgccaaccatatgcaattattgtgaggagtatgagctaacagaattgtgaaacttagaaccatgcctggatcaaagtggccactcagtaggtgttagactttgtgattattttgccagatcaaaaactttcattgttacatcatggactgaattgtgttctcctcagagtcattagctgaattcctaatccccagtacctcagaatgtgactgttttgggacatagggccattaaggaggtgattaaggttaagtgaggtcatatatgtgagccttaatccagcaggactggtgtcctcataagaagagggagaggcaacagggacgcacgcacacagacaaaaagccacacgaggacacagcaagaaggtggtcatctgcaagccaaggagagaggccacggggggaaactgcacctaccaacaccttgatcttggactttcagcctccagaactgtgagaaagccacttggtctgtggttttgtgttgtggcagcccaagcaaactaatacagacatcataaatggcagtttcagaaacattctggctgttgattaggcctggagtaacgatagctaaggcccttccttctctaccatcagtgctctctgtgccttgacacagcagttgtttttctagtccttgtacgtgctgtctgatttggtcacgatagaatgttatagatagagctagcatctatacccacagcaggagacaccgaacagcaagtcacaggaggagttgctactggaagtggggctcctttaaagtcgcccttgatttttgggtcagctctccgtgcttctcccctaccagtatattaaatactgtgctctagctattaaggtaaaggctgaaaagattttaaataatgcccatgatgcaccttataagtcaagtctcctcacacacagagagaaaaacaactgagtggtttttcaagggtcacaaattcaaggcaataaagcagatcttccagctgtatccagtctgcatgctgtgatgatttgatggcggtttaacacactatgggttagcttttccagaagatccgaatggagatctgtataaactcaaaaaagttagttggcttaagggaaataaatggagagattgtacatatgattattagctagatttctaactttgttttgttgaagctagaaagtatgtgatcatcagtcttcagatcgtagatattcctggaattggtgacagggatagttggaaattgggccacgaatcttggataaaactgtggaaactgagatgttctctttgacatttctcttccttccatgcactccctgcctcatcatcccaggaatatgactgcaaatatccagtcttatttcatctttatcttgtatcttctgcattaatatctgtgaaaaaaagaaataaaagaagaggaattgttttatgaagtcagtgctgggttcttaatgacagacagctccaatagtgcacagagctcaaagcaaggaaacagaaatgtaaatttcagagaccctgggcgcttttacatcttcccatttaacagcacctgaacttttcatagggagagctctatttcttagtaagccaggagtgcctgtagtgctcagtggcctaatgtctttgatcataagtggattcaaatattatgttattagtcatctgttaatcaaggtgctgattatggcctcattaaatctcatctccttgataatctaattttcttctaagcttcaaaaatgatcagcaagtttattatcattgctttcaagattgagttaacctgtctgaactctgagaaattgagccagttttaattttgatatgttacttcagccattttcaagagaaaaatgtcatcaaaggccaaaaataataatgtaactctgggaatgtctataggcttatgatcacagatgagatgacaggactcacctttgtaaaattgcaactttatgaagttatgtctcctaagatccacctttcatgcagatgttagtactgctggctttccacctgagcccttttcaaaatgtcagcttacagtttctgagttggagaggcaacttaatgaaaaatttttccataccgtgtgtgatattttcttcctcttgtctttctttttctttttataacaaaagttacttataaacataagttagtgctacactgaccatatattaacaagccaattcaacaggccattgcctatttaacaggtattaaactcctattgctttgagatattttccagacctgcttaaccttaataataaaatccacagggtttgttttttcttgtgcatttggggccatagtgatgcacacccctgccccggggtgtcatgcacatggtagtaggtagtacatgggaatggtgcccctaaattgtgcagtggttgctgctgccctaagtttagttccttagaaatcattaattcattctatgaattttgtccacaactaaattaaattaatgcctcaactatggctcctttcttctgggcagaaataactgagttaaaggtaaactaacaaaattatacctttttaaagactcttgaagtcttggcatatgtatttactaatattaatatattgcagcgcttcagaatttagtgtatctaaacaaaaaacagcttgactcaataatttcccacacccgttgcaccttcatgcagttggatcttctctaaggaggagtattactaggcaattcagacaacttaattataatagactcccctgccctcctgttgccatgatccctgtgaccaggacatagaacaataatttcctgatgtcttgtagaaaatgatataaagaaacaagaagggaaaatacaggcatataatctcaagggtgtagaactttgttttctgcacacacatgtgcaatacataattcacggctgaattactaaaatgatactttacaaagggatttggaatcagcttcaaattcagtgaaatctgagcaatgttataagaatttgtttaatttcaaacatctgctattcctgcagaataacaatcttaaggaaattttattgtgcaataagttttgtacaggagaaactactttatggcatattgtaggtggaggatttttctccagagctttttacctttttgattaaggtagaattttagatgaaattcagtgtggctattactgagtgattcatgaaaccgaaatactcatggggaaaattaagaattttaataattggaaaagaagaaagtcatttaaatcagcctttagtttatctgcttaatttgaactcatttattaagcaattattgtacaattttgaactttgttccactcttatataaaaaatctcttctagatttcttatttcatttaaaaaaaaactctgcagtgtttcccttcgacaagatgaatccagtatatggattggagcctgaattatttcactttatttctactgaaggaaaaggcaattagttaattgtggggttaatttcacataactttgttccttgaacatttgagaaaagaatgcccttccctgctacttttttgctatttctggatattctgagcaatcctggtgactcataaccatcccttttcatggccggctctgtataactgagggaacacatccttctgggtgagaagtgagccttgcttaactcggtgtccctcacacatttccatggaaggaccatgactggtacagcagaatcctaaagcagacagctgaaagcagcagaaatctgtgaagttctgtgtttcatccccatgctatttttttatccgacttcttaagaggtggcttagtggttgtaaaataatggtttctcttccatttctttcccttcacctcaataaattgatgttccagacagatcttttagctttgttttgtggatgtatgtgccctagacaaaccactaaatgcccccagattctacaattatctagtttgagaaatgtggccttaatggattcaagccctcctaattgtaccttttagggcttttaggctttagattggtttgggtctatatttgtccaggtaaatttcagatattattctctcttaaattatctgaaatctgatgggacaaatgattctggagcttgcttctctctcagttccattctatctctttccgttgcttgaccaccacttgggcttccatttgtgaaccgttcagtttgtccttaatctttccagtttgatttttctgaaatgtttctgtaaatgcttttatttcttttctgttcactaattctattgggctttttattgttgtggttagatttcagcctctctccacatttcagcatttcctctgttgatggtgaatcattttactgggcagtttgggctaggttatgccatggtagcaacatctcagtggctttcaacaacagaggttagtttctcactcatgaaaatgcaggtggtggctgtgctctgtggtcccttcactctgggatccagattgaagaaacaaattctgtatggggagaggaaagaaatggcaggagcatgtgatggcttttatagcttcagcttgaaagtagcacatgttacttccacttaagtttcattgtctacagtcctacagccaagcctgatgtcgctgaggcaggaagtatgatctttctccaatgacagatctggtagggaggtgcagcacagattgacaataaaatctaccaaagccatattttttccactttttatgtactcagaatgtgacacaatgctctcatataatggatatttagtaggggaaagacccacttcttttgttgcgatatgcttttcttggtggtattgagaacttcatcctgacttctctgggtcctcttcatcgactgcttttactcaagtgtttatcatcagcattttctctttattctcctcttcctctctctggaaatagttttctactacactttgctgtttggaaccccaccatgatttgctttattttctctagctgatggaagtttgccatcacacaaactttctgcatgtttcaacaagggaatagaaaccttgagttttgatttaaaaccatgttgagacactagaaagggagtcaattgtttagcactttgatttctgctttgccattctgaatagaaccattctgtttgaagttcatacgtgccagcaaatggactcatcctaagcttttgtctggtagtaaccgggtttatagagctgcaaaaataacctgagcttaactcaaatacagaatacctcacctgagtgttacatagatttcaaggaaataatgccactatacctgcacaatgcaagtgttatatggaaaatatcctaattcagaatcccttttgccgtcaagcatagtcttaattatttcttgtcagtttatttgtattaatcattatctttaaatgtgatggacattttgtttttgtacttcaacactttgaatggctgttgcaatgctaaatgtaatatgccttgcagtgcaattgttttgttttttgcttatatattttagctcccccactagattataatgaggaaagagggtccccccaccaccactcttttgggcaaatactaacaatgtttgttaaattgaacatggctattgaagttgctgtcctattattgagctcaaggtggagtcctgtatgctagctctctgcaattttgttaaatgactatgcaattaaaatgcatgcatgttttaaatcgactttcagttgtagagtcatagcagctactgttggtgctcagacatatgcccctagtacctttttctgagcccacaagactgacgtgccagcattggcaactctttgcctgagggcttctctggtttctggagccctctctgcttctatatagatatattggggaattaatgtcccctaggagcagctctagaaacatagctgacaggagatattggataaacgcctcagcttcctcgcctttcagttagggtatctatagggtgtttcattgacactgtcttccagagttcccgagtggaactgaggtccagttgcccacagtggtaacttgcttgataacgctgtctgtatcagctatcttcccttctctgcctcacttctctactctcctattggcatttctttgactaactccaaattaaactatttgcagtctcatcctagtttcagagagtctcggagtttctaaaaaagtatccaaaccaaaacaggcattcatatgtcaacatttacaatttaacagtttctctatttcaatgcagtccaataaaaatataatgcaaactacatagtttagaattttctagtggctacatccttaaagtgaaaagaaagagatgaaattttaataatgtagtttaactcaatatacccaaaatattattgttttaacatgtaatctatataaaattaatgaggtttttctggtactcagtctctaaaatatgttgtataaaatacagttacactgtaaatggaaaatacccttacagtacatctcaattgcaagtactcaacagccatatgtggcttgtggctaccatgttagataatggtgatcacttccctgctattataacccatgtgtcaaaatctagaaatttgatagctcttgaattagaagatgtgtaatgaattgtattatctattagcaaaatcttgccttctccttttgctctttgaagtggaacaaaatttctataaatatctagactgatggacattattgccttgtttagtctgtgtccacatatttatgtttttttccaagaatgagcttctggcaatagtaactttgagacttaacacttcttacatgttttcatgcagaatatagactagatatttagcatctgtgcttgtgttttttaggcagagggtaccagacttcagcgagaactccgaggatatttagcagcaatcaaaggtaatgtgtatgagttgtttactgcatgttacttagcacaggttgttcttggaattcatgagtgacaggattgagtgttaattacaaagccatttggcttcctggcaagatggatgcttgaacacaggtgttccattccaccaccgccccccccgccccaaattcccattgaaatgataatcagaatatataaggaaaaaatatgtgtgcccttatgctggaaactagaaataaatgccacccacatgccagagatttccaggaaaatttcttagagtgagcttgagaccttgtttaagaaaagctgcagccggcttacctcctgagggagaccacatgccaagagtggagcactcacagacacgcacctaagccctctcactggaaggggcaagacatggtggcaaaggtaggtggaagatgatcagcaaacatggccctggactggctttgacttgtgtggattagcagcgcttgcatccctaccgacgtgcaatgcacaggcatggagaggccctagcatgagtttctggactcagccatgtaaggcaaggaaatgaggccactggaggagggagaagagagcaatagggaggtgggctcagcctgtgcctgctatccatcatcacgctgcctgccctgagtcacagccaagtgtgcccacggatatgatgtatcataaggcagattttgtggggaaagaatggatcatctgacaaggggtattgggaaaactggccaaacacttagaaaacagagtgaaattctcaacctcacgctttactccctccttcctaattccagatatagtaaagatgtaaatatgttgttgtactggactctattaacttcagtagggatggcaccagattcaaggggccgaagaagggacccagagtcagcaaacaagacacagggttttattagtgggaaacttacatacagagtgggcccagtcatggcagggctgggcaggagtattgcacagccaagtggtggcaggctgggcaggagaactacatccgtttgcaaaaagcaatgcagtttctgtaacatttttgcttagcatcctctacctaacaacctccacctggcaaccttcgtttaacccaaaacacatggcctcaatcccctgtatgactcaccttcaatgggacaggctcagggctcaggtgttccttgtagacaaggaattaatctctcggttggccactcccagattccttagctcagaactctgagcacatattcaggtgcatctaacatacagggtgattctcaggggatgcctaagttatcactgtcaggtgtgtctgctatgcatcgctgtgcaaagaaatgtgctaaagtactagaataaaatacagtacatttagtctctaggctgtagagaaggtctttataagggttacttgcaaggcagaaacccataaatctctccataaagatgaagagatttgatgtcgtaagtatgtaaaacttaatatgttttttaaaaacaccattttgacaacatagtgaaagtaaatcaagatataaagagctcagtgagtaaactaaatgaaggtcagttggttaaattaaaaatgggcagaaaactctaagggaaaattagccaaagtagaactatagatggatgataaacgcaaaaaagccttatcctcatgaataatcaaataatattaagtagcattgaaaagaagattttatcatttttcctccaaatgttcaaacacattacaaataaaatactgtcatatttagaattggtaaagctctgggaagtggactccattcatgtattgctgggaggatagcttttctggagagcatttggtaaaatcttttatttatttatttatttatttatttatttatttatttggtatgctttttaacataccagtttcattctaagaatttattctcacagttttaatgtggatgtatagaactgaatataaacatgttattaaataatgaaataataaaaatatcaataatttaaaaatggccaaaataataaaaattagcaaaattgatttttaaactaaaagatatttatgaattttatagtccaggcatatcattttaattctcatggcagctctataaggcaggtagttttattatcttcattttatagataagaaagtgagttacagccaggcacagtggctcacaccacctttaatccgagcactttgggaggctgaggcgagtggatcactttaggccaggagttcaagatgagcctgggcaacatggcaaaaccctactgaaaatacaaaaattagtcaggcgtggtggcgcatgcctgtagtcccagctactcaggaggcttaggcaggagaattgcttgaacccgggaggtgaaggttgcagtgagtggagatcatgccactgcactccagcctgggtgaaagagtgagaccctgttcaaaaaaaggaaaagaaaaagtgattttttaaaatagagtttaaatagctcatccaaggttgcatgccaaggaaacaacagggccagattgcatatttcgttctgtgtttctccagagccctggttttatctactgtcttttactgcctttgaactacgtgaccaatggtaaggcattggtttcacaagtcagagttcatctatacaatggaataatggcaacctactactattactttttcatgagcacttactatgtgttagagtctgtgctaagcattttaggcatattacctgtttctaacttcccaacatagccatattatcaatgtcattaacttgattttacatttgcaaagaagtaagtctcagagaatttaacttccacagtttgatggagctcatcattaattactcccaaatcaaccttaagtatttgtaacagttcagtcagaaaatagaagccactctaggtatttcttttattattgatttaggatttgaacacggaagtcatttcaagcacaggactttttctgggttagttgatttttttgaaaatgtggataagtttgttgaatgaaagagtgagttctctttcccaagtctatttgatttggtctatgctgcctctttggtgtggagcgtgctgcttatagagactggcataattcttttccttaatgtgatctagaagaattccctgaggatgaggcttgagctccagagaaaagctgggtgaagcatcagataagcctttctggcagacggcacctgcactccagggctagtggccacagctccatatgacggagaaaggaattctatcagcttttccccatcttgggtttgctgattgactatgttaacaagcgatgctccaaaaaagagatctctgcttaaattactttgtccacagctgattggaatgaatttttaaacaggctactactgagtttctcagagcccttaatatgctaaagtcaactcagaagtcctgtgggacaggcaggaattccaagttatttgactgcaggacccttctctcttctcaaagcctcgtgaagaatgaatattgttcctgggaacacattttgggttttgggaccaaacttgaaaacaaggtatatgcctgtgttagtccgttctcacgctgctaataaagtcatgcccccagactgggtaatttataaagaaaaagagggttaatggactcacagttccacatggctgcagaggcctcacaatcatggcaaaggcaaaggaggagcaaaggcatgtcttgcgtggcagcaggcaagggagagtatgtacaggggaactcccctttatcaaaccatcagatctcatgagacttattcactatcacgagaacagcacgggagaaacccgcccgcatgatcagttacttcccaccaggtccctcccacaacacatggagattattacagttcaagatgggatttgggtaaggaaacagagccaaaccatatcaatgccttaagtagatcataatttacattttcaaaggctttcatgggcaatttttcttgttttcccaaggacaactctggctcactaatcctgctataacacaggtagcatcagggcagcataggagaaagtgatatttggccctggagggtcatgggtcctggggcaattgtgggaaaatcattgagcctcttagttgctttgggttcctcatctattaaatgtttcagttctctcagaagcccctaaaggccccaaaactgggattctgtgaagttgggttaaatgaattctaatcattttattgtgactgatctctgggtggcttcccctctatgggtctttatgatttctgctgatgcttaggctttgtgaggcagatcttatgcttgcattcattttagcagcaaacatctctggagctccatttgtgcacctgacactgttctaggagagggagatgcagagatgaacaagacatagtgcctgcttgcaaggagctcacagcagagtgagaagacacttaaataaaaaggccagataggcatagtaatatgtattttaatagatacgtgcattgagtgccatcataacagaggacagattcacaccttaggagaggcaagagactggggcaggaatggttgttccaaggaacttacacttgaatgaacccaagaagtggggtcataggtggccatcaagtcattaggttttctagagaaagatagatttcagagggacattgcaggtggaagaaacaactgggccaggaagcagaaggaagcacgggttcttgagggaacaaacagagcagtgagatgcaagcagaaaactgagctggatgaaacatggaaaggcagcagcatttatataaagaagtgcttcatgtatcatatcatatggggattttattctatcaatagacaggagagtcattgttagagttattgtagacaagggaaaacgtcccatgatcagattagcattttagaaaaatagttattgtgattgtgtggaattcaggctagaagaagtgaaattgcatggagatttagtagaagtttagtccaatagttcaataatactattagctaacatttattgagcacttatatgctaggcactgagataagcattgacatgtctcagtttatgtaattttccctacaaccttgtggcaggtttatttattagtattttacctcttggaaaactgaggttatagatgattaataatttgcctaaaatcacatgaatcacatgtaatggaaccaagcttttaacaaaggctgattaattgcaaataatagtcttaattattttgttatgttgcctccaaaaatattttgtattgtgatggctgacagttggacatttgcttgtgccaactactttgctaaatcgtgttatgtggattaggttatctaatctaaatcgtaggtgatgagtatctaatccagggaagggcagtgggcagggaaggaaggggctagatttaagaatcaggtggaattggtgactcagctttgggaggatgaatctgggataacttctagtttttgaactggggcaactggatggcattcatgagaactgagaaaaggagttgaagcaggtttggacaagaaaattaagagtttgtttttgacatgtgaagtttgaggtattagtaagacatccaagtggagatgtccagtaggaatttagaattgggagtcactggcatgcaggtgcagcagaggccagacacagggatgatgaacatgccagatctttctctaaatggagcacagtgcacgtggtgtcattaatagttcttcatttatgtgtcttatgtgtaggcatgactaaggggtagggttgactattcttgagctacctcaccaactgcctattttattccaactcttgttcccatccttgctctccttaagaatctaagaaaaagatgcccactcttgctttcctttgaggcagctgctgtctttttacacagctctcgtctaagcaatgggacaaagctgctagatacttgcagtattttagacgttcttttaatggtttatcgctgctgcttgttatcatcgtaatttattttaactgatgttatttttaactaaaacacatactctcaggctatttaagcaaggagtacttataaagtagtgcaatctatgcaacaagtcttaaaggatgaaaatagaagctcacaaatttggctgcaaatgggaatagacaatgttatatgaaatgtcttggagaaggtccaaaattttgaagagagtgaagtggttcccatccagtagtaaaataataataattcttctgtatatgatgctgggcatttgtcttacagttttagaaatcactaatcttttaagaaaattttggatattgtatattattcaatctcggaggtagcatttagcaccttttctgctttgatgttccaaattactctgaagagaacttgtattttagcttttttcgcccatcatactctgtcagaagagtaatccctaaatccctaaaagctctgccagtctggagctaggcttgaagcctttcacctgtgtatccatcaaagtgcatcctatggagtagatgttctcaaaacaatttccatgtcaaaatggcttctgtccaaatgatccatcaccacttatccaccctgtaattagtagttcttttggctgctaatagacatatttactgcaacatcatgcttttagtcttgatgattaaaatcttatataattttattttaaggttatattcatgattttatttttcatcacaaagattatttggtctacagtgccaaatttctttttcttctcttaagacattgttaaaaacctatctacacagttgtgtatagtttccatcagacttaagacaaagatttaaagaaaatgccagaagttttttggcatctggattatagaagggggtccactagtgactaacgcttgttatgaatttgaggggtatatttcttgatagagatttgcttgtacttgggtgagggtgaatttggacacttggcataatgtagcttccacctcagtgttgaccatatcatgagagaacgcatccccccttgcttggattcagagtgcgatgggttggattcaggttttgtctcctatttgctgtcccttcacctgcacgactctgtttcatcagagtccccagagtcttgagtcatactgtttttttcctaccccagactctgcaagggcttcgtccgatggtggtcaagtctcttcagctcatgtaggcaggacacctcattgtcaagggcttcgtggaatgtgcccagcgatgctctgagggaagggagatgttggctgtgtctaaagagagcacaagtgctatgaaacaccaagttacatgtggacttttatacatactcctcaaggatgtacttctgtcatttcagacatcttttagtttgtccttttctctcacagttgaacccagaattagctacctccaatccagcaagaatgttgagttttcagtttaacaaatgatttttatcttaggattcactgaccttaagtttacaggatgtgttttttatttctcatgacagtgctctgattttcctctcctctccctgtttccagcccccttttatcccccgtagtgacaaaggccaagacatcaatgtggccaggtcccaccttccggctgtcggggagagtcttctgccggaggcgcatctccaagtccccagctcttcctggccccttgttttgctctcagccatgagctgtcttcgtggcttttcagtacattcattaacctttgtgcagggggtccttgggagagactaaaaggactgggtgatactttatgtcaccatgttgtgctcagaagcatatatctttaatgctattctttaatgttgcaaaccatagttttgcaacatatcaaatgtatccctaatgaaaattcagacccaaaggcttaggaaccctaaaatttctaagagttttgatttaaaacttcattcatagttttaaataatacagcagatcttcaaatagcattgtttcattcaacatcattttgttacaataatgatgagaaaaaaaaaaaaaatctcagccagggccactgtccgtatggaatttgtacactgagttttctctcggtactttgacttcctcccacgtcccaaagatatacaggtgaagtttactggcatgtcagtgagtgtgggtttgtaagtgcaccctgcgatgatatgcatcttgtccagggctggttcccatcttgtgctctgagcctctaggagaggatctggtcacccatgaccctaaactggagtaagtaagtaaataattatcttacttgtttttattaatcttccttaaatgtgtgtactgctctcatttatttcaatgttcaatattagaagtgttttgacatttagttagaagttttgtgatgtgtctgtgacgaaaaatatgtcctggtaacttaactcttatttatatgaattagccttgggtaaaattggtttcattattcatcgtatcaattaaagtcacactttgcaagaacctatagatgacattaagtaaggacttactatactggaaaatgacaaactttttttctttgttctttgtaaaaattttaggccacttaaaacttaaccatttaaccactttaaccgtgtttaccattttaggccacttaaccacttttgactgttatgccctataatcctattgatttttacttctagtcccttctaaaaatgctttatgccatgtatttaaattcatttaggactaattttagtttgagaactctgcagttttatggaccagtgttcttagcatctgataccacttggcaagtgatagcacacgtaataggacacactatgattattgtagttttcagagtaggatacttgttgatctttcccgagaccccatatctatcattatcaagtgaataatagaaaatgtgcaatgtgataagtcttagagaccctcaaagaaagatacaacagcagatacaagcagcagttgtgcctttatagtttttccttaaatgtttagcaagtacaatatttttctctcacttaagaaagtggaggaagggagaagagaatcctcactcatttctgtgtaacgggagttgtttctctccaacactaggcatgcaggaggcctccatgaagctcacagagtcgctgcatgaagtctatgagcctgactggtatgggcgggaagatgtgaaaatggttggtgaggtaagagctggggtggcttccatgaggctcccacgacccttgctcagtccacctgtcccctgacttgctctttccacttcacagtcttaatcatgaggcaagacagtgtgctcagaaggcactgtgcagttctgctgcctgatgattccaaacttagagtgaaaagtgaagatgggccaggtgcggtggctcatgcctgtaatcccaacactttgggaggacgaggcgggtgaattgcctgaggtcaggagttcaagatcagcctggccaaaatagtgaaacctcgtctccactaaaaatacaaaaaaattagccgggcatggtggcacacgcctgtaatctcagctactcaggaagctgaggcaggagaattgcttggacccaggaggtggaggttgcagtgagccaagatcgcaccactgtactccagcctgggcaacagagcaagactccatctcgaagaaaataaaagaaaagtgaagatgatcataaaaccacttgggtagagagcagtgttttaagattcctttttgcaaaataacaatatcatttttctgtcctcactacaagccttaacagcccatttctagcagacatggatcatggtgtgatttgtgttgtcccaacttcacccgttcatctcaatccccctattgactatgcctccccaaatgcagggacaggagttcagaagagcatccattccactttaataccagctagtccgttcacaaatcttcacttcacgaagacaagcacaaagtcagactgtgaaaaggaatttgacttcaggaaggctttggccctagacatgtcttaacacttgaaatcaggcttctggctgacaggagtgagcaagtgggttttgttctctggaaagcagaatggaccagagactgagtagcgctgtgtgacgttggaccagttctttgatcttcttaggctttagtttcctcatctacaaaataaaaaaaaaatgtatctactaataagacacttattgcctttgtgtggatgtcctctacctactcagtgtttggtacatattatgattactgatgtgagacaactgccagtcacagattgtctcacatccaagttctttgttaaaacgaagagcagttgtttgtcatgtcctctactccaggtgagttattgcagctcatttaggcacagacgacctaaatttgatgtggcagccagagctcaggggaaggtctgataggtgatgcactgaatgtctgtgcagccttggaaaacctgcgttaacagtggagtcctaggctgctccatggatattctgacaccctgacattgagcttcataatcttcttataactgagatgctaacagagatttatttatgaggaaagcatttgttggctcctttacatctttcaaaaactttcaggatgtagatttggccaaagcagaccgcacacattactttcagatgcaattattaagtaattgcatcttctcacatttcttcaattaaaacacagtatttcaacatcatgttgctaaatactttgtaaatttctaattagtggtataactaaaaattcatcacaaaaaaataatttttaaggaaataatagaaacttgtgttaataacttttcagaacaccatgttaccttctatgtgtggcaaaggtcactattgccatttcttttttaaaggaaatgactgttatcctaccttggttcttgcagctgcccggttttttggaatcctcagttgcacatgcaaacataggctcttgtgatgatgaagaaactgaatactgcatgttcagagggtctactcacgtcagcagttgagcctttctaaacagtggatttaaatgttttggtttgcatgaaattcttgaattgagatttgtaaaaattaggactacttttcaaagtgtgagaaagaaacaaaagcaaattttaaaagtgtgtgtgtgtgttttaacaagatgaaaacttatgtgtcacatagaggaatttaaaggtcggcagtccaggtgttgcatattggccccacaagtatgaggggcccaagtttgccatttttagcatgccttcacgggcaaggtgactctctgagcactggccatcagctctcatttctgcatgccagttagcaaggaggatgaagtctggaagacagcccactccttccctctttttcaggacacttcctgaaagtacatcccattgtctagaacacagccacatgaccacacctggttgcaaaggagtctgggaagtggagtctttatcctaggtggccaagggccgagctaaaatgggaggttcagttagtaggaaggaagaaagggtagagattggtgacaaatagcagactgtgtcaagagacctggaatgtgctagtgagagaaatgtgaagatgacattcttgagtacctgctatttgcctgaaattctgtgaagcactttacattgccaactcatataactgggggaattgaaattcagggaggtctagttccccaaagtcacacagctgggataaaaagtcctctggtgaggcagcctggtgtgatagtcatttcctgactttcatatcatggctttgagttcaaggagacaaatctgagttgaagcctgtgtctgtcatttatcaactttataaccttggccaagttatgtgacatctctgggcttcagtgtcctcttctgtattgtggaaataacaaagtcttttctcataaaacaatttttgagaatgccttaacatagtgacagtaggaatactagttgtaataatagtaatacctaatattcattgtacgtttaacataattgatactccataaatggtaagacctttcccaatatgactgtaacttttctgttttccctggggaggcttcagaaatgatttgttgtttgtttcagtggtggatttttttctgatttcatggagtgcgtcaaaagcaaactgtcttagtggaattattctcagtctcttagccccaaagtccatctatagggttatggggatcttttgaagtttctgcattctttagtaatttagaatcagaaatacagttttaatgagctgagctctgagctagcctgttttgttaactagaaccagtggccaaattgccttaaaattttattgcattattaaatgattctcatttttcccctagcatctcatatctgggaaagtattacttgtctaattttatagtttcagatttttttagaagtttggtgaaaggtatccaattaaaataattcagcagtggtctctttatttcttttagaaatgtgatgtgctgtgggaagacttccatcaaaaactcgtggatgggtccttgctaacactggatacctacctggggcaatttcctgacataaaggtattttactctgtgtctataaagggaaggattgagtggggtcatgtagttattgaaacatgggcaagagaagaattattacaagtcctcaaactgacatcaaagatagttggtaacttttcatttatttaagcgtgggatttttatgttgttcctatcagtttgaaaagaaacgtcattacagaaatcacatttcgcttttagtgaactgcttcagcttttattattctacagaagtctttttaaacctatagatataaaatcataaaccagagctaccaaaagttccaatcttctttataatcaaaacttttattatatagcatttgacagggatttccattagaataaccagtggtcacaaggaagtgagaaatttcattgtaaatatgagagcaaaacctgatctttccttctttactgtctattttgcatgcatttatagtgaacctggatagtttttctctcactgaaattttcaggttgaagttaaagtgttaagatataagcattttaaatacatttgcatctggacctaaaaatattgtgtctgaaacattgatcttatttgacccttgaatctattacagaggtaaatggacaagtgaaggattgaatattgtagatttggaattgactctggaggtaaagatggcttttaaactatcagggttggtatatggtaaatgaaactaaatggatctgactaaatgtgttagacctattgacaaaatgccacatagagcaaatccaaacagtagattttcgatgatgttaccatattaggcagcaaagtgctttactaagtagttgggcaaatgcaacctaattaacaggtgtgaattgggttttaaaaattctctgagaaattaaaaatttaaattgttaaaaattctgtaagaccatgtgcaccagggaacatgttttgagacatcttcagataattttgattagtcactcaatttttgccttgggatttgtaatgtttgtggagcagacagtctcacaatagtaatcacttcagagtactgtttattgcatggcaaattattttcaaaattattttatttaatttatattttgtactttattgcggtaagaacatatgacatgagatataccctttgacagattttgaactgcacaatacagtattgttatctgtaggcacagcagatctctagaacctattcatcttacgtaactgaaattttatacccattaattagcaactgtcattttccaactctctctagcccttggcaaccatcattctatgtattctttgcttctctgaggttgtttgtaggtctttggagaaatgtctattctagtccattgccgatttttaagtcagattattagttattttttctattgagctctgggtgttcctttgtatattttggaaattaactcctcatcaaacatgtggtttgcagatcttttctccatttctatagcttgcattttactcttgattgtttcttttgctgagcagaagctttttactttgatgcagttcctcttgtctatttttgcttttgttgcctatctttttggtgtcaagtccaagaaatcattgctaacaccaatgtttattttaaaacatcttcatttagaaaatgaagcttccccccccctcaacttttcttctaggagttttacagtttcagagcttacaattcaggtctttaatccatttttagttgatttttgtgtatggtataagataaaggtccaatttaattttttggcatgtaaatatccagttttcccagcaccatttattgaggagactgcctgttcccagttctgtattcttggcaccctttttgaagatcagttgactgaatatttgtggatttacttctgggctttatattctgtttcagaggtctgtataactgtctttatgccaggacaatgctgttttaattactgaggtttgtaacaaattttgaaataagaagtgtaatgcctctagctttatccttcttcttcaaagttgttttggctatttgggatcttttgtgcttccatgtgaattttagaattaaaaaaaaactttctgttaaaaattccattaagattttgatagggattgcattgaatctgtagatcactttgggtagtatgggtattttaacaatagtaagtctttcagtctgtgcacccaggatgccattccatttgtttgtgccttctttaatttatttttgaatattgtatagttttcagtgtataaatcctttcacttccacagttaggtttattcttaagtattttagtatcttggatgctattgtaattggtattgctctcgtaacttctttctcaggttgttaccagtgtatagaaaggcaactaataatttttttattatattttaagttctgggatgcatgtgcagaatgtgcaggtttgttacataggtatacgtgtgccatggtggtttgccgcacccatcaacgcatcatctgcattaggtatttctcctaaggctatccctcccctagccccccaccccccgacaggccccggtgtgtgatgttccactccgtgtccatgttttcattgttcagcccccacttatgagtgagaacatgaggtgttcagttttctgttcctgtgttagttggctgagaatgttggtttccagcttcatccatgtccctgcaaaggacatgaactcatccttttttatggcttcatagtattccatggtgtatatgtgccacattttctttatccagtctatcattgatgggcatttgggttggttccaagtctttgctgttgtgaatagcactgcaataaacatacgtgtgcatgtgtctttattgtagaatgagttataatcctttgggtatatacccagtaatgggattgctgcatcaaatggtatttctggttctagatccttgaggaattgccacactgtcttccagaatggttgaacgaatttacactcccaccaacagtgtaaaagcgttcctatttctccacatcctctccagcatctgttgtttcctgactttttattgatcgccattctaactggcatgagatggtatctcattgtggttttgatttgcatttctctaatgaccaatgatgatgagctttttttcatatgtttgttggctgcataaatgtcttcttttgagaagtgtctgttcatagcctttgcccactttttgatggggtcgtttggtttcttcttgtaaatttgtttaagttctttgtagattctggatattagccctttgtcagatagatagattgcaaaatttttctcctattctgtaggttgtctgtttactctgatgatagtttcttttgctgtgcagaagctctttagtttaattagaccccattcgtcaattttggcttttgttgcaattgcttttggtgttttagtcgtgcagtctttgcccatgcctatgtcctgaatggtattgcctaggttttcttctagggtttttatagttttaggtcttatgtttaagtctttaatctatcttgagttaatttttgtataaggtataaagaaggggtccagtttcagttttctgcatatagctagccagttttcccaacactatttattaaatagggaatcctttcctcattgcttgtttttgtcagatttgtcaaagatcagatggttgtagatgtatggcattatttctgaggcctctgttctgttccattggtctatatatctcttttggtaccggtacaatgctgttttggttacagtagccttgtagtatagtttgaagtcaggtagtatgatgaaagacaactaattactttatgttgattttgtatcctgcaactattcttatttgtttagtagttctggcagtttttttgtagagcctttcgggttttccatgtagaacctcatagtatctgccaacaggtacaattttacttcttcctttccaatctggatgaattttatttctctttcttgcctaattttttcgtttgaaaagaagtggtgagggtgggcatccttgtcttgtttctgatgtcagtggaaagctttcactttttcactactggatatgatgttaactgtaagcttttcatatatggcctttgatatgttggggtactttccctctatttctagtttgctgagcattttatcgtgaaaggataatgaattttatcaaatgcattttctacatctactgaaaggattatgcgattcttatctttcattctattaatgtggtgtatcacattaattgattctcatatgttaaaccattcttgcatcccaggaatgaatcctacttggtcatgatgggtgatccttttgatctgctgtcgaattcagtttgctggtattttgtagcggttttttgcatctatgttaatcacgaaactggtctgtagttttcttttcttgtggtgtctttgtctgactttgatatcagggacttagaaaatgaggtttgaagtgttctctcccctgcaatctttttggaagagcttgagaagaattggcattaattcttttttaaatgtttggtagaatttgccaatgaagctatctggtcttggttttgttgttgttgggaggtatttggttgcctattaaatctccttactacttaaagatgtgttcaaaccttccatttcttcatgattcagtcttcctaggttgtatgtatctagtaatttatctgtctcttctatattattcagtttgccagtatatactgttcatattagtctcttaacctttttatttctatggcatcagttgtaatatatcacctttcatttctgattttatttatgtgagtcttctatcttatttagtttagataaaagtttgttaattttatctgctcaaaaaaaaaaaaaactcatagttaccttgatttttcctgttgtttttctaatctttatttcacttatttccactctaatctttatctttcctttcttttgccaatttggggtttcatttgttcttttcttagttccttgagatgtagagttaggttgtttatttgagatctttccttttaatgtatgcgtttatcactaaaactttccacttagtacagctttttctgctacttgttttagttttcatttgtgctgagatactttttaatatccattttgatatctttttggacccattggtcgttcaaaattgtgttgtttaatttccacacatttgtgagtttttcagttttctttctgctattgatttctagtttattttattgtggttggaaaagatacctggtataatttcagtcttcttaaatttgttaagacttgttttgtgacccttcatactttctatactgaaaaatcttccatgtgcaacttaagaaatatgtgtattctgctgttgttggattgaatattctgtatatgtctgttaggtccatttgatagttgctcaggtctactgtttctttgttgatattgtgtctataattgaaattgtaattgaaattgtggttctatctataattgaaagaggggtattaaggttttgtattattattatattgccgtctgtttctttcttcagtttgtcattttgctttacatatatagatgctttatatttataattgctgtatcttcctgagggactgacctttttatcattacatgtccttccatttctcttgtgacagttttggaatttagatttattttgtctgataaggacagccatccctaatcttttctggttaccatttgcatggaatatctttttgcatctctttattttcagccaagtgtgttctataatctaaagtaaatctcttgtagacaataaatagttggatctttttttatttaaattcatttagccactctatgtcttttgactgggaatttaattaacttacatttaaagtaattattagtaggaaaggatttactgttaccattttgttcattgttttctgtttgtcttattgttcatttgttcctcttttcctctcttgctaatttctgttgtattttgttgtttctttgtattgatatgctttgatttttttgttttactttcgtgtaacttccatatgcatttttgtggttattacagaatttagataaaatattttataacagtctattttaagctaagaactaaattaacatcaatcacctataaaaactctatacttttattttcaccacatgtatactttatattgtcaaaatttgcatatatttatattgtgtttccataaatatattttttagttatagttatgcttagcgtttttgtctttttgacttttatactagaattgaaagtgatttacccaccactgttacagtaataaagtattctgtatttgtctatatatttacatttaccaacaaatgttatacttttttatgctattgtttgctgtttagtgtcctttaatttcatgttaaagaaatctgtttagcattttttataaggtaggcctaatggtgatgacctccttcagctttggtttgtctagcaatgtctttatctcttctttaagaatgcaagaaacaagtattcttgtttcacagttttttcgttctttcatcactttaaatacgtcatctgacgcccttctggcctgcttctgctaaaaatccactaatagtattacagagattcccttgtatgtgagcaagtcacttttctcttgctactttgaaattccatatttgtctttgacaattgattataatgtgtccctgtgtagacttttaggggttcattttatttggagtttttgggcttcctgaatttgaatgaacattttctttcccagttttgggaggttttcagtcattatttctttcaatagctttctgattatttttgtcttctccttctgggactcccataatgcataaattggtttatgtaatggtgtcccataaatcccttaaactgttttcactattttgcatttgtttttctttttgttcctctgaccaaatgattcttaatgacctgtctgagtttattgatccttttttctgcttgatctaatattctactgaacgcccccccagtgaatttttcagttcacttattgtatttttcagttctgtcatttctgtttgatattttctatatcactttgtttaatttctcactttgcggatacattattttcctgatctgagtgacagttactttgaattctctgtcaggcacatcatatatctccatttcattagggttgatatttgtaaatttattttgtttctttgtttgaaacatatttccctgtttttaaatttaccttggttctctatgttgatatcttcatattagacaaaacagccacctcttttaatctttgtggactagctccatataggagaagaccttcaccaatcatcccagtcatagattttggaagcctctcaaacttttgactattctgacagttttctttgttcttagcaccccctaggcatctagagaatgctgggtcatttcagtgctctgagacaagcaagactcattttctttggaagccattttcttgggaagcccccaaaggttgtatcgttggatgcttgttcaactctttccctgcatagatagaagcaggaaactgggtgttttttactgtttgtttgttttatccctcagttgaggggaggggctgtggcaactagttgtatggtaggccatactacttagaagtgtgtttttatttgcttatttgtttcctcctgcttgctctacactaacctagggagaggagccatggcaagtgcctgcattcatgttcaaacctctgtttattctctgtagaccccagggactagtgtatgctggacctgacagctatcccagacaggcaagtagaaggcactcccttgggtagaagtcagaaaagttgggatgctagatgtgctgtcctatttcttcactcttcactgagaagtaggtagctggaggttccctcttcattatatggcactgtgctagggatagcaagaatgtagctccccttttcctgcttgtttcaatgtggctggatttgcacttgccaagggttaaggagctattcaacgagtttctgggtgtcttacaaacaaaaattgattcctgtgttggtattaaatctgtatgtttgtggggaaggagagtccagggcttcctattcttccatcttgctaccatcacctttattgcatggtaatttaatctccttaaaagcaatacttaagaaatcagaagaggttaaattgtgtcttcctacctgaaaattccaaagcagcttacaacttgttcaaattattcatatgatatatgttcatagtatgacttagctaagcaaataaaggctgtgactaactagagaagcaaacatctgaaagttttttgagtttcaggaacaaaaacttagtatcattaataaaatgggaagatcttagttattgtactatatttagaaattggccacactgtctaggagcatgtaatttcagaatacaagcacatacagaattacgtttattgaaacacagaaagattaaaataaaattatgacagattatattggctggtcttctcagtttattccatgtcagaaagatgaagagctcaatataacttttccttgagcaattcttttattgaggtccatggttgaggtcatatacaaagatgatcctgcagtttctgaaccatgtagagatttggaaacaatatcatctagatcttttgctggatgccctgaaggtaaggtaaatatacgttaaggttttctatgtatcatggaaagaggctgaatctctctctctctgtctccctcaagccacatttaggaaactggagcatacatagaggctatcaaccaagatagataattgtgaagccatataacacaagtaacagttgaggaaatcaaaatgctattaacttgtaatagctatgctattaacttggaaaggagataatttggaattggaaagtgagaagatagctgtatttaatatttgaaagaagtttttctgtgaaaatggacttaagttattctgtctgcctttattcagtgaagggaagttagaagtagatatagactccatcactttataaaaatagtgttgagtgattatgtaatgaatgagctatgatggaaaggaagattaatcaacttacatttaaagtaattattagtagaatactcggtggagtattttacaaaaatactcagtggagaatttttaaagcatggaacacagttgacttccttgcctcctattgaaatcaacaggccatgtgcagttaaaacctcaggcaaatttccaaatatttacttgagcccatcagtgagggctatgaaggaccattcatgaggggatgatgtttaacttttccagctgtgattggcgggataccctgcgttatggtttctgttatgcagcattgacatctgaaatcactgttataataagagcctgcttgtcaccaacccaggcaggcttacagctgtgagcagttattgtaaaatatagtttggattctatcttggcagccatgcatgagcaactaagcatgtatttactgcagtgtaccaaaatgaattccaatttgggattattatggaagtttaaaaaatgtataataacttattttttaactatagaggttcagtgcacaatgagaaatctcaacaacttctttttctcttttcaagaaatgtaagttaaatttataatgtaatttaattaagtttcctattggatggttaaataagagaattatataattttccattaaaaaaagctaatgtgtgtcaaccttacccttatttaggagatttgggttttccccccaagtttcccaaatatcagataggtaaggaaataagattgatttatcttttctaaccccaaaatgtatgcatcaaaatgagtgatattcttcaaaatagtcatttctaccatggtaagctatccttgtaattgacttaaaaattacataagaaaatgagtcacattatttactttgcttcttgtttttgaacaaaaataagattacccagtgcactcttccatcttattctaagacttaaaagttattgattcatagatgctttcaaaaatcaaattcatcttcagagaatcaagatttgctacttggaagatattaaaggaatgccccaggctagaaggcaagtccataaggaagagctttataagagtttgcatatagttacgtaggccactgcttcaagggatagcctcctttgaaggtaacacatttttgctaaaagtaatgagccttgtcaccttataggcacatggtgttcaccatacctaattgaagggtttccactctactctgcctaggctaactcattgcatactttgagtgactgggtgtgtatctccatgctttctgctagtatactagttgtaagtggtaggtgcagggaaaatgaaagcaattagaaatagccaaagaggttaactgccccaacccacctctcaccagtcctgaagggtgtgtagaagaatagcatagagtgacaggttgtagttgactcataaagtctgtcagagaaatggtgggagctgttggaagaagcactaaccgagactgagaagcagggatgagattggatgaggtgagcaaagaacccgtggtgcaaattagagggaggaagttgctaaccctgcactcacatgaccctgagagtaaggggccttcttaaattttgtgccctgtctcacctgcctcaccctactcctggcgctggtcactggggccaacttctaattcagttcacttttgccacagacttgctgagcaatttcggacaaattagaggttatctcatgcagctccacatttcctaaaagtaaaatggagataatccctgaaacactcattctgtaggttgctagaaggatccatcagatgtgacaatgccttgtaagccataaccatttatattattgtgttttttttttctttttcctaccatatcaaattttttaaagcatctcctcctgggttagttcttatttttcaaatagctgggcataactggactacggggaagattttttttaaactgtagatatctagggcttgcctcagtctaattaaatcagaatctcttagtgtagggctcaggagtcaatatattttatgatacttccttattcgttctacttatttttacatttttctcatttatttgatgtataacaatttatttaattggcatataataattgttcatatttatggggcacgtagatacttctttattaatttatttcttagttgctgccttataatgtataatatacatctttaacatattaggtttaacttgaaatgatgtattacttcatgtattatttaagaacagtacaacagtacactttcagttcccacctcctttcctttgcactgttattgtcatacatttttcttttacatgttataaaccccacaatacattagttatgtttttttgctctgaatgatcagttaccttttcaagcaattaaaagtaggaaaacaaaatcttttatattttacattgatttttatcatttctggtactcatttttctgtgtagctccacttcatattaaaattcttatgctggcaatgaattccctcagcctttgtttgtctgaaaaaaaatatttcatcttcacttttgtaaatattttcattgggtgtggaattctgagttggcagatttcttttaacttttatttttcagtactgtaaatatatcatccaatgtgttctggtttgcatggtttctgaagattagcatcccgtaattcttacctttttattgtatgcttttcttttattcttgatgttaagtagtttgactatgatgtatttagatgtgtattgtttggtatttttcctttttggtattctctgagtttcttgcatctatactttgatgtcttcattatttaaaaaaaattttcagccattatctcttgaaatattgcttattattctctcatctctttttgagacctcaattatattatgttagaccattttatattacattgtaggtcttagatgctcaattctctgttttcttcaattctttttcctttttgtgttttaatggaaataatttattgtgacctgtcttcaagtacactatttatttcctcagctttttcgagtttagtaatgggcccactgaatcaatttttcctctctgataacatttttaaaatttctagtgtttccatttgatttctatttgaccattaacgtttctatatctcttctgaaattccccatctgattatctttgttgttgactttttcaaactagatactttaacatattagtcgtagtcattttaaaattcctgtttgttacttccaacatctgagtcatgtctgagtctgtctctgttgtttgctttaccttttctcatggattgttgtttttttgtttttgtgtattttgtaatttttgattgaatgccagacatcatgtataggatagtgagtactgaaataatatttatgtctggaaattggccagcctttttgtcaggccgttaatgtgagagttggaatcaattaatcaggacctgagctgcattgggtctttatttttgctattgttacttcagtgcaccgcagctttcaaattcctccagaattggactgctaatgccttgtacttatattttaatatctgtaatattttcaaattcttaggttgaagcctgacttgggggcccttaggtgctggagggtttctctcagtgtggctgctgcttattagattttagttgtctttgtatgcctgtagagacccctctgcagaaggggtctctctccttgcactgtcctcctccagtggtaggccactattgcttgttttttagtgttatagcttgtagtggagttagggctgtttttgttgttgttgttttgtttgtttgtttgtttgtttgtttgttttaaatcctttcccggccttgttttaggcaaagtcagcctcatatctgtggttggatttgagcgagagtttccttccctgcccaagttggagcagtccactacttgttgtaggagtcaggtcttgggcctaggaagcttttatgccccttgagactttttcttttacccttttgcctacagcaattatttttgcctaaaatctagaggtcagaaggctctccatctctaccagagccacattggttttacttttattgctccccgagaagcagtagatctttgcttgcacctgtgggtagaagggtttggtgccccctcctcaagcggcttaaagctttttgtttttgtggttgttgttgttgttgttgttaagaggaaatgttccatagaaatgagcagggctttacgcctatcccctagcagccatatatcacctcattctcatccacactgcaagggaatgtcttgttctcagactttctcatggcttccaatgttgacccatgggaaagagcttgcccattagcacaatctgtgcctttggccctgtgtctttggccaccagctattccaaatgacacattagtccaggggattctaatgaacaaagtattgagaatcacttgtaggaaaagagatttcttgggaagtaaatctgtttttatagaattgctgttggtgtgagtgttatcagaattataaaaccaaatctaacatagtttcccactatcttcagaatagaacatttaaagatttcgactagagaataatgagtatagttttgccttctctccctgaccaattctggattattttctggtctttgactgcaaactctgccctcagctgcttgtgattagcctaattattatcaaaagggaagatatttatctaatggcttcaacacaaaggattggaggtgttcatctgattttcaggagtcacttagctagtgaaactccagcccatcttgatctccagtcaagatcctcagcagctctggccaaggaaagcattttggcacctggctgtcaaagggagactcttatgtccatgcttctttcttagtgagtgcatttcctgttgacagaatcgcatcgccaagcgcagcaggaagctagtggactatgacagtgcccgccaccatctggaagctctgcagagctccaagaggaaggatgagagtcgaatctctaaggtagggattgagcccatggtgaataccactctccgtattttatgacctgttgcagctttactttttaaaattaaatgcctcctctataaaaggagattggaatctgaacagaatttaaactgaaacatagtgctttttattatttttaattaaaataaggcttttcattatattgtacagttcatatgggggatactgactcacacattttgatcagaataaactttgacctacaatgttgcgggatcaaagaaagtagtgtgtctgcacttccttagatggttgtggtccaccctcagtgctgaaatgcagatgcagatgggacaccaagctgaaattctcagaggtgacttttgattgtctgagagtacggatgtgtggatttgcataaaacaaattttctgttagaaaacattttttagtagctttcaccatgtatgtcagcaagttacagatgccgactaactgaagtcacctcctaactataccctcttcttccagtcatgccttttcctatgtgcctacacacagctgcctgaatggtctttctacatcgagatatgtttctcaactgcttaagtcttttaatggtttctattgcctctacaaaaaatactttatttcttagtacagcataaaagatcctcacaatttggctgtaactcacctgtccatcctgatcaactttcaagtctcctttcccctcctcgccttcttccataaacataccatgagccagaactacacatcagtttctgagcagttcacaataacaaatgcccttcatgagaggcctcctggataccaggcactctgttcaacacttcatctacattaactttccttaatactcaaaacaacctgtgaggtacacagtggtaaagcagtctgacaagttcacatggtaagctggaattccatttcaaggctttccacctttatgtattgtaatgtctttcttaccccctcctttagcaaacattttctgattctttaggattcagttaaaaaattaccttctctcttctctgcaccaccttccatatagcatgctctataacacattgtaagtcccttttgtaaatacatcctgtaatgtaattatttagactttccactaggctgggaatttcctggggatgcattcatgttcagtatccatagcagagctgtctacatggcaggcagctaacacatttttgtagaataaatgaatcagccagaaactgcaagagcaaccattgtaatcaatccggtttccagttttagggagtcttagtgtttcatgtttaattgaaaaacaaggatatgcttttaaccaaatactctccttctcaaaatatttccaagatgccataagactattcttattttacattaaatgatgctgttgtgtatagaaatggtctttcttagtgtaaacacatgttatgtttcattcctaggcagaagaagaatttcagaaagcacagaaagtgtttgaagagtttaacgttgacttacaagaagagttaccatcattatggtcaaggtaaaaatgtttctctatgggttgcacatgttccttttagaaattcaagatcagtgaatatcccttatcttgtctttattattactgtgacatttcaacactgtccagtgaaagtgttctttatctgcgctttccagtatggtagctacttgtcaccagtgggtattgattgcttggaatatggctaggattaaaaaggaggaactaaattttaaacttaatttattttgttctaatttatttatatttaaataaccacctgtggctagtagctgccatataggatgacacaattttagaccttgatctatttctcaagtggagacctaaatctcaattagaggcattaggaggactgcccttcatcttgaaacttaacaataatatcctttcagttcttggaggaacttcctttattccaagagctcatctagtcatctggcttagatggtaagcctctactttaagccctgacttttaaatctgaactgtatttgtattttaagcaccagatattcttacttacacgttactctgcatttctcgtggaattacgtgcattttgaaatagttgttctgtttttcctactcagtggtagaacaaagaagttgttggatgaaataggaccttatgatccttaatctctgtcagcatcctcatgctcccaccccaaattagccagagttgtgcttaaaataatgccacgttattttaaatcaggtcctctatttcttaacttccaactagatggatttgcctctaaagccttcctatatacaaattctagagcttctatttacccaccaaaattgtaagcattttgagggtctatactaaagtttgcccatttttgtgttcatcgctagtgtttttaatttttgccaataaaaggcactctgtgtttctctctgaactgaaatatctggatgaaattttggctagtttttacctcagtgtccagccatcacccaaagtccaacatgtgaaattatgtcattgttcatctgaatttactcattctctctacatctgcatttctttttctttttatttatttcattttattttattttattttatttttttggtgccattatttctgggttccgaaacctcaaagctttgcaattgttacctacaggaaaccaaagagccatcaaaataatcaatctatcattttttggtgtgggcttctggatcactctccctttctctggtcccactgtccccaccctaaccctcgtcatcctgttgtgtattatgatggtagtcttgcccttacatttctttctttgacctcttgctgtacaccttttctttcagaagctccaccttgacatctctgtggcctgcttaggacctcactgtatgtgcctaaagaagacctcttctctcccccagagaggatttaaacaacctgaatatatacaacttttagggatagagataaaacaaatatctatttatgatttgaatttatttagttattcacatttatttaaaatcacaaattatatgatgctatggcttttttttaaaaaatacagatattacttttttgctcttacatttcatggaatactttttttttttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccttcatggaatacttttatccaaaatctttacatatatctttagcatcacttgtttttgtccttacttaagatactcatcatctcaactagtagttctccagagcttatcatcatcttcaacagctatttagttccaaacacaggttgtcatttacatacaattaagacagttatactttttatttcccctgtaaaggaattttttatgatttctaatgtaattgcttaatcgctttttaaactgatcttcaaaaagtcttgggtaccacagtgttcaaggctttcaattatgagataatacccctgggaaattgccagtgccaattatgaaactttggggaaattgccagaattgccaagagacagatatttattatttgccttaatatgtattgggtatataactaaggtttttctagtgatctctactacatccaaaactagcattgatgttatttcagtcttttgtgcccttcctaagttgtatttggttattcaaagtaaagtaattgttggagtgtctcgtagcgtgaaagactttgtagggacttaaaaacaaagggaatatctgagggataattttggaaagaaacctttccccttttctggtcatacgcagtataaatgtttcaatgcttttgaaatcaatctaatgtctcactctggcacttaggaaataacatcagtcaaaactagtttttcaatccagatcctgcctttcgatcaaaacctgacttaggccttcctttctatgtagcatatttcttaatgaaatccagattactcaaccataataattgtgtgcattgtgtatgctgtataccaaagatcattttttggaatactttctatttgctagctgtcattttatgtactttacatgtataacctctaatcattacaattacagatctctccatttcacagatgagaagctaaagatcatattaattaaataccttaccttaggttgttaagcttgtaaatcctaaaggtagcatttaaaaacactttggtgttttgttttgttttcatgtgaatcctgctgcttttatctagggcctctctttatctaaaatgagattgcatttagtcataatttttcaagttattccataaatacatatgttctttaacaagccatattactcaaccttgaaattgaaattagtattttgtatcttctttgcctcctatgaggaaatgcataatactgggtatgaagtaataaacatattacatgttagttattaatgcatcaaactatttataatccttcagaatgttgagtggaatgttctatatatgcctgtgaggttcaggttgactatatgttgttcaagttttctatttccttactatcttctgccttgttgaaagtgagatattgaagtctcccaccattattgggcttatttctgtcttcatttctgtcagcttttgcttaatgtattttagggctcttttgttaggtgtatatatgtttataacttgtatatcttcttgatggattgactgttttttctttataaactgtccttctttgtctctaataattttgactattttgtctgatattactatagccattcaagctctcttttcattactctttgcatggaatattattttttccatttttaaactttctacctatcttgaatttaaattgtgtctcttgtaggcagtatttagttggatcatttgtgtgtgcacatggtgtgtgttttatccattctgccagcctctgcctttcgattgctgtgctcagtccatttacctttatatagttaccaaaatgtaggcttttctgtctactattttggtaattgcttcgtgtgccttatgtcttttttgtttctctattcctccattactgccaagtgtagaaaactttcaaatttttggatttaaactgatcttcaaagattagtagttcatgagggagaaatggaactactgcttagagggggatgcaggttcaattttaaaaaaggaaatactagaatatgattgcaggttgtaaaggagcttatagattatatagatagagatgatagagtggtatcaccaagaaggaaggactctaaagagaattcttgaggtaaatcttgtaaaataagtaaagccaccatttagtgaaaaggatattctaggctgacatagagtatgaataaaggcctgtgggttgaagcagatatctgggttcatggaactttagtctaatgtaactcagggtcagagtgatagtgtctaggaggggcttgtggtgatgaagcaggagaaagatagggatcagatacatttatcatgcattcaacaaatatttattgaccacctactgtgtgtgaagaactctgttagatgttaaagattctgtactgaaagtttttgtttgcttggagcttatattgaaggacagggaaaggcagttatctttaaaagaaatgaaaaataagatatcagacaataagttcaatgcagaaaaaattttaaaaaacgataatttagtagagagtgacatgagatggtgtaactcagactatagtttggatgtttagggaagttgtccctcaaacagatagacaatatgtaaagaaaaggaaattttgggaagattgagtctggcttatatatgttgagttgaagaatcattaggaaattcaaaaagatatgtctattaagctaagtctaaagcttgaagagaggtttgggagtcattaccatatgggtggtaatgatgccatgagagttgatgaattagatggtcggatagatcaaatggcaagatgaggatcaaagcagaacctttgagagcactaatattttatggaatgtgcaaaagaagaggggactgtggaaaagccttccaaaaattaatcagagatgtagaaggagccatgacagagggatatctcaaaaaggcaagaatggagagaattttaaaaatgaggagtgccaggactatcatttacaatagaggtatcaagcagatgaggactaaagaggcatcacctttggtaaacgtccagaggggtttcagtagatgttgggatcagaagcttgattataggcattggagactccattggagatgaggaagcagcaacagtgtctgttattttgaggattctaactatgatgggcctgaggaattgtggcagctggtatagggaaattagagggcaaggggagctttctaaaaataacttttgtcattttgagaagatggcatagttgtggtaaaggtggaataatttaggactgaagatatgtggggcaaacaggggatcaggacaaggaggaagggtgttgataggactgaccagagagtgttgaggggtataccacagggcccaagcttgataaagcaggatgttcaacctgatcaagggtagtggcctggaagaaaagtgcattgatctcacagaggttttgaaagaagcaggtggaatggaaatgaatgaatgagggagctcatggcccaggaaattaggttagtgggtgggccactaatctgccccatttcagaggtgaaatagttgtgagtcatggcaagatccaagatgtcagaggccaatgcagaatgtgtataaatagaatgctggggtccctagttagagggctcatgttttggctggatagtcatagggttgttgagatctactgtgttagtgttaggatttggtgagggagagaggggaaaccatgaggcatgccattgtggattgtggttggggttgaggagtcttgctgagaggttgatattaagctttgaagaggtttaatatgagtgccattaatcctgaaatggagtgtaaatgagcttagaggatcagaagagagctaggaaaaaactcttcctcatactccatctccatagtaagtgaaggacagcaagggttgcctcctccactgcaagagggtctgcaggaagcactgacactcccctccagggaggcagatttccttagggcattgcgaaggggagagtgctcaggtctgcaatctgtagctgtgataagctcaacttaatttttcctttatttctgagaacaaagaaacatcttaataaagaaattaagttggttttgacagctaataagaagtgtcctgaggatgccacatttggggaaatggtgatgtctcagagtccctgtgcaaaatgaaacttttaagcagataatatcagaatcaagagcctggtatgctggtactctgtgtctgtatgttctttttttttttttttttttttttttttttttttgaggcggagtctcgctctgtcgcccaggctggagtgcagtggcgggatctcggctcactgcaagctccgcctcccgggttcacgccattctcctgcctcagcctcccgagtagctgggactacaggcgcctgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccgtctgtatgttctactgctggttacattaagtttttacaagccagggtcacatcggaatatgctcttatagtggaatgagtgccaagtttcttcattcactggcttgtttgttcatttatggaatttattcatttactcatgcttgccgtgtactaggtgctagggctgtaatagtgaactagttaaaggcattcccctctttgcaggatctctgacttcataaattggagaaaatcactatcagttgtatcaaaaatgttggacactttatcctaattaaatacatgctagttaatttctaaattaaaaaacaaaatattagaaatagatgtttagttattctaaataagatatttctgatactataccattttctcaggataataattgatttgacaacttaagatatgctgtatatcagaaaacaaaattgaaatatagaagaatgggacttcttttttgtttttgcctaatgcatccaaagttaaatatgtttaatagaagtgccattacatattgataagaaaaacaatactaagaaataaaaaaatttgaataggtgattcacaaaagaaggaatacaaatgagcaataaataaatgaatgaaagtgttaactttaattgaagaaatataaacttcaaagtcagtgagatgctaacttttggctatcatatttataaaggttgtatgtaaggtaatgtaagggactataagtggcccagtctagtgcgaccagttgagcagtctgacggtgaacatcagtgcttatttggttcactccttttaccagcaaataccttcaagaaatctgtcctaaggaaatgaataagctgtgtacaaaaccttaatcatagatattcattagggttttatttaccatagaaaaaaattaataaaaataaaataatactctccagtgaagttcagcttacacacctcttccatctgtacccaccttctatttaaattggacacttctttctgcagcccaagtttgtcctcttaagcagatgtttgcagctgtcacagggcccattgctctcctctcttctcagtttctctgtttctgcccatatccactcacttttgatatgtaatcatgtatgccttcttgttgtaacttaacattcccatgtggttttataagctgcttatttctaatatatatatatacacatatatataaaatctgcttatttctcttacacacacacacacacacacacacacacacacatatttccattgtaagtataaatagagcagcccctctggatgcttctctaactggattgtacgttcctagagacatgttcacctaccactgtgcatgtacccagagttggataggtcctttgttgagtaattgaaggaagtaattgaaggaagaaaagtgttaagaattactgtcccagttgattggggccttggagaaggggtcatgagttgccactcaaagtaccccagaagacttctctgcaaacactgcgagtggggtccctctgcataatgtataggtagcctgtagggtctctccttgcctgtcaagctgctgccttaattagcttcctcaaatacaggtgcaagtgttctcctttgccctatctcagacacatctaggggttgcccactgcctgccaataaatattgtgcttcgtggtctggcaaggacctctgccccagagaaccatctgcttcctcactaggctttcctctcccaggctctggtctgatcttcctgggggcttaccatttcccaaacacactgtggaggattttctttattaatgaatagatgtctatatgcatgtgtatttgtatgcatatgaataggtatatgcacatgtatttatgaataagtatatgatcttttaaaatcaattaaaagaaaaatatatgaagtcagggtcacatgatcactgtaggtatagaaatttaagattaagtcaaatatgttagggatttaagtaaagataagccatagaagaagttaatctcattgctattatgaaggggcagcttatgttttcatttactcagtgatgacacgctcttatttttgatgagcagttagaattaatttacgggttttgtatttccttctatgaaacaaatttcagagtccaaacacataataataactagaccatttatagtttataaaagttaataatgaacttctcaaatcttgaaagcaagaaacagtaactaaaatataaataagttctcagggcgggggttccataagcgttgtctctgaatcagcagcatcagttatcacctagaaactcatcagaaatacaaattctcagtcttcatgttcagacctactagatcagaaacacacccttcaggtggttctcatgcacactaaagtttgagaatcactgtcttaaggcactgaattttaggagaggtcatgctctatgccaaaagatacttgtttttgttcattaacagatgaggaaatgttgggcttgctttgggttcagtattttatttagtccaaagttattcaaaatggtgtaaaagaaacctgggttttcatacatttcattgctattaaaattatttttactgactggtctttccctctctcttctttcctctttgtgtttccacatggcagacgagttggattttatgttaatactttcaaaaacgtctccagccttgaagccaagtttcataaggaaattgcggtggtgagtcatgacgataatttttgcatatggaatataaagtaaaggaaggtttattttggaagcaaatgaaatgggatagaattatccaaagaattcacccttttgtatgtttcttttagcagtgtgttattaccctcgataacatttctacggtttttcatagtgatcacatagttctttgtatcttttgaagattttgccacagttttacagtgttgtttcttttaccaggcagtttataaagttggaattcccagtggtattttaggctaatgaaaaattgctctcaaagtatttagataatcaactctgttgttgattgctttttgttgttgttgttcaaaagggtggagtcaatgtaaacagtaagcttttgttttctgccctgtactctggttaataaatatatacatatatatttagtttactcgtgtttcgtttgtttcagttttgacatagattttaaatttgaaccgtatacagaatttcagttatcctgaggccatccaagctatcataaaatttatagcttctcaataagcaatttctttcttggggagaatagcctgaattggcaccagaatgacatgtgactaatagacaagtggcctctgtccccttagctttgccacaaactgtatgaagtgatgacaaaactgggtgaccagcacgccgacaaggccttcaccatccaaggagcgcccaggtaggcccctgctcattggagcacctgtaatgtcctgcttgctaaaatttcttcaatctgtggaccagcctgtactattttatttatcctacaaaagtcccacaggagccttttcaccctagaagctgacactaattttatttttgtgcttttacatttatgtctggccttcagtgacccaactaggattcttcttcttgtcacaacagcattgactttctgcctctctgcctctctctgctttccatgaggcctgatagcaacagtgtgaaattttaatatataatgtatatgcttgttgtaatatataatttgttatgcacttaatattttctccggagaagaaaggaattcccaaagtttatgacagtttgtcttgattgttatcattgatgctgacgtctttcatgaatccattttgggaaaggaaagaggaagtaggtgagatctcatcttcctcttacctcctgactcttgatctggtgaacactgtgctgtttttgttttattgcacgttgcattatgagtatgccagtcaaataccccggagccccaatgatccataggtgacctgtctaccttgccagggttcggctgcacaccagctttctccagtgattctggaatcctttttattccatccttcgtagactttacgtactcagagattgaaggctagtgagctgggagtcagaagacccagctttcggttttctgattttgcagttaacttgctttgccttccttgagtaagttcaaaacctctctggttagaggtctcattttttttaattcaatagaaaaaaaaagatactattgaactacatggtttccaaggtaatatacagtcctgacattctatatttgccattttaatacaaacacttatttgcatacatttatgaaaacacacatagtcatacacatgaaccaacttctacatatgttaatgtttggatccctctagagattgttaattttcttattccctgctctttggattagccctacttataggttctgctatggtttctatactatgtaagcagtagtatatcttctctttctaagggaaagaatattgcctgaaagaatacataagagaggcagagttactgttttcagtatggttatttcagtatggggctaggcacgaaggaagaattggaatgggaatatcagaatgatatttgagtgttttaaaaatgaagtgcatgaaaaaatttagggttgttcccttacatggaaatgaaagggacaaattcatctgaaaattgtaatgttgccaaatgagatacagtgaagaaaaagcggggccatgaccacttaatgaatgttcctttcactttttttcaacattcctctgcagaatgaggtggtgagtgagctcagtggcatctctattaagcttagattggggctatgtttccatctgaggccatgattgctggcatatgaccccaatcatgtggcatgtctgtgttctcgctaaaggacccagtttcctcagccctttgaatatgtagaccatgctgctgtgtacatgctcttttattttggggtacagactctgtttcttcgagctgtagactttagaaattcttagagagtaggatgtgtcctgagtgcttcttagtcatcacatttgggctgttcccgagcgtctggccgcatgccaggaacatggtgggttcttagtaaacgaaactgaatcttgtctgattttgttgcacatttcaagatgcctgagttgagtagttatttataaggtctagaaagagaaataattagtgagtttatttccaaatgttattagaaagcacttctacaaaatccttactaacactatcctaaggttaccttttaatataaaagttacaattttcatagttttttatagattgtgacatggcaagattctcttgtaaatagaaagtgaaacgagtaaaatcaattcagcttatgtttggaagattcttgcagaacttgtttgaaagaacagagggcttgcattactaagacctgaattcagattcactaaatggctgggtgattttagagtttttatttttaacctatctatgccccactttactacttgtaaagtggggacaataaaacatggctactgtgaagacaaaagataatacatgaatgaggtctctgtagtgcaaataaatggtaccagttatcaccatcactgttgcaattaaccagaattaacctggaaggggagagcaggacaacagacagtacctgttaggcttctgggtttctctgaaatggaaaacccctgattagatgaatactgttcttgagaaggccccttgcccaatcccctgtgttcctctagtgattcgggtcctctccgcattgcaaagacaccatcaccgcctgaggagccttcacccctcccgagcccgacagcaagtccaaatcatacattagcacctgcgtctcccgcaccagcacggcctcggtcaccttcacaggtaggaagaggtcaaatatattgggggatagagctcatgatgagatgaaggtggccccatctaggataatcccacggtgccggggctttaagagaagtttccagttagggagactgagatgtgaggctttaggcattgtgattgtcatgaaggtatccacctgcttttcttatttgacttgatatttcctcacatgccctatattcaagttttttgggacttcttaccacgttctcggcatgctcaggcgagcatgctctctcttctcctatctcttgctacaaaactcttttctttcaatgctccatttaaatcctacctctgcatgaaaccttccctctcctagtggtttagagttggcaggtactgccaagaaaagcggttatgtttatatgtcatctcacattttttggtacacctggacattttttagtacacacacttgcatatgagtggccacttaataaaattgaattgaagaaataattgaagagaaacaataagggctgggcaaaggtaactgtagagagaaactaccacctttattctccctatgttgggtgaaaatgaaatttctgtagaaaaatttatagtccccagtccagttcaagctttcttgtacagatgctgcttgccttacaaaggggttgtgtcctgataaacccatcgtaagtagaaaatattgcaagttaaaatgcattaaatacacctaacctgttgagcatcatgacttagcccagcctaccttaaacgcgccgagaacgcttaacattagcctacagttagacaaagttatgtaacacaaagcctattttataaccgtgttgaatatcttgtgtaatttactgactatagtacactgtagaacataatagcagtcatttaccctcgtgatcacagggctaactgggaagtgtggttcactgccactgccccgcctcatgagagagtgttttcacacattctgctgaatgcctattgcttttacactttcctaaagtccaaaaaaatcatagattgaaccatcataagttgaggaccatctatatgtagttgaactaaggaaagtcttgggaagatacatgcattaaacagacctttaaagttttctacttttcaaaatccttgaatggaaagtgaaatgtaagctgcctatagtaggtctcaccaattcaaatgaaaagctgctttagttttgaaattttaatttatttccaaaatgagaaattattttcagtttagttcagaagagggtattgccctagtttaacctttaaagtatatgtgcctggccctacagctctgtgtattgtacttgagttgagatgaatggactcttatagcctcagttttgtttttgccttgaaccatggcttatcagggctcagagagcctcacaagtagacagcattctttacctgtatcagataggcttgctgctatatgcagatacaagtttcaatcagagctcaatctgtccatgtagctctgttcatgtgacctttcttcgtgtctgacacattgtctttggctggattaatgtttgtatttaatgcttcctagacaaggaaagggcctcctgtcccacctctacctaaagtcaccccgacaaaggaactgcagcaggagaacatcatcagtttctttgaggacaactttgttccagaaatcagtgtgacaacaccttcccaggtaagtgcctggttcagggctggtatgtccatgaaagtcccatggtggaaggactctcaggggctagccctaaagaaagtggcggttccagaaccaacaacataattttaattgtcattcaggcttgttttaattacttggttagtctgaagcattcttacatgggagatgtacggtatttgaaaattatcttttttttaattaagggtagtatatacttatagaaaattggaaaaatattgaaaagtgtaaaatgaataatttatcttatttttaaaaattgttttattgataccaaatattttacatatttatgggacacatgtatttgttatatgcataggatgtggaatgatcgagttagggtatttggggtatctatcaccttgagcatttatcatttctatgcattggtaacatttcaagtcgtctcttctagctactttgaaatacctaatacagtgttgctgactacagtcaccctaatctgctattgaatattggggcttatttgttcaatctaactgtatgtttgcatccactaaccaacctctctttatctcctccttccacccacacatccttctcagcctctggtatctattattctatcctctatctccatgagatcgattgtttctaagctcccatatattattaatttgtggcatctgtcttttctgtgcctggcttatttcacttaacataatgacctccagctccatccatgttattgcaaacaacattatttcattcttttttgattcagtagtgtgtgtgtgtctataccattgtgtgtctataccacattttctatatccatttgcccatcaatggacacttaggttgattctctatctttactgttatcaatagtgctgtgataaccatgcaagtgcaggtattcctttgatatacacatttcttttcttttggataagtacccaataatgggattgctggatcttatggtagttctatttttagtttttttgaggaatctccctactgttttctgtactagttgcaccaattctattcccaccaacactgtataagagttcctttttctccatatccttgccagcatctattatgttttgttcttttaataatagccattctaactggggtacgatgacatctcaatttggttttgatttggatttctctgatacttagtgatgctaagcatgtttttatatatctgttggccatttgtatgttttcttttgagaaatgtctatttatgtccttagcccactttttcatgggattatttgtttttttaattattgagttgagttccttgtacattctgaatattattcccttgttgaatgtctgtctgtaaatattttctcccattcaacaggttgtcttttcaccctatttattgtttcctttgtgtgcagatgccatttagtttaatatagcctcattttttctattattattatagttatctgtgcttttgaggtcttacccatgcaattttccttaaactgatgtcttgaggtgtttccctatgtccttttctagttgttttatagttttgggtcttatgtctaagcctttaattcatcttaagttgatttttatatatcaggagagacagggatccagttttatttttctgcatatagatatccaattttcccagcactatttattgaaggtgtcctttccccagtatatgttcttgatacctttactgaaaatgagttggctgtcaaaatgtggatttattactgggctttgtattttgttccattggtctacgtgtctatttttataccaatgtcatgctgttttggttactatagacttgtaatatgtttagaagtcaggtaatgtgatgcctccagctttgttcttgtagctcagaattgctttggctattttggctctttttttggtttcatacaaattttatgattttttctaattctgctgaaaatgttgttggtattttggtaggcgttgcattgtatctgtagattgctttgggcattatggttatttttacaatattaatttttctgatccttgtccttttaattttctttcatcagtattttgtagttttcctcatacagatctttcacttccttggctaaatttcttcctaggtattttattttgttgtagctgttgtaaatggtattgccatattgatttctttcccttctggctctttattggtgtacagaaatgctaccgatttttgtatgttgattttttttacatatcctgcaactttactgaacttatttatcaaatttaggaggttttttttgggtggattctttcattttttctagctataaggtcatactatcagcaaagaggaacaatttggcttcttcttatccaatttgaatgccttttatttctttatcttgcctgattgctctggctaggacttccagtgctatattgaatgggagaggtgaaagtgggcatccttatcttgttccttatcttgttcatagaagaaaggctttcagcttttctcccattcactatgatgctacctgtgcttttgtcatatatggcctttgttattttgaggtcagttccttctatttcctagttggttgagagttttcatcatgaagcagtgttgaattttatcaaatgctttttctcaatctattgagataatcatgtagatttgtgcttaattctgttgatgtgatatattaggtttattgttttgcataagttaaactatccttagatcccctgatataaatcccacttggtcgtggtgtgtcatctgtttgatgtgctgttggatttggtttgctagtattttgttaaggatttttgcatttatgtttatcatgaatatttgcttatagttttctttttgttgttggtgtttttgtttggttttggtattaagatagtgctggccttgtagaatgagttagggagagttctttcctcttcagttttttggaatagtttcaggaggactggtattgatagggttgggctgtgaattcaactaattctaggcttctgtttgttgggagacttctttatttttattttattatagattcaggggatacatgtggagttttgtaacatggagatattgcgtgatgctgaggtttgagcttctaatgatctcatcacccagatagtgaacatagtccctagtaggtagtattttacctttgcccacctccctccatccctccgcaatctttttgtgagaccaaacacacaaatgaggaagaggaatgactcaagtggtactactgcagtatactaccaaaccatggtgacatatatgtcattgtatgacatatatatgtgacatatatacacacacacatacaaaatgaccagaaaacaattaacattatgacagtcacaaaacttcacatattagtaatagccttgaaagaaaacagattaaattaaaagataaactgactaaataaacagatgcttttctcttgctgttcttaggattctgtcttttatttttgccttagtacatagtctgactgtaatatagcattgagaagacctttttgcattgtatctgtttaaggatatttgggcttcttatatctggatggctaggtctcttgctagacttgggatgttttcaacctaatacttcattaaatagattttctagcccatttgttctctcttggccctcaaggacacgaataattcaaatatttcattgcattatattgtcccaaatatcaggaaggctttgtccattcttttttatttatttttgtctcactgggttatttcaaagacctgtcttaaagttctgagatgctttcatctgtttgatctagcctctggttgaaacttccaaatgtgttttgtatttcagtcaacaaattcttcagttccagaatttctatttgtttcttttaaaaaatatctctttggtaaatttttcattcatatcctaaaatgtttttctgatttctttgtttttcaaaattttcttgtatctcactgagcttctttaaaagcaatattttgaattctttatcttgtttctttggaagtgtcatatttccttgctgttttatgattctgtttcattgtgttgatatctgtgcatctggtataacttccaatttccaatctggttgcttcttccaattctttgaaattggtttttgtaggggagggcttttctctgaagatgtatatatgttgttggttgggtcggacattttggctttgattttggccacatgtagtagtgtgatctttgtataatttatttggctgtaaatagtgtcagttgtacttgtgatttcctcaatgacttagggtgcatttgctagcagggggccagggtaaagttttgctgaggacaaggatgccaggttgaccagtctttgggccccagtggaggcagtggtagactgagcattgcttgtgcttggctccaatgtgggttacactagctccagtgttagtgagtccagacaggctgattcttgggctccaggtggcttgctcagatattggtagtggcagcagtaggttgagtgtgtggtcaggttctcaaatctctgggcagctgctgtgatgtgggtgatgtcagtagcggtggtggagtaacccacgggaacccaagtggtccactctggtgttggtgatagctatgacaggtggggtgtgccagtcccttggcctgctgctggtgcattctggtgggtgccacctgtggtagctttggcaggttgggctggcccaatctcagacccaggaggaatattcaggtgccaacagtggtagactgggctgggagatttccaggcccctgaacagcatgctgaagcactggggtgacaagattgatccaatagcttgtcctgaggtcaagctacattgacactggttgtgacatgctgggtagggtggtttccagcctgctgacaaaatgttcaggtgtaggaggcaccacactgccctgcggacctgctattagggaggtcaaagcctctcatggtgggagcagtgtagggaggtagctgtgggacacgtagtttccttgtgccttggtcccgctgcaacctgcagcagcagcagtgggatttgtccacaaagtgtctgcaagtgcctggcttcccctctccctctttggcctggtggtagcagcagtagcatcagccttggccccagggagggatgcagacctttggaagctaggctttcagaatggcacccactgcaactggggaaggtgggggcccctctaaggtggtgtagtataggcaggtagctgtgggtctgtggggagtgcagttttctcatttcttggttccacagcagccctcagaggtgcataggatttctcctagcagtacatgaaagtgcgaggcctctcctctcccttcttggcctggccatgacagtggcagtatctgccccagagcagaatgcagtccttttgggggcttagctcagaatgcctacaagctgcagccactcaggacatggttgcctatggggctccttgtgagttctctctctggaacaatgtctctgtgtggtccctaggcagctacccatgtaaatcttgaagcccatatcagttgaggggttctcccatagctagggttgtaaaaagatggtggtgggtatgtggagtcctgggaattctcacttatcttttcctcacatctgggagcttctcctggatcccagctgaggaaagccttgctgccctctccttgcttgctttcagtgcttcccatcacttctctgttgaatcccagtgttctctcttaggtgatctattcacagtgtgaacatctacttgctattttgcttccgctctgtggaagaagcatgtactagttttctttagtcggccatcttgagaatctcccagaataaagaattgtaggctgggcgcagtggctcacacctgtaatcccagcattttgggaggccaaggcgggcagatcacctgaagtcaggagttcgagacaagtctgaccaacaaggggaaaccctgtcgctactaaaaatacaaaaattagccgggcatggtggtgcatgcctgtaatcccagctactcggaaggctgaggcaggaggaggtgggaggcggaggttgcggtgaaccaagattgtgccgttgcactccagcctgggcaacgagagcaaaactccatctcaggaaaaaaaaaaaagaattttaataatcacttaaatcataccactctgacatgaccactagtgccctttggtctgtcttcttttagtcttcccaaatcactgagtatatatcaattttgcactataaaattgagactgtactatcatgtatttctgacctttctacttaattttattgagcatattttcatgtcataatattgtgtttgcaaaaacatatttgcccatagtattctctcagttggttgtaccaacccctgattattggccacaagttgcttccaacttttttgttgcttcaccagcacttcgataaacatctctttatatattatttcatgtttatgtcttctattgattcttagtagagataggaaatgaaattgaaagaggtgaataattttaagtcttttgtccttcaacaggggcatattatttacatgaattggcaaatgaaagtcagtgttcctactgattttgaatatacctgggttcacatatcccaccgcagctacttgcaggcctgttcctgctagtggctgttttttgtgtttttttttttaattgactcaagaattatcatgacttccagagctgcctctagtgtcactgaaactatctcttttttctacaagtaaaagaccatacagaagtcatggtgatactatttcttctcagtgttctcagggtctggaataatatttacattttacaagaggtgctaatgcagtactataattactgagtacatcaatcactacactatgcgtaatatgccgattataatcacatcatattaataatagcagagatggtgtattgataataatagggacctcagaaaataaaaactcagacacaatgcagtggcaaatcatgatttttcattcttttcaagcacacttatcaataggcaaaatgctttgagctattgttttctttcttctgttgtatgcataagatgctgagtttgataaaattaactggggcttgagatgtgatttagcagctcctttgagaatggtgtttatcggtgcatggccagattgtatgtctgtggataccgagatgccgccagggatagctgtcttagcgccaaaggatcttacccagcatctcccagttgtcctgggacaaacttgagcaattctaatttccaaagttgtacagtccctttgcatttgctactgcccagcttcattctctttgttcgctacatgaattttcgaactgggagtgttttaaggcaacaatacccttactcagttgctttgacctggaccctccaagagcatcctctcagttccatcacaaatagagactttggtcacctagaagccttgtgtgcttagctgaggacatccccatttggtagacaaggcaactgaagtagagacaacatgacatgcagactcattgtgaagtaaagatgaggttcagaagtgttctttctttttaaatgttttttctttgtatttgtaatttgctggctcataggtaaggacacttgatggtggggggaaaaaggatcaaagcacttttgaaaattacagatgccaggagagtcccctaagtacttaaaagagcattcgcttttgctggtactgttgagtgagagtgatgggaaaagttaagaactggggcagaggaagtgcctttccaaacagaagcatgttccagctgcagctcctgtgaggacactattcccgggtctgcttgcctaggctttgctagtgctttatgcataaccccaaggctgctgggaaaggaatgtgggagctttcagtgtctctccatcaatacctcttatatctcactggctgtgtgtcacatccttcagtcttccaggcaattttggaagaactaagcaccagagacattataggagtgcattttcgggggcacagccttatttatattgttttcttctaatctggggaggagtcagaaaggggtttctgccatttttctaaatctgaaaagcgacatggctctagcagctggaccacagagtatgacttggagtgtttccatggattaaatgaccatttgtctcatgtcaagatgtcaaaagcgggagtgaaacagggatttatatttctgtctgctttctggtttattgagtgacataatctggctttaattaaaaatatacagatgctgtctctccctgaagcatcttggcagtttcttcagtggcttgttcctctgtagctataaatagccattttatgttacttcagcccatccagcagtttctgatttggcaggtctgggatgaggtcaggaatctgcatttctgaggaaaatgctgctaatgctgctggtgttggcaccacactgtgggagccactgtttaaagttatcaggattccacatggcactaatcagtgaccattaacaaagcaccacagtgaattaatagatttattccagagaaatacccagctgagtcaagtgtgtgctatgactgaccattcataactgctcccttcaaaactagtgtgactcaaagtcttccatatttagggtagttggacacatacacatacacatgagtgcttataaccttagatgtgttgatcagattataggtcgagctacgtattataagtgaatgaactgtatcatccagacaataatgtatttgataatctacagataaatagataaaagagaataaataacaatacctgggaaaaatgagatgctaactgcaaggaagtacagcattgaaaactagacagctttgatgtacctgaaaaggttttctctgacacatatagcaatataggatgatccgtctacatttattttaatttttttaaatgagtcatttacatttagaagattgatctatgtccccagcttgctatttttatcatgcacttaatgggggaagaaaagcatttgtgttattcctgcccagaagctcaaaatgtaatgactgaaatgtacccagtctcagatggatttgtttgtctcctccaccaagcaccatcacggtgatgattctctcctgagtgtgtcctgggattgaagacagaaatccattagatctggagagccctctaatggcccaaactttaaatgtagcatagaattttttctggtaaatgttcttatctgcttgtagggagatgccccgtggttatgacccaatggtttacttgcttttctggttttgtgtttacaaaaacagatcttccaaaggtccaaaaaattgttccctatttttccatcctaagaacttagaaatccattctctctctttttctttcccttcctctttgtgtgtttgtgtccctacattattcttttaaaacagcattttccaaagcatgtttatgaggaaaactagtatcattagatgctttgaaaagggagtctctgtttacatgagactgaggggctacatcccttttgatttttcacagtttacatcggcatgtttaaggctctgaaaagttctgtaacaaagttccattcaactttgtttagggaagaatttctcagtctctccttcacccccaaaatatgctttcctaggaaatgggtgtttggtaaaacactttaagaaataaagatttaaaagatattttgtccctggaaatcaaatctattccatataaatatgattctaacaagagatcaagacaaaaaataaagcaatcatgtatgtgtgtatatacacacgtatatgtatatatacatgtgtatatacacatatatatacgtgtatataacgtatatatgtatatatacatgtgtatatatgtgtatatacacacgtatatatgtgtgcatgtgtatatatacatgtatatgcacacataaatatgtgtgtatgtgcaaggttatttctctctctttttcaattcttgtcctcagaaaatgttttggggccagacatggtgactcacatctgtaatctcaacactttgggaggccaaagcaggaggattgcttgaggccaggtgtttgggaccagtctaggcaacacagtgagaccctgtctctacaaaaaaaaaaaaaaatagctgggcatggcagtatgtgtctgtagtcccagctgctcagaaggctgagaggcaggtggatctcttgagcccaggaggtcgaggttacagtgagctatgatcacagtactgcattccagcctaggtgacaagagcgagaccctgtctcaaaaaaaaaaaaaagaaagtgttttggattggcttttcttctaacttgatgactggattttaaatccaatgttcaccctccctttaggattatggccctgagcaaatattttttgctggggacctcttccatataaaaagttggagtcacttgaaataagcttatcagcaacattctgatggccagtctcaggggtttccataagtgaaatgccaagctgaccaaaaagaacagtctcaccatcttaccactcaccctcctggaaacaggccccatcttcatgctcacaacacctttgtggataggagccctagagttccagaagcatataatcgaccgtacacatggagtagtgttggggagtgctccgaaggggagatatggcaaccaaagcccagtcctggtacaggctctcaggatgccctgaccagatggcactgcagctgcagctggtcccttctgccagaggaagacttaggaaactgtaagaaaggtgctcaaaagcatgacggtccccttagattcagggcttggggcagggtccctctttgccagagtctatctttgtgtccagtggcagagaggaagaaaatattgcctgtctcaggattttttcatagcagatacccccaactatttttcctaaatctttctccaactatgatattgcatattttctctgatcaaagatttcccctttacaaatccagaggaattatcccttgaacatccaagcttatttctccaagccctgcttatcacgccataggaatgcctaccatgctcccatgcagacatgagcacagcctttcaatcctgagtgttgggaccaattgagcaccattggcttttctacccttatgtctctgttttccagcctaatactgcatcttacttgttaagttcattaaatcatgctgttttccctagccaattgaactgaaatagaattcaacttgcagaatcagtccatgaaatggttttttcacccatgtaatcctgagaggccagcctgcagttatgaacatatgcatctctcacttactgggtatctgtaacctggttctaaataccacactggcttttcaacataacatatttctggaccagctgcctcttctttctcttgctatttttcaaagtaaacatgttaacattattttaagacagaaagaattagtaagatgaaaattagaaggaagaaaaaccacacagtgcatttcaagcccaaatttagtcagttcattgccctggtggattaccaacatcattgttccattccttgagcaggagtaaccaagcagtgcagtttatgtatcatctggtattctgaaaatgttttaaaatcattgggtcattaggcttcactatctttcaaggttctgactccagagctgctaacagtgcctaggctttttctgtctacagaacagggaaagctactaaatatctttctgcaaggtctcattcagtttaaccttgacatcaatcctgtgatttacatgtcattagtcctactttctagaagagcaaacctgccgtctttctgctgaaccttgcctctcctagtgcagaagtggaaagcagaatgctgtaggctatgtgtgacagcattgtaagcacccgaaagagagcagtaccgggcattcagtaaatgaacaaatcgatatcactctttctatccttagtatccaggatgcaggttctctagaactcgtttgagtgttgatattagcaaagttcttcaggttgttacatatcagtgcattattggtaaataccatgatatagtggtaggagggcctttactcaaccagtttagtcatctgtctttccactagtcagagtagaacctcattataagcataggccctatccctcttccttgctgactctattctcatgactgtcagcctttatactattagtcataatatatgtaaaagcaatgaacaaaacccacgtgctacactaggaatgattttgcagcctaccaacttgttctaataaaaaacaaagtcaaaacaaaacaaagtaggaaaacaatttcctagaaggtctagtttattgtgtgtcaactcattcctagagcatttcaggattatgtaaatataggtatgcacataaagcaaatgtgagagaacaatcgataggtctagattgtgagtaaagggatctgcattatactatccttttaattctctgttcagcagtctccccttatccacagtttcactttccatggtttcagttacccatggtcaaccatgatccaaaaatactacataacagtaagatatttggagagagcaagcgagcgagagactatattcacattcacactacattcacctttattacagtatattgttatcattgttctattttactgttagctgttgtcatcaatctcttactatgcctaattgataacttcaactttatcataggtatgtatgtataggaaaaaacatagtgtgtatagggttcagtactatctgtaccatttgtggtttcaggcatcccctggggatcttggaacataactcctccaaataaggaaggactagtatactacaataaactttgtggaacaaatacttggcaacatcattttaaatgactgaacgattttccattctaagactgcaatataaagcacttgaaccctgtccatgtgctatatgactcacattaactgtaatgtacccatctggagcaatcttgttataagcttctaaccacgaaggtaaactttcctaggccactgcttcattgtaattgttgatgaaatgctaaaactttactcactgttagaaattgtaaattgtgacttttacatgaaaggtatttctattacataaaagataacttctgattggccttgttcctaaagattttatttaacctctctgtcttaagcttcctactctacctcttttgcctcattgggaagtcacaagtgtccagcacaatacttaggatatagtaaaggttttcaaaatatgtttaatgaaagaataaaagatgaaaatctctagaagaagaaaagatgaaaatctctatgccctcatggtaatctggcttactataatactgtgttatgattaaagaaattttgtgtatgggtgtgtgtgtgtgtgtgtgtgtgtgtgtttatctgtctgtttgcatgcagccatgaggatgatttggagactatatgttttacttctaagtggtttttttgaggtgtttacagattttatacattttattcaaattctaaaggttaagatcctcagaaaatgtgttgtgtgtgtgctctggaggctagatttctgggtcaatcaaatacttgcaaactacctacagatgcatcactactaaatgttttatggctatagttatatattgaaatctcttttacctgatatgcttataaaaatgatgcccaaaaggatgcatagttaatgtaaaaaaatagtaaattacagagaagcaaaaagtaaaacttcaaaagtaaaagtctattccccagcaaaactcacttttactaattttgtgtgtaaaatgccacttttttccatttaaatagtaactgaaatgtggccgggcgtggtagctcatgcctgtactcccagcactttgggaggccaaggtgagcggatcacctgagattgggagttcaagaccaacctggctaacatggagaaattctgtctctactaaaaatacaaaattgactgggcatggtggcacatgcctgtaatcccagctacttgagaggcggaggcaggagaatcgcttgaacccaggaggcggaggttgcagtgagccaagattgtgccattgcactccaacctgggcaacaagagtgaaactccgtctcaaacaaacaaaaaaaaaaaatagtaaccaaaatgtatatttttggaaatgtgatcattctatgtcaggtttttaatttatgatttttagtacaaatataacaaaagtatttccatgtcaatttagtatttattttattattttaaatagcagcagagcactgtgttaagagaatgtgctatggtaggtttaacccatctcccactattagattttttttaatgttattagtaagctctattgatgtgtgattgatctacaataaactgtacatgtttacatatgcacatatttgatgagtttgcacatatgtatatactattaaaccattaccagaatcaagataatgaatatatgtcaccccaagaagtttagaagttttctgagccactttttaatttctcttgctcctccccattggcgccagcatctctaggcaaacactcatctttctgttgctatacattagtttgcattttctagaattttatataaatggaatcatatagtatcagaaagcatagtttttggattacgaaattcattaatgttgtagcacatatcattcctccttattgagtagtattccattgtatggatatatcacaagttatctgatggatgtttgagttgtttccaatttttgactattataaacaaaggcactataagcacttgtatacaaatatttgtgtgcatgcatgctttcatttctcttgggcgaatacctagggataaactagctagatcatatgttaggaataaatttaattttttaaaaaattgacagattttctgaagtgtttgtaccattttctattttcatcagcatcgcataagagttctagttcttccacatctttgccaacagttggcatggttaatgtattaggccattctcacatggctataaagaaatacctgagactgggtaatttataaagagaagagatttaattggcttatggttctgcaagctttacaggaagcatggcagcatttgcttctggggaggcctcagcgagcttttattcatggcaaaggcaaagcaagagcaggtgtctaacatggcaggagcaggaggaagagagagaggagggaggtgtaacacacttttaaacaaccagatctcttgacactcactcactatacagtaccaagggaggatggtgctaaaccattcatgaaaactccgcccccatgatccagtcacctcccaccagaccctacctctaacactgggataacaagttgacatgagatttgagtggggacacaaatccaaaccgtatcggttagtgtttttaattttagctattctagtaagtgatagtggtatttcattttgatttaatttgcatttcccaaatgactagtggtgttaagtattttttcatgtacttatttaacacccatatatcttctttggtgaagtgcctgttaaaaactttttctcgtgtatttattttttaactgagttttgggacctctttatccattctgtatacaactccctcattagataagatttgcaaatactgtctcccagcatgtggctttcttttcattctcttggcagtgtaatttggagagtagaaatgttttatttgatgaaatccaatttatccatttttttctggattatatatttcatgtaacatctaaaaggtctttgcctaacccaagataaaaatcgcaaggttttctcttaatattttttagaagttttattttcaggtgttacatttaggcctgtgaccaatttggagttaatttttttatgtggtacaaagtgtgtgttggaattcatttctttagaaatgaatattccattgttgaaaagtattcttactctactaaattgcctttgtacctttgtggaaaattagttgtacctttgtggaaaatcagacaaccaattatctatctatctaatatatatgtatataccatgtatatatgtgtatatatatatgtatataccatctatatatgtatatatatgtatataccgtgtgtgtgtgtgtatatatatatatatatatatgtatatatatggatatatttctggaccatgtgattatccattgatcttttagcttacctttgtgccagtagcatgctatattgattattgtcattttatgatatcttgaaatcagggtcagtagggttagtctttcaactttgttctttttcagagttgttttggctattctaggtcctttgaatttccatatgaacttcagaatcaactgtaagttgatattgtattatttcctgggctgctgtaccacaactgagtggcttaaatacaaaaccccccacaaaaaaattctctaacagttttggctgctagatgtctgagatcaaggtgtcagtagggacatgctctctctgaaggctctaggggagaatcaatcctttcttctctcctagcctctggtggttgctgaaagtccttggggttccttggcttgcagatacatcactccagtactccaatatgcaccttggtcatcacatggcattttccctgtgtgtctgtgggctctgtgtcttcacatggcattctccttgcgtctacatatccaaattttcctcttcttacagggccaccagtcattggattaggacccactctaatcaaaatctttattttattacattggttcagaccctgttgtcagttaaggacacacttacaggttccagataggcatgaaatttggggggtgggggaaaatactattcaaagcagtacagatattgaatcatgttgcaccgagtctatagatcaatgatatgtgagtcatctgacgcatagacgcagtatatctctccctttattaatggtcttctctaatttctctctgccatgttttacagtttgcaatgtacagacattatacatcttttgttggatttatccataagtattttatattgttattataaatcatgtttttaaatttgttttttctggttgttcacactattgtctataagtacaactggtttttgtatattgatgctgtgtctgcagctttgctaaactgaattattagtttctatagcttttttgtagattttattggatttttctatatatattatcatatcttttatgaataaagaaagtttacttctctctttgcaatctcggtgccttttatttatttttcctaccttatttcattcttgtaccaccagaataatattgagtaaaagtagtaaagcagtcacccttgtcttgatcttagaggaagagcatgtagtatttcacttttaaacatggtgtttgttacttgtaggttttattagatggcttttatcagattgaggaagtagccttttattcctacttaaagagttttaaacaggaattaatgtggattttctcaaatgctctgctgcatctgttaagatgatcatatgagttttctttatagtttgttaatatggtgaattatacttattggttttccaatggtaaaccatccatgaagtcctaggatgaaccccatttggtgatgatatgttatcctttttatctgtgtatcttttagtcagcttgctaaagctcggtctagaatttttacattcctgttcatggggaatattaatttataggttttttttaagaaaagggtttttatgatttaatactagggtaatggtattgaatgaattgaactgaaaatcaattgctggttaagtttgtgttggtattatttgttgcttaaaggtttgatagaattcatcggagaactcatctgggctctgttttgttgtgttttcttttgttttgatatatttctatataatagatatagagcagttcagggtatctatttttcttgagtgagatttttgtatttgtagtttgtgtttctcatgaaatctgtccatttcatctaaattgccaaatgtatttggagtacagtggttcatcatatttactattattttttgatatctctaatatctatgatgatgtttccctctctcattcctaatattggtaatctgcatccttgttcactctctctttttactccaattagactggctaaatgttgattaattttattgatcgtctcaaataactagcctgtggtcttattgattctctctttttcttgttctcactctgtcttttgttttctgtttcactgatttccactctaatctgtataatttccagtttctactttgggttttattgctctgtttatgttttttttttatattcagggtaaaaagaaggtgaggttaataatttcggacctttttgttttcttatatgggagtttagtgctataaattttccgtaagtactgctttagcagcatcccatacattttgatatattgttttcatttccattcaggtttccaatttccactttgatttcttttttgactcattgaattatttagaagagtattatttgtggattttgcagagatcattttggatgattaaaatatttgtggattttctagagaccattctgttaacaatttccaatttaattccagtgtagtcagagaccatactttatgtggcttgaatgtttttaaattagttgaaggcagaagtgattcagtgacagttttttccagctgggacacatggggtcttaaaacaaaggatagactaccagggagaggaggaaggctgtatctcacttgatgaagccactaggacaagagtggactgagtaagcatatggcagccaccttcatgctgtactctttaacagggcaagtttttattaaacttttaagttcaggggtacaagtgtaggtttgttgcataagataaacttgtgtcatgggcgtttgttgtacagatcacttcctcacccaagtattaagcctagtacccattagctattttttctgatcctctcccttctcctaccttccacttccaataggccccagtgtgtgttgtttccctttatgtgtccatgtgttctcaacctttagctctcacttgtgagaacatgtggtatttggtttgctgttcctgtgttagtttgctaaggacaatggcctccagttccatccatgtccttgcaaagaacatgatctcattctttttatggctgcatagtattccatggcgtgtgtgtgtgtgtatgtatatgatatatatatgatatatatgatatatatgatatatatgatatatgatatatatgatatatatgatatatatgatatatgatatatatgatatatgatatatatgatatatatatgatatatatgacagatatatgatatatatcatatatatgatatatatatgatatatctgtcatatatatcattttctttatccaggccttcattgataggtagttatgttgattccatgtctttgctgttgtgaatattgctgcgacaaacgcacaaatgcatgtgtctttataatagagttatactgggaactttagcattgtctctggtgtctgtgcaagaaagaggttccattgtgtttatttgttcatttgtttgtttgtttttggaaataaaatctcagataggacctttaaaaaagaattagttgagacctatttgatgacccagaatactgcttatcatgttacatttccatgtgcacttgaaaagaatatatattctgctgttgttggatagaatgttataagtgtaaattaggtcaaatttagtcacagtgttatctaaatcttttataccattgcttattttctctccatttgttctttcaattattgaatgaggaatattgaagtctttcctataaaagtgtgtgtgcttttttatttttctttacagctttcttggtttttgctttatgttgaagctctctaattgagtgcataaatgtttaggcaatgatcctctttatccatgacaatattctttgatttgagatctactttttttattgttaatgtaattactacagctttctttttgttagattggcatggtgcatcctttatatccttttactttgaacctatttgtgtctacatacttcaagttagtttcttatagacagtatctagttgggtcttgcttttttgtacaattagataatctctgccttttaattgcatgatttagactattttcatttaaggttattattcatatggtgaagtttaaatctagcacattgatcacttgttttccattgtctctctgttcatttaacccttccatttctgctttcttttgtattaattgaacattttttattctctttaattttctttatttacttattagctataacattgttttgtcattttagttgttactttagggttttagtgtacattttaatttatcacagtctaactttcaattatatgatgtcatttaaggtacagtataaaaatctaatgataatatactcacatttctccacttctgttttttatgcaatttttgtcattgattttagtttatctacgttttaaacttcacattattttgttattatttttgtataagcagccaattatctttttaaaagatttaaataataaaaactcacatatagttacctaggcagttactatttctggttctcctcctttgtgtagatgcatagttctgttatcatttttcccttgcctgaaagatatcttccacattagttgtagtgtgtatatgagggtgatgtattctttctgattttgtttgtctgaaaatcttcattgaatttttattttagaaagtattttcaaggggcatataattataagttggcagtttctttttctcagtactttgcctcactgtctttttgcttcattatttctggtgagaaatctactgctaccttcatgttgttcctctgttagtgaaatgtcttcttttctctggttctttttatgaatttatctttaacactgattagaaaattagattatgattggtccacatgtgcttcatgtgtctctcattctttttggactagcagctatgcaaggctctacttttcacggtgaatggcggaatacaaaccaaccaaccaaacatgcaagcacatttccagcctttgtttgcattacattaactaatatccattagctaaagcatgacatatggtcaaccccacgtaagggatggggaagtaaaatccatctatcacgaagccgtggcaaggctaggcatgccgattatgctcaaattgcacatctgcactggaagaggtccggtactttactgataaacttagatgtcccaagtagaagacacctcatgaaacatagtacagatgattataattggcaatgttttcctattggaagattttctcccactgtggtttccacagctggtctcctttcttaggagcacattccaagtcaccccttgtagatttctgatggtaaagcagtacttacaatcaagttcccaaaaagctaagaatgttgagaccataccatgtgtactctaattgtgatgaaggtgtacaggattcatttgtcttgttaaggaaaattacacttttctgtgtttcaacatgtggtgacagagttgtgagtacgttcctgcccttttaaaaaggaatactatataagctggcaaaatccttttgctatgtttgtagctttaccagaatattctttgacatgagtaccttaagggataattctcaagattaagagggcaaagctaagtagaagttgagcctgaaaaaaccagccacatattttgaaggcagtccaattggcattatggatatttgatgacagtaattttacatattcacatgttgtattagtccattttcacactgctataaagaattgcctgagactgagtcatttataaagaaaaaaaggtttcattgactcacagttccacatgactagggaggcctctggaaactttcaatcatggcagaaggttatggggaagcaaggcacatcttaaatggtggcaggagagagacagcaggggggaagtgccacactttaaaaccatcaactctcatgagaactcattcactattgtgagaacagcattggggaaactacccccatgatccagtcacctctcaccaggttcctcccttgaccaaacatggggattacaatctgaatgatatttgagtggggacacagagccaaactataatcacatgtatgcattgttgctaatggtaattaataacattagcttccatttccattttgagtatttcctagacattacgtacatgtgcatttatcatctttactactcatggtaatcctattaggtcttattaatcccattttattcatgaagaaaccgaggctcaaagaagctcaattaattggccagggagagacagctagcaagtggtaaaattggggtataaccacagattgatctcaatcaaagtctgagcatagcccattatagtctgatgcctcatttcatccttcatctctaaattcccatttgagcttccttaaggggattcattatgcttaaaaggaaataatgaatatattcccatgacctaaaattttatggagaacttgcagaactttgagaattcctctgcagatttttggggttcctaattaagaaacttgggtctggggcatcagttgacagcctggcaggcattggagtcagaggtaccaactacagtcttacctctgctacatggcagctgggggccatgacaatagatcaccattcagccaattctcttcattctcccaaatggagaattgctgccatctctccctcaattttttgtaaggattatatttgaaaaggcaggtacaatgcagtctggagaacatggcaagataaatgctttaaaggcaataaagtgttgtcaacattagattgcaccaaagtgtgttaacatgaggtaatgttcatatgtgtaaagttcttcgaacagtgcctatcatactccaagtataatatgtttactacattttaaaaatataatttttacctacataaaagttggggaaaaacaaagcttatgcagattttgaatagggaatcggttgatagttttgtgattgtaattagtaaagaaagtagagctctcagaagggcattatccttgtgaaatttttaaaaagtatatatggggagttactgtgctgcagaatagaaaatgcaaggctaatagcatgacatattagcagctttcttctgcaatgagtacggatatgctaaggaaagtatttaggttataccacctcgcttttctttatttttattttttttatttttgggggggaatggagccttggtccatcacccaggctggagtgcagtggcatgatctcagctcactgcaaccttcgtctcccaggttcaagcgattctcctgcctcagcctcccaagtagctgggactacggtcatgcaccaccatgcccaactaatttttcttttcttttttttttttttttttgtatttttagtagagacagggtttcaccatgttagccaggatggtctcaatctcttcacctcctgatctgcccacctcggcctcccaaagtgctgggattacaggcatgagccactgtgtctggccctcacttttcatacatttctcagtttttaatgtctgtgatgaatattaattagaataactcctattcttcaaaaatctgtctccaaaaatctgtttttatgtatactttacccattggtttgacgtttcaatttctaggcaacaaagtttttttaaaaagaattttatattgaatgctaaacacatgtaatttaaattgtatgaaaactgaccccaactcccttttctgtgatgtactttatgggactttgtcttagcctggccctttactgtgtaacttgagcctgggttatgctgacttcaagcccacattgttttcatgtattatgataccacaaataaatgaacaaatgataatgtttagtattatagatttttttgtattatcaaagcaggactttcgtcctgtgtcttatttggcttaccttctttctaatccaaaaatattattaatgggagctcattttgcagcaaatgttgggaggcatggctgtctctctcctctctccctcccgttcaccctcactcatacacatacacaattgaaactaacaatgctatggatgaagactggatcaaatgataaccaaatcaaggggtagggtaccagtgagggaatgaggccgttgggatgtggtcagcagtacacaatggcaccttccttttaaaattttagcttcccagaagaacatcagcagtattgctataatgagtccagatcttggcccattttatcgattgggtcatctgtaatttcttgatccaagttctctgagctgacagaggagactccttgcatcttggtatattaggatacatccttggaacattctctctgttgactggacttggagctagacaaaggacaagagctagagcctgggacacattccagggcaacttaggttatacttggccagagttagttatttccttctcactgcatttagctgagtgactgggtgcatatgggtgagccaccatgcttataaaagtgtgttttggagatactcaataataatattagagagagtatacatgggctatatcatggtcttatcagattcaagctaatacatgttttattttgttttgttgtttgctttaacagaatgaagtccctgaggtgaagaaagaggagactttgctggatctggactttgatcctttcaagcccgaggtgacacctgcaggttctgctggagtgacccactcacccatgtctcaggtatcaggtgctttttggatgtttggagatatttcataaacctcagtaagctcagtgtggtaaccaatgatccctatacctttcatgactactatctatttttatttttggttgacagatatttcctaataggaaagaggggtagaaaggggaccttatctatatcagttattctaagactcccatgccatcagctttctctacccatagagctggcataaccatacattcctgttttctcccccagagtaattgttaccagtgcccacgttgcactcagaactgttcaggtttacaggatacattttatggtttccctggatgaagctctttcttttggttttgggtttactcttcttgctcttttctctacttcccttcctcatactttgcaagttaaagtgtgtttgcaatgaccatgaaagcacgggccagcagaagccgttttcagtgttgatcgttctgaacttgatgatgctgtgttcatcctccccattgaagaagctcccctcctgtgatcatggttatggtttgatggagagtcgccttgcttccccaagcctttttgctcaccactccctcacactccatatttcttcctttcttatagtaactgtcattacattctctgtcagaggatactggtggtaggtgccataatgacctgtgggtaggtcctctgaaatatagttagtttacaactgtctgtgctaatagaaggaagttaactcaaaatttgacaaaacagaaactgtttatataagtactttgcatatggttggagccccacatatgaatttaggcaaatccaaagttgctagagtatgcttcaaatgaattagtacaagaatattgtaacattcaacctaggaattaagacctagcttgattccctggccttgaagccttcttggtatatcacagtaaactgctagggaataaatggctcaatatgaaccttaataaataaggattatgtctagtccatgcttttttctagaatgtgattgggcttctaaaggctttcctgttgtgcaatatgaacaataaatgtccaaggtgttaataaagtaagaaattaatagtctaaacactagccttgaagatgctttgcaaaaaacaaaagggtctcttaggtgaaagttccaggaagcctcctgtattaactctcttctagaagattcatgatgtgcattagaatattaaaggctgagaagttctgcaatttaaaaaaactgtttatatttgtttaacttagagtttcccaaatttgtttgaccacagaaatctatgttaactacacttttcttaatattcattggaatgttctctaaaacaatattttgagaaatgctaaagtattgtcaacaagtttgagggttccaccttggtgaccaagaaaagtacaaagtgaatgtacatataattgaatatacttccttctcagagatttctcattatatagacagcctgcagaattcacaggatttcctctgccttactctccatgcttctttttttttttttttctttgagatggagtcttactctgatgcccaggctggagtgcagtggtgcgatcttggctcactgcaagcttcacctccctggttcacgccattctcctgcctcagcctcccgagtagttgggactacaggcgcctgccaccacgactggataattttttgtatttttagtagaggtggggtttcaccatgtttgccaggatggtctcgatctcctgaccgcgtgatctgcccacctcggcctcccaaagtgctgggattacaggcatgagccaccatgcccggcccatgcttcatttcttttgtggcagatgcaaagtttctgcagtggatgctggaatgattagtgggtgagatttcatagcatttctgtctacaagtttgaatcaggagagaaacctcttttatgttaattcatgattacattaatccataaatcatgaaactgtgtgtggccttatgactaagagattcttcaaaattaaacaaaaatgaccttggtttaatcttcaaaagttttagttctgaaggacatatatcaccgcagtgacggcaagctgtgtgtgtccctgtgctcttcctcagggccaggtaataaaaccctctagcctcctggtggccataactgagtcattacactatagttgtcctgcagtccagctttgatcatacctctcctcttttgctaagaacaaaagtcttgactgaatgacaaaaaaagcatagcactgttaggtctgcctggtttctttcctcttcactcaaaatgacctcctttacccatcacctgaccccatgttttcaagtggtgttcttgctgctagcagaacacctcatcttgtgatctctgcagtatctgtgcacgctaacgcatcctttcatgatcctgaggactgataaacatgacatttcatatttcctgccttccttttaaagaaaataactggtgatgtgtgcattatacagagacatgcactagcttttatgatctttgattcttttttttttttttttttttttgagacggagtctcgctctgttgcccaggctggagtgcagtggcaggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccatgatctttgattcttaagtggctatgaagcaatgaaatgagaatcatctagataatcagaaaacatatattagatccatgtacaaaaaactgtggctttccatggagctgttctctcctgtcttagtcatcctacgagaaaatgctaagcaagagaccaggcaggctgcatggagatgcaaggcaggccatgcagagcggttagaatgggacccaaccaggtgggtgggtatcagaaccacagggcctgctttctataatacggagcccaaatgaggcctctgcaatctcaaccgaaaaccatcatatttttaaggtggcaatgccaggctctctagtttgctgttgacatttagtagttcaaaataagtgcataaacgtggatccattctagtcacaaagacatgggcataatcggatgtggctttagcagcaattctcaatcataaaggaaataagaaagagaagtcttccctgctcccctcacccatagtggaagccatttgaaccatctggcctcactccccgggattcataagctttataattaaaataccagtagtaagtgtaattcattcatgtcttagggggtgctctgccaatttgtatgattaccaattcattgagcagtgtgttatcatctaatttaacatattgaagaactatttttctggggctcatttaccattaagctggtcatcctacatcctcttgaatgagatgggaaggaaatagcattagcagtgattagggcctgcatttcctcaaagatgtgacaagctctaaaatttggacaccttgtttacttcattttaatgaggtgtgtgtgtgtgtgtgtgtgtgtgtgtgtgtgtgtattaaaataacctcatttgtgtttcaaatatagttttctactcacatagtgaaagttgagattgattagacctgtgctatccaaagctaagtgccatttaagcttatattaagtataatacaattatgtaaaatttaaaatgtggttttgttaccctagcacatttcaagtgctcaatagccacatgtgactggtggctaccatactggataagcacagatatggatcatttccttcaccaaaaaaagttttattgaacagtactgtacaaaatgcttaaaaaatgcttatgatttcaagaacttttgtcacctcagcatttttttatgttttagatttgtataactaacagtatttttgtttatttgctttcagacattgccctgggacctatggacggtaagccactaataactctgttttttcatgtatcttgatccccagaaatttggaaaccttgttatattttatttcatttgcaacagaaagaagacacatacatttaatgatgatatagtcccctagaatgatcattaggccactgaaagtcttgagcattatcagaaccggaagatgatggtgaaggaagagtacagtggaccagactcctgggtgaataatggtcaataatttgaataatggtcaagagtttggccctttgtttctttctgtggtggttggtggcaaaaggagctgttgcagtgaaggacacacacacttaaatagaagacaaggaaagtgtgaatgagaaaatggaagagatgggctacttggcacatggtaccattttaaaaaaaagtgattgtattcaatgaagcttgggttaataagaacttgagttttagagccagatagccctggattttagtccaaactctactactcataaccttgagactttgagcaattacttttttttttttttttttttaagacggagtctcgctgtttcattgagtgctggagtgcaatggcactgtctcggctcactgccagctccgcctcccgggttcacacccttctcctgcctcagcctcccaagtagctgggactacaggcacccgccaccgcgcccaactaatttttgtatttttagtagagatggggtttcaccgtgttagccaggatggtctcgatctgctgaccttgtgatctgcccgcctcggcctcccaaagtgctgggattacaggtgtgagccactgcggccagcctgagcaatttctaaaactctctaagcatcatttttttctcatttataaaataagggtaatgatgcctacctcggaaggttgtgtgaggtttaaataagataattgtaaagtatgtagcatggtgtctggtgtgtatcaataaaaggtagatgttattactgatgttttttcagctaatctgatgtgtaaggataactactccataatttagacttgggaaagtgtcacaaacagagctttgtggtggtctcattggtgctgtgaaattaggtgattggtcacacacctctacagcctcatatcccttggagcagggtctttgttttagaaaagccctggtgatgtggtcttaagaactcaacttaagttgtatgttttcttcttttattgtgaggcagaaaaaggaaagttcgatagatctagctattcatgggcaatgccacttctgaattgacattgccactttctttctcccttcaaaacaaaaagatgtctgtcccttccttctgcagttgcagggctcatactgcactctttaagatccttggagcatcaagggaagtgctcaagaagagagattaaaaatgtctattgaaaccaccaatgactaagttatatcttttctagtgaaaagttttactcatatattcacaaaaaggcatgcatggattgatgttcgagtcatttgaattctaacttcaactctgtgttaatttccttggagattaaaaagacaatgctattttttgttattccaatattttatatctttagtggaactgtaacacattttccttccctcgctgggagggtatggagagggtgaaggtatcgtctaaaaagagcttttgaacgtttcagaggacaaacttgctaggaatggtagcgatatcaaaatgcaaaacaacagctttctgaacatagttgctcacagctattaatcttctcaactttgcaagattttttcattatgtggagaaaatggctgctaatttgggggaatgacatcaagagaactctgcaggcagtcagactggttaatatcagaccattctccatctaaacacccatctcaaagacagagccaagtataggatgagtttggggaatattttcttctgatactgtgtcaaagtgtgtgctactgtgtaatttcttgacctctagtgcttgatcttattccgatgttctcaaacttgcttatgtgtttgaaacttagcatttcagagtctgctaaagcagaagtcatatactagccataaaacatccttgctgatgctagaaagtgaaagaggctttctttgtgtttcatttgtgccttttctatggtggtcttaaacaattttggaacaaaaatcattcctatcacaaaacaagttgtaaaatttgttcctaaaccagtaaaagctatagccttcagcagaatgttgactctagacagcataggattttattgtgttagtgaattttctctctcgccttattgttactattttctttacccatacagacaagcactgatttggtacagccggtaggtaaatatccagatcattctggatttttttggtatttgatatgcattacatacatagtatattttctagaatgaactgtttccccatggcattgctagtcatagatttaaaccttaagccaatgaatgtaatcactttccagtttggttttactggtgctactcgcctgaagagctttgtgtttctcatcaaatcttaccatgttctgtttcatcttttgtttttgttttttttcctttgctcttctgcatactttaaagactgactcttcagaaagtctttccttgtgtaacctgatcatggaggaaactccagacagtgggttggccgaagaaattcaaagatctcaaaatgatataggtgcatttacttggggccctgacgctagtacagacagggtcagccaagaagttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggtagacactggagctattgatatcaagacactagaaggtacagaggaatttgaagagaaagcatgtgaaaggacaggaaacagagtggtagaacttcttaataccataggaaaggaagaccataagaccttaaaaattaatgaagtggaaactagaaaagatctaagagcagggtataaggaaagtacaaacaccaatgaaaattattttgagaaaactgacctattagaaaaggacatggaaggaggagatatggcaaaagaacttagtgacagagaccaaggtctacatgatggaattcaaaaggtaatcaataattgtggaatgatagaaggctttggagccaaacctgccaatcacccagatatcttgaatccatctctccagacctactctgtatctaatattgaagatggcagccctgagggatgggatttgactagaaaagacataaagaaaaatgcaatagacactcccaaccatgatatgatattttacccagcacaagacagtacagatgctgaagaaattcagtgtgagactgtgttaaatgctcttgtaggtgacagggataaaaatcaggctgttttatcaataaaacttgaagtagaagctcagtctaggactgaccttaattattctctgggaagagatgcaaacagaagagatttatgttcatgtaaggcagaaagttcactaatagaagggtctgaaagaacagtaactgagaaccgtagtcatactgttaacttgccaagaattgcagagatagactcttggggaacagatccaggtcaaatctggcagccaagcctggattcagcaatgaataatttggatataacaggattctctggtataccagatggccaagcaagtggatttgccagttgtctggattctattaaccactggcctatcagagatacagaaggcttagataatagctggacacattcagatgtagttgagcacaaggaagaactgaaggtggacttactagcaggtgattgtagggaacaagccattgctagctgctgggaacaaagccaggagatagcaagaccattgattttggggacctcctggaatgctagcactgagagttctgctagttcccgagaccaggacatcaacaactcagatttatctgaagatgaaattgctaaccagagatatggattgttgtaccaagaaatagaggctgacaaagacgaggtacttaccctggtctgtagcatagactagccaaagacttctgtaggctctgtttttcctcatgtctgtcacctacttcattatccatcactatcttctaggaggcctgatctctctaacagattgtcatgtacttcttgaaatctgtgcaaaccaaacacaaataggttgaccaaaaaaaaaaaaaaaaagcagcagcatcaacaacaacaacaaaaagaacccaacaacatagacacatacacacaaagcagaatgattgtgttgggaattaatgacagtctatgttaccatctcattttctgagtttattctccctactttcacttttactatgcaggtactaaaaatgtgctaaaccaagagcagcacagactaatttactgttcctgaagtggttccactccaaaaagaacacacgaaatgtttcaacccaggcccactgaaactgtaaaatatcataattgctgttcatcaaaatgatgcattgtagaaacactggagaagtttcttctagattctatcaatggcctgaaaaacaagcaatttaactcctaatggcccttttctggaatcatcttctcattatagagaaagtgggttttggttggcaccaagcaataatgcagcagcaataattgtaaaattaacctttctttttttttttgtcagcctatttaaaatcatacagtgtggcctttgcatttcctaagttctttcatgcacagcaaccttttgtattattttaaaacttgtgatagtctttactttccaacttgtctaatggatatttactggtcctacaaaatgataatgaaaaataataacacaatctgattttcgtttctgtttaggcttctggtggttcatttaatggattcacacaggtaaggaatctgttttcttacaagatccatctgctgagaatgatgcacatttttttcaatgtggtttggttctctgtgccactagtatagcgtaatgattaagaatatcagcacaaaattggaccccactacttacagactgagtaatggaaacagaatagtagcaacattgtatgattattgtgaagattaaatgagctatgcaacagagtgtttagcccagcaggctagcacacactaagttctccctgactttagtttagcttttattaatatgattagctataccatgggcttctaccttctaccgattcctctactagaaattagaagttgttctgatctgagagatccactggattcagctgttctaaagaagagctaggattgttttgaactaatgagatggatctttagaaaatgtgagagggttttaggagcttccttctagagattcctataggagccacactgcacagagccttacctcttcagcagttctccaggaaggagctgttggaagatcagaaaccataggctggttgtgtccaataaggcagtatttttcttgagagtctgtgaaagagaaaccacaagatgaactgtcccattaggacagtgtatgtgtatgtcccaacaggtaggcaggtgtaacctgtgtaaaaggccggccacatggctctcaggctcctggatcagttctgacaacctcttcaatggagacctcagacaggcttgtctgtgatgcctgctttgtctcagaatgtcagacatgcacagtttctaataatttagcatttataattctctaaatatatattcataatatattcataaatagaattctgtatttaaaggtttcattattttcccatgttacctgtaaaaagataaaaacccactgatattcccacatccaaatacagatacacacaaatacaaagagacgttaatgcatctcttccatcttcagaaaattcctttgaaaggttatgataggctctgtcatcaatttctcattcttttcaggtttgtatttccatcagagttattaatgcacataattttaaaagtaacaacttttataagggcttttattttaaaacttcagaccaccatacactcccttcatttcctgtttcttagaggtaaatagtttcacttccttcaacaaattctctgtttccgccctatatgtgtgcatgggtttcttataatgctgcttcttgatttctaaagtattatctattgactcatctctctggaaggtgaagacttaaagtattttccacctcctacccacccaattcgccccctcttctgcttcctgcccttcctctgatagagttccatcaaagccatccaggcaatctgtggtaatgtaatagtgatgaaaatgctattaacagccaagtcatgaatttcacattttgtttcatgccaactttttgttttcctttgtggtaattataaaaaaattgtgggtctaatttatttgccttttgattgatatgcttagttttctaggtacttatcacatattcaaccccatactctatagttatacaaatctcctattttgctgaaaacactagacattcaatcagtttcatcttcttgaagaaattgcctatctgtcctcctctcctgggctgctgtgggctgaactgggtactctatgactgtgacttgctgtagagctgttctcactggctcttccatcctgttggtcatggggactgccttcacctctctttcctgtccttccactgttttctgatgcaagttttctcatttgtggtttaatcattcatttgggtggagcacaacctccagtagctttctgaaaaaagtgcatacacggaaggtgtatatttgtgacgttacacatctgaacatgtcctacatatatattaatatactggactgctagtttgggtattatattcgaagctgtaaatcattttcccttataattttacagccatcgctccactcaatcctaccacctagtgttgccttcaagaaactgtcattttgattcttgatattttgtaagaaacctgcttcctctcctcattctttctctctatctccctcctcctacctctttcatcttccttttctctctttctctctggaactttgtagcatcttctttttacttcagtgtttctgaaatgtttcaatgatgggctatggtctgagtctcttttcatccactgtataagcctttttaatctcaaaatttatgggttttggtttgggagaattttaaaaaaatatttcatggctttatctttttttttcctttgttctctcattccataacacttctctttttcatattttaacttcctgactagtattctattattgtttctttgctgtttccttttctctgttgtctttctctactttctctgccaactattctaacaggtttttcaccctataattttttcaatttccaataactctttttgtttactgcatatttattttccaatagcatcttcttcttgtgtcatgaatgattctcttccattatatctctgaaggtattaattatcattttgaattatttttgcaaaatctttgtttcttcctcttgcttaaccctttctattccatctctcttttatatttgagacttctcaaatgtttggtgatcttgactgaatattcatatttaaaagtgggatgctgaaaagctgactggaaccttgtacaggtagatagagttcattgactgtgggcattgttgcaggactttctggcttatcttttctgttggggagccactgaagtcagattctttaggcattttttttcctttgggctggccagatttcccagggaagatttattttgtctcctgtctgtgaagttcaagtctgactactagtgtaatggaggtgattggggaaaaaatgggagcagagtggcgagagaggggtgcatggtctcaatatttattatgtaagtactcagtgcttctaccttcctgatgtgcctgtgtgttccccagtccagggaccctgtttcagcctctatataattaatctcaagtcttctgctagggtaggcaaggatgttgcttggtgttcttagtaggtaagaatatcttgaggtctgatgactttgtaatagacttttactattcttctgttgttaccaccaccctcactcctgtttcctgtggctctttatgcttctaatttttcaccactgggagttctaaggaacaaatcggactgatttgcagcatttctagcatcaccttaggatacagatttctttgatctaccaagttactactctttcatctgctttccaatttcaacattttgttgtttctatctttcttctcattcttttcattcttataggttgatgccttaaaaatccctttattgttgtttagtttggattcaggaggtaacagaggcaactgcatgtgttcaaaacaccatcttcaaccaaaaggcactggctcatcttttccgttaggcatcccctgatgtcaatttcttcaggcattttgtttttttccttgagctggcagatttcccaggaaagacacctgggtctcctgtttggagggtgcaagcctggctaccaatgtaatgagagatgaagtttcctttagagattacttttcctttagatttcctccagcttgatttgtttaggtcaatgaacatattttatgaaatgttaacatatggttcatacataacccatagaaggaacacttaagtaatatagtgagattgaattcacaacatttaaaaagtttaaattttggagcttcaaccactaacttctgatttgatatcaacggccagaagagaagctgtggactaaagatgcccctgaagccagtggcctctgtttaatgactctcatagtattctgctagcagagacttatatttagaataactattattaaaacttacttttgcatgttttgacttaatgatttaaaataaaaggggacttgaacatgtttcaaataatatttattgaggccaggcatggtggctcccacctgtaatcctagcactctgggaggccaagctcggcagtttgcttgagcccagaaattcgagaccagcttgggcaacatgatgaaaccctgtctatacaaaaaaatgcaaaaattagccaggcgtggtgatgtgcgcctgtacttctagctactcaggaggctgaggtagatcgcctgagcccagggaggtggagaatgcggtgagcatgatcataccactatactccagcctggggaacagaggagaccctttctcaaaaaaaaattagatagatagagtgtcgatagatagatggatagatagatagatagatagatagatagatagatagatagatagatacgtaggcagacacaattgatggtagctgatttaaatatctttaaaaaacatcttctatttttatccttgattttcagccccaggatacttcattattcacaatgcagacagaccagagtatgatctgcaacttggtaagttgatttgggtttgtgctctcaggaagttgttagttatcactgaatgttctaaagctgatcattctaggctgtctagagtttgaatatccagaatgtggtttctggatcctgtacttttctagaaaacaggagagaatgtgtctgtaaaacctcagtgtgactttgcatttggttatttctattcacacaggcacagtgattccagcaaaaactagtctcctaatgatgaaccccagcagaacacagtgaatccattaaagacatgtatatttccatgtgaatataacttaagttccagtatttaaagtgaaattgtctcaagaattcatgcttcaaaataaatccttgtttgtttcttgaacgtgaaactaccccatttatcatctcatccctccactttgtgagaggtagaaagcagtaatgcatagtagagttgtgattcctaatttgataccaaatgagaagagagagaaaagcttagttaggggatgagtaagaaatagaaatagttactcctggcgttagagaagattcttaaaagatcagtgttgcagttatgatgggaaacatttttagcaacagcttaaagcttactagtaaagatgaatgaagagaccttaagagatatcacttttgagcatgtcattgctacacttcagaggatttgggctctttgaggactagttcatgagggttatttgtagcactatggttttctcatgggaatagtgcatacttatcctagctcctgcctttcatattggatgcttggaattgagattaaatagaatgatttcttttaaactattttaagtaaggaattctcttctggaaagtttgtcttcaaggctggtttgatatatttgcaaagacaggtgtgtctctcataccttgtcaatagattgtcacacttttgccttttgggcaaccagctgaaaggcagagtctctctggcctgcaaataaatatttaaatgtttcaaatacaaattatacttgtgttagtaatggagccagtgaagctcattcttcatgttcattggtgattctccagctgagtgatgaagatggagaacggaatttttaattatcaatcatgaatggtttatgagaaatggagaaataccagtataaaaggaaaggcaattggttataattaaactcacacctactacacggatgcaaaagattcaggtctagaattcagtggtttttaagtttcagtgaacctttccctgtcatccatggctggtcctaggagcttccatgcttgtctttctcttctgtttgtatgtattctctgaagcagacatcttgccccttctttccatggggaacttagctttgtcatgttcagcattgcaaatgctgctaaccttggtcctgccctctgatctaggaaatcacagtgaactgatgtctcccagtgagtcgtgattgtacacgatcttcccaggagcaagaaaacgccccagtgtttggctcattgactattctgagcgaggtagggggtgaagttggtaatcagctgtacatctcccagcctgcatcatacagccccgcaggacatcttttgagtacaggtttaaacccttttgaatcagtaactcttgctcggggctcagggttgcctctaaagccctttggagttctcactaaattagttctctcaggattggagaaactggatacaaggccacattggatgtgactagacttctgcccctgctgtcccaacccatctcctcttcctctgtattgacccgcctttcatcttatcacaaaggataccagaaaaggtgctgcaaggctacactcctcattttattctaaaggaataattggtttatggtcctcagagttaaaccattgtggcatctgctgccaccaatatctgtaaaggatgtacctcttctctgagtgtgtaatgactgctactgaagcaaacaataggaaatcattctcagcactccaaaataggtgtggcatgggatcaacccatttgcaatgtctttcaagggaggcatcttgtaggaaaaacagtgaaggtagggcacaattcccacaggactatattaaatctctccacaagcggttgctgacattttatctttgcttttccctctttcttgacaaaatacttacaattttacattatcttggaatagaaaggtggcctctatttctaaatttgggtagctgattttatatataaccatgcttcattgttactcatcatttagtgagctatactatcctcctggaatttaggttaagttgtaatgccatattgtaaaatttcatgtgttattgtcgtatgtgaaacatcttgtgacttgtggggaacataagcaatcctatgttctctttatactagaccacagctgcactgtcaaatttcaacaagcaaatgcaattgggctcatttataaaatcaccctagctatttattcttgccttataaaaaatgtcagaatttcttcagacttctaagaaacccagactctggtgcaaatattttttgcattttaagatatctttgcattttataaaatatatgatgttatatttctttggctcatgttttaaaacatctcttggcttctcatctggcttcgatcttacttcttccatagagtagactcagcttgcagtgaacagcatctgctcgtggatttcttggtgttttctcaaattacccttttatccttcattgtgaaggtcatttgataccaggctgtcatagcaaatcaccttgacttcccaaatggtaagatcattccctgagcacttacagtatctatttgctgttatgaaaacttgttccactatgaagataattcttttcaaacaataaaagtgaagtatttttccataaaggactcttgagagcatattagtgtgaattttatctcattcttccttaaaaattatgtcaggccacctcttaaagctgaaaaaagcccataaaaatcaaatgtctgcacacttgtctaccagtcccttgaatttattatgtccttttgaaaagaatagtcgtgtgatcctggcatgcataaaaatggaatgatttggtgggaaacataagacaaatactttgtgtatttgtccaacactaggctattcatattcattttgtattatctcagcataacttttccagcacttctctgtggaacttgccatgtgcactgactcagataaatgtacaggacaaatagaggtgcgttttgattgcttatggtgagttggatagaagttactgatttctccaatcacagcattaattagagacttcttactccactgggaaatcacttttaaactttttttagtttaagtgttctggtgatagaaaaggatcttatgagccctctaatggccattcatttagtgaaagaatcatactagataaatatgtttatttatattaataagaatggaaaaagaaggaatattttcagtatttgtagtaacatgcattggctgtggtgcttttaatggcttgctgttagtttatattgctaattttaaaactaaaaaggccttgatctaagagatgccagaagcctgattcagcatatatgtaattgaaatcaggatgatgtttatatgtcttgttgggacaaaaagacctcaccctgcctacacaattcagggggtataattgaaaccatggagaatactgccctgtggttctttaaacaactattatatgaaataaatgcattactaaggattttgttggagggagaaagggaaaaagggactgaacaggaatttacaacaaggcagtaaagtatctatgattgtagtagcaaatagccaggtagctgattctgttcttcccagccttggaagtggaacactagcttcatggtgacctgttgggtcaaatgaatgcattttagtctgactattagaatgactctttgatttttttggtgcaatgcatattcataaaactgaaaggccctggaactgtgtgccctgcgatttcttccttactccttcccactggcaagtaattgtgggtcctcctagaatcctttctctctgtctctgcctccgtctctgtctctatctctgtctctctctctctctctgtctctgtctctctctctctggaaaatagcagaacctcttatagctatcataggtaagtgggtagtcaaaatgttgcaagtaagtaaaatgggtaggtaaaatggtaagtcttgcctgacttcaagggaaatgacagtcttgatgatggtaaagcagaagcttaataagattttatttctagtcttttccattctctaaaagcctatgatggcaaatgggggcttttctccagcacggatttcatgaagctagttgcctatgggatgacaaagaaaatcttaattgtccagtattctgtaatgttatctatttacctgttgaatctttttcctctaaccctcaaaacaaacactccaaggctgaatctgaacaggctccacccacagagccaaaagcagaggagcctctggctgctgtcacacctgccgttggtctggaccttggaatggacactcgggctgaggagccagtggaggaggcagtggtgagcaccacctccctctcaccctccatctgcctcgctgccacagccatgctcatctcatgaccatatgcatcgctctcatctttgcctcacttgggccaaacatgctccatatctgtcgtagctcccaggttcaaatagccttcatgcctgttctctttcattttttattaaggaagatatccagataactgatcttatgatctaaagaaaactgtacatagccacaggtatagcacagtagaagggttgtagaacttgcgagtaatcagacctgttaatgctttgttctacctgtgacagctggagacgtgcctttattagggaacttgcatgtgataaacagaataataactttgttcattgtgtgtacatattgattacttacaatattagtttcataggttggttaaggtccaatgaggtgttgaaatcccatatcacaactccatgaatctgtaaggattcctatatgcaccaccatttgctcacaattaagtctgctgatgactcataataatacggaccttgaggatgttttgtttttgtgctgggatggggatccatttgtctgcctggaaacctgctcttaccctaatccatgcagccataaagaacaccacattgcaaactgggctgagctctgatatgtaccaagtagaattggacattgtaatacccatgaaagtgtagagtaccaaatacccatggcgagtgaaaagtcatttatttatgaaatgcagaaaaatgtcttccaacaatttcaatcagggtaccatttacccttcatagactgtacaaataggaaaaacaatttctctattaccaaaaataacattccctagattagatacctagagaaatgagtcttacttcatgtcgttggtgccttaagtcattttacagggaaaatggtaggtcatctgtcacatcaacagttcattaatcaagtagaaaaataaataatagtgcaagatagtaatggaaaatacttaaagctggactgaatctctcctagaggcattgcttgcagggactttagaccagggagtgctgtgtccagggccactcccagattcactggagatttcagcaagtccatgcagacagtgctttttcacttggtgtccaatggtgatctgtctactcaccttagctttaagattatttaaataacaaaggaagggaaaaatggagtttaatttttcgttactattataattaagaagataatttatttttaaaggaatgtggatgatgccagggagttaaaaagatattgatttaggttttgagggaaattgttttgattctgaaaaagctctcatcaaatccctattttgaacagcagcaccaacttcatcttcaccaatgttttaaaactagttcattgattttatgcccaagactattcagtgtaaggcttaatgccatcatgcccatgagcaggggcagcattggatgttgtgcaatagattggaaatgtggaatagacaagctactgtgttcaatacggctgaatgttgattctctatgatcccttctaagagtgtcatgttcatatacctcccacacccatcctcatttcaacaaaccgatctaagtaggcttttgtttttttcagaatccaggtttatggttttccagtggacaatattagtggccaccaattattaagtacctactatgtaatagctaatatatatatatatatatatatattcatatgtttgatcattgtttaaactaagggtaatatgaaaaatattcaacaccctgtggcacaggcaccaaccatcactcaaaccagcttccctcatgttgggtaagcagctgtttggaagaatgcttcattctgaaaataccttttctcctgaagctcacaggtgaactgtagagaatcaaaaattttgattccttgtaaaatataaggcaatttacagtctaatgaaggattcaggcacttcctgagatccacaggtgatgcaagaatcataggtgcagagctcacagtgtgatccacgctttccacagagaaaaaattcaagttcatttctccatatggactgaaaaataatagtaacaatgttaactaagaggagacagtttacagcaattcagtttgcctaatggtcatcagtagtggctgccttccatgtttttaacatggacatacttggatgaaatcaatttttcccctcgttctcccttctccttaggaaaatagaatcagataaaatgtatttttgtttcctaaagtagatttatagcttcttccttccggtcataataatctaacataatattagggttatatttctctggagaaaggtctattaggttgctagatacgtggtatttagttgtaaaaacaaaaatccacattgtgtccctagcattaattaattggctggctgtggttgtcgtcagtcagcgttgagttgacatgaccttttgaggtaatccctttcactactgaaatgtcaccataattattagttcaagttttgacagaatgcatttcacctgagatgaagtttgtgattgttctggttttttttgtttgtttggtttttgttttgtttttgtaaagaggcacgtataatttcaaacatgggaaattttaacggtgtttccaaaagaaacctagggcttttaagaaaagtttaattattacatttttgtttgttgttttatttctcatataggtagtattgtcttcagtttttcccaacaacatcaaattttactggtatgtctacaggatgcatttaaaaaaacaacactcttgtctttacttttccagatgtttctatgttatgtaaataatgaaaatatttgttagaaaaaaaatgatttggggccaggtgtggtggctcatgcctgtaatcccagcactttgggagggcaaggcaggcaaatcacatgaggtcaggagttcaagaccagcctggccaacatgatgaaaccccatctctacaaaaatacaaaaattagcctggcatgatggcaggtgcctgtaatcccagctacttgggaggctgaggcaggagaatcacttgaacccagaaggcagaggtgcagtgagctgagatcttaaccattgcactccaaccagggcgacagagtgagactctgtctcaaaaaaaaaaaaattcaatatgatttcaatattcgtttcaatatgtgttagagaatcaggttgtaaagcaggtaaagatgagcacagagccaattcataatgtattatttggttacaattaattatggttagatttttacccacatttattccatttttttctaaagaggccccttctaattttctctaaatttctgtcagtgcctgtattttgcttaaatgatgtgaattataccagtgttcttttttgcctattattttttcaaaataatgccgtgtaattaaatttagagttagcatagtttttagaacatataaatgtaaggaagactgtggtaaagacgttcttagaattgttggggaatcctggattatgaaacattattgacccattattctggggacaactttggtttttgctgtgttttgttttttaaaaattttaccactaaacttgtcaagaccaatttaaaccaacaaatatatacatatcagaattgccagactatagtctatcaacttcatcttgctagaatatttctgtctgaacagaatgcatgtgctcacttcctcttttactcagttgacagatatatttgagtcctctgtaggtgtcaggctctgttctggatctggagaatacagagatgtggtaaatagatatggctcctgcctcctagtttccacagactggtggttgagatgcacgttacacagaggttgaggtgtccttcagtgacactcatgttcacgggaaacagcatttgggttttatccttttgcagagtaaacatgagagctagcgtttcccctgtgcctctagatgtgatctctcagtatgtcagaagaagacattgaagatcagaggaagccaggaagcttgaattattgtctgcccttattaacatagaatgatcttccaactccaagggcttacactgaagcatgctttaagatgtcaagaaacatacatatggatttttcttttttttatgagaaccttggagatggatgttcctgtttacctttcttagaaaaaaaaatcacagaattggttattttctgagtttgattgtattcccattagcaaatagttacattttcaatgcccctcaaactaaataagtgtctgtttctctcttgttcatgataccaagcacacagcagagtgcataatccatgcccatcaaattctaagtcattgatttgttagttagttgacagtgcagtcttggggtccttaaaggggctgcagtttgatttcttaaagtacaaatatgtatatggtcattttccttctctttttttttcattcagatactttggctttttttatatttaggaaaagcaagccagttattatgatcaaaagcaatgtcagttttttcattctgccccacagctctgtgacacctaagccccacttacctcaaatataaaatggagttaataataatcaccttaaaagtttcccatgagggcttagaaataaaacatgttgtcagtttcaacatctgtcgtgcagaggttattagttaatgacagtttggtgatatcattattgttatcatcgtcatgaaaagttggtgagaagcaaataagcagaagcatgtgaaatatgtactctggggaggagaaagcagcagaggcaaagataacagccccctcttccagtgttgcctcatgtcagaaatggcaatggacccagtccctgttagatctccatcaacgcaaatttccatgtggttcccaaacaagctgtgtcccatcaaaattctttgtcctttctaagaagacttccccttttccaggcaccttcatactcagtgaatgaatagggaatttttctatcttcattgcccaggagatgtgagtattcagagaactggcagtgccctctcagctgcgtcctccttccatgtggttgtagaaggaaaaagaagggcagatgatctacaaacatgatacatccaaatctgatacaagtaactgaacctagatctttctctctgtctttgcaggaagtcatagggaagagataaaattagccaagaataaagtgaaagtaacaacacagtgatcagttcccccaacctcacagagcaggttgatctgggtttgtaggtggccatctctgaaatatggggccactgctgttttgagatgtggctgatattaagtattcattaaccacctaccaactgctagtagcggcatcttccctgccttctggagtgtgatttccaaagccccatctcaaacagggccaagtgagactttttaataaatgtcattgtttattcagagtgttgttataaatctatgtgaacatgaactcaggattcaggttgttcttccactattgaggagccatttttaggtgatagatgcccagtgacttttaagtattacttttggcatgtacttttcttctgaggtgaaattcacataaaataaaattaaccattttcaagtaacaattaactggcacttagtacattcacagtgttgtacagtcatcacctctatctcgttccaaaacattttcatcacctcaaatcacagccccatagccattaagcagtgactcccatcttcccctccccaggcccttggtacctgccaatgtgctatggatttatctattctagagagctgatataaatggaatcatacaacacatgattataagatggttttgtgtctgccttggtgtatactttttgtcacatactaaatctagagctttagcttgatatatttaatatgactagttatcattagcttcaggataagaaactcttattctgtcttctgaatatgtattgggcccaattcataatccctcattgaaaccattcctggtcatcaacacaattgggtagcctatgtaagaccagacccattcagatgttaaaaagacaactctgttgagataataaagccccaccccaatatgaagcccagtcccaccccagaaatcagaatttagacctacaagagccttacagatgtgttctacttactggctcactcctcttcccctacaggtggcagtgttgggatttgtttagtccatggataatatggaaccaaccccctagaccatgtgtgctgagttctcattcacttcttgcctgttcctgttctgtccatccctcacctgcacgatagaaaggcccttgcatgaatccctcctgctagccctccacagacatgagctggaccttaaacatgatcaggaaaaagtgcttgatttgagattagagatcccttccttttccccagcaagttgccttgtgttccagcatcggtgctcaagcagctcagatactgcctttgaggactactgtgtgtgtcctgaaatgaaggagtatgatcaaagagagtaaggtgatagtaaagaaggccatactgtgataagagatactagggagcagtagcattgtcatgcattctctcacagcagtcccgtgaaataggattatttaggcatcaggtccctcgttttacagattaagaaaacggacacaaagagattaattgattaaccaagatcacacatctagaaagtagtgacatgtgattcaaatcctggtattttaagccatagctgtctatctcctgactactccagatgcttttaaaaagaggaggttttataaaaatatatttatcaacacgtctcatatcacatctaactaaagccgttagggtcacaacttagggtccaagtggacacaaagacttcccacaacgaatgcttagacttgatggatgttcctggtttgtggctgaggagttgaaatgaaacagaaactctgtgcagcctcaaccttgagcttctcagagataatgtgtgtcctaatcctccactttggcggcaaagcaaatttcaaaggggatgtatttgaaagaccttgaattaggaatatggggaactaactgcatggtcaaccagtgaagtggccttagggaaatcattttaccctctgtgccagttttctcattcttcctttaagagggttgtacatgataacctcttcctgctcccccaaaatcaaaatgtattactttaaaaattccttgtagtaacaattctttgtagtaacaagagcaccctgtgtttatggcttttttccagcctctgtttgctaggccatcgggatgacatatcattgtggagtggcttttacttactaatgccatggccagttcaaaggctgtgaactcagaggttggcagtcaggccttccaagtgtgactttcagctgcctgcccctcctcaagcttcaggccccacactgccatctgggttgggtcccaggttgcacggtgagatatatgtcgtgcttgacagggtcaggtttgggagttttgccaacaaagtgtaatgacattcaggtgatttgcagatcactgtttctcagtctagtctctgggtatgtctggcagccttccctctgccttctgccaacctgagcctgggcctgcttaggagaaggcagtttgaggtgtaacagcaggcaccttacatatcattcaaagatgacatagccagccatagaaaaatgcttattgtaccataaatgtgtcttccttaagcaatctctttaacaaactatttgcaatccccattgaagctgtccacggcggctgctccaaaaactagtatgtgcttatctcctcatctctgagagagaacaatacatggtatttacgtttgcattaaaagataagtccccttttcctatccacttctcccctatgcgttgcggataaatcactaattaaaactttaaatactgatctgtattattattggatatactgacacaaacttaaaggccaaattaaccaaaaattcattaactttgggatctctgtagaagactttaatttttgaagaaagtgatggagctagttctaacagacgttgccatggcaacagtgctgcctgcagttgagttgctctgggacccggctgctgagggttcatgataggactgcaggcaataccaggagagcagattgaaaaagatgattgagctgaaggttgtgagggggacaccactaaattcctttattagaaaaaaagcgcataaatgtgtcaaatgaaatttgcggtatcaagtgccagctttgaaaggaacgctactagggaccgggggtaccatgagagagcttgcccctacagtcacactgaaggaaaattatgacctgaattgttttaaatatagttcacgtgaagagatttaccagtcaccagcctgtgccatagtccaatcatcttctatttggggccataatgaggatctggataccctacctacctcttgggcttttctttaaaatggattctgaagaaaatgctgtattttcattaaaatgccaaggaacttcagacaagtcaagagctcaagttggatctagaattagagatgggcaagaaaaggcaatggtgccctgcagccagaattcccgctgtatttattctcctttgttacttttccccatgagtttacacagctaggcccaaagggacttcctccagctccatagcaaattagtggaagagtcaaaactaaaacccaatctctagtctgtctctagtgctgcttctactttataatagttcctcccttctaaaatgagaacattgggccctatggtccttccagccatgggatcagattaatctctaacttgtgaacatagctatcaatgaaacttctaaatgttctcagttgtagttctgtagtgcaatggatcaactggtcatcttttccacttttccagcctgtacataacttaacgatgaaatccacaggacaaaaatgaaatctatagaacaaatacaggacaaaataatgtagaataataaagtaggcaaaagtaatgtagagaaattctttttttttttttttttgtgatggagtctcgctctgtcacccaggctgaagtgcagtggcgcaatctcggctcactgcaagctccacctcccagttcacaccattcccctgcctcagcctctctgagtagctgggactacaggcacccaccaccacgccgttgtatctttagtagagacagggtttgaccatgttagccaggatggtctcaatctcctgacctcgtgatccacccacctcggcctcccaaagtgctgggattacaagcgtgagccactgcgcccggcctaagtaatgtggagaaattctatcaaaccaaactcttcttgatatctttttattgtataatttgctattgattaagaggcattttgtgatatgtttgctttgatgcccagatagtatgtgtacatgaataaagaaaaaaaattataatctatgcatctcactttaaagagtagcattccaacaatttaagtgaatgtatcaactgtttataagaatacactcacattctttgtcaaacatcacttgggaaccaaagattatttaggaggtctcagaatttccgtggaactcccttacttgagagatgtgtggtcttcttggttatgggatggtgtgagaaaacacagaatttagagttagacaaactgtttcagtccttgtttactgactaggtgagttacttaaacttgaagtactagttaatttttcttgaaaatgggggaatatttaatagggttgttggaagaataatgtgtaataaatgtaaaccacctgagatacagtctggaaaattgtaaattcatgataaatatccatttccccctcagtctacagaatgtgcatatatcaaaactgtcaagcagaaacctgcttatgaatcagaatcagaattattattctccatctttggggtaaatcagtaagccttgaattcagtggtcctgtagtcaaatgtctctgtaagagcaaatgccaggaagatggctgttctctaactgtagtataaagtgttccatagccatggaagaatatcatttggctaaaatttaaaatatatatgtctttattctgtacttatggcttgtataatttaccttagtgtatatttaattttttgaatttttttaatttaaaatttttaaattttattttagatccagagggtacatgtgcaggtttattatatggttatattgtgcaatggtaagatttgggcttctattaaaccatcacccaaatagtgaactttatacccaatagataattttccaaccttcagcctcctctccgtctccacttttggagctccaatgcctattatttccatctttatgtcaatgtgtatccactggttagtttctactcaaaagtgagaacatgtggtgttctcacttttatagggagaaagagagagagagagagattttccctaatagattcctctctctctgtctctctctctctctatatagatagaaagctagctagctagatagatagatagttagatacagatatatctctatatctatctatctatagatagatatagagagagggagagagagtaattgctggatgctagatagatagatatagatagatatatctctatagctatctatctatgtctatatatttatacacacacacacacacacacacacacacacacacacacatatatatatatatatatatatatatatagagagagagagagagagagagagagaggagtctattagggaaaattggcttatgcaattacaaggcaaagtcccacgattggccatctgcaagctggggacagagagaaaccagtagcaaggctcagcctaagtctgaaagcttcaaaccagggaagctgacaatgaagctctgtgtgatgccaaaggcctgagaacccccaagaggccactggtgttaagtcccaaaaccttgagttttgggcagtaggagagaaagcaggcatccagcacgagagagagagagagagagagagagagagagagagagagagagagggaaagggagagagagaggagaggagagagaactcagagcaagcaagcttatccccctcttctacttggtgttccagccatgctggcagctgattggatggtgcccattcacattgaggaggggtcttcctctcccagtccactgactcaaatgtcagtctcctctggcaccaacctcacagacacacctagaaacaatacttcaccaaccatctaggcatccctcaatccagtcaagttgacacctaatattaattattatagcagtctataaattttatttatccttttaaataaccagctttctgttttgttgatccttcgtaagattttttttaattttcaatttcatttagttccgctctgatctttgttatgtcttttcttctgctagctttaggtttggtttgttcttatttttctagttccttgaggtgtgacgttagattgttaatttgagatctttatatctttttgatgtaagtattttaacagtataaactttcctcttagcattgctgttgctgcatcccagaagttttgatatgttgtgtctctattttcatttgtttctatttttttatttttaccttaatttcttatttacccaaaagttattcaggagcaagttgtttaattcccaagtatttgtgtggtttttagagtttctcctggtatttatttctaattttattccactgtggtctgagaagatgcttggtatgatttcaggactttgaatttattgagacttgctttatggctaagcatatggttgattttggagaatgttccatgtgcagataaaagattgtatattctgcagttgttgggtggaatgttctatagatgtctattaagtccatttggtcagaagtacatttatgtccagagtttctgtgttagttttctgccttggtgatcagtctgatgctatcagtggggtattgaagtcctccattattattgtagtgatgactatctcttttctcaggtctagtagcatttattttataaatctgggtgctctggtgttggatgtatatgtatctctctatatatctacatatatatatataggatagttaaatcttcttgttgaattgaactcttgttatgatataatgctgtctttgtctttttaatgttattggcttaaagtctgttttatctgacataaggatagcaactcctgctctttttgtttccagttgcatcatatatcatttccagcccctttacttggagcctgtgggtgtcattacatgttagatgggtgtcttgtatgcagcagatggttgggttttgtttttttaatccaattttctaatctataagtggaacattaaggctatttatgctcaagtttaatattgacatgtgaggttttgttcctatcatagtgttatcagctagttgcattataatctcagttgtgtaattgctttataggatgtgtgaactttgtacttatgtgtgcttttatggtggtatcatccttccccttccatgttgagaactcctttcagcatttcttgtatgaccagtctagtggtgacaaattcttttaacatttgtttgtctgggaaagactttatttctccttcgtttatgaagcttagcttgacaagatataaaattcttggctggcattttttttttctttaagaaggctaaaaataggccccgaatcttttctggcttataaggtttctgctgagaagttgactgttagtctgttggaatttcctttgcaggtaaatttgacacttctctctagctgcctttaagattttttctttagtgttgatcttggatactctgttgattatatttcttgatgatgttaatctcatatagtacctcccagatgttctctgagttttttgtatctgaataaatacttctctatcaagatcaggaaaacttttctgaatcattccctcaaatatgtttgagggaacatactgcactcctttgaaggtgtcaaaacactctgtctttttgtattgccagagttcttctgctgattctttctcatgtgaagaagctgtcacttcttatttttaaattagtcatcctttggatgggacatttaaatttttactcttttttcccttgaggatatggctgtggagtttgttgtatatgattgtttggctttgtttctaggtgctttcaggaggccaaggctctacatgggttccttggttatggatatctgttgtgtggtggctttctcaaacactgcttgttgtagcagtatattgggtgtatgaactgatacactgtcttctgtggggctgggagtgtggaggtctcaagaagtttatctcatacattagcactatgcccttctgcagcaggttttttatttggtcttcagtctccagtccagtaggtggcacttaaggatgacagctggcttacccttgggtagctggatgatgaatggaggcacctgccctgacaagggtgacaggaggaggatgtgctgagctcttggggataagggttagggggctgcagcagcttcccatcctagataggcagggatgtgattcactttcctgttgcaggactcgtgaccttcagttcacatagatgctgtcctttgactccagtctgcagtgtgactgaggtctgtgaaaggacctctctggtggctatcagcaaaatggccttggggcacagcttcttcccccaatccagagcagacagctctgtgacttgtctgtcctctgttgccaccatgctgcccactctgtttagggaggggaagatgggctctgccctttgtgcaaacccaaatggcataggctcactttcactgggggtgcggccatctggaaatgcactgaaaaggctttctccaagtgcacttgcccaaggccccagtaggggaagtctgctctgcatccacaatggtgggtgggggaagtgggaaatggcctcttttccatgatctttcccagccactggtgctacccctttcagaaatcagcaccatgcctgcatttcctttgttccaaggggcactttggcaggccgtattcccccttccctcggggcggcctctgccaagagctagctctctggagtacccagagcttcccagcatcctccctatcagtcccctatcattgccaagtcagagtgggttctaaggtatgtttgcaggggtctggtgacacagacaggcaggttcttcaggcaggcagtgacctacactgggtgcacagccggtatggcacctgccatttcagtgcaggcctgcggggagtccgagtgcacctggaggagctggccactgctgctctgtcctcaggaagttctcagattgccaccaacagcattgcccaaggtcacaagggcagaggtgctctctgacaatttagtggtcagcagtttgtcacagaagggaggggagtagagaagcacccccacctaccctttctgccgaattctaagttccttaagagtcagtctctgccagactctcgtagctttcctttttctacaccccagcttatttccatgggaactccaacaggtcctggctctcttctctcagctttccattcagatcatggccactcgtctgtaactttgatcccctttctgaagagaactggcttctgacgtctccagtcagccatcttggaaaaaacaacaacaacaacaaaaaaaccttggagcatttttttaaaaaaatgaaatttatcattgggatgtgtaaaagaagattcacgagaaagctgaaaacacttaaaaatcactcaaaaaatcagattcactattactagttttttttgttttcattttaatgattttactcttaaagaaaaaacccagcatatagaaaaagaaagtcaacatttcaaaagtatattctagaaatgttagctaaacccaagataattttccataaaacaaagtataaatggatccttgacgcataatacctgagccaggcaagggaaaatatctgagagtgtcatccatctccaccctcgatcagagacaactcgcatctaccccgccatgagtatgggattcctttctgaagcatccaggccatttggggcctgctgctactctcacagaagtatatcctttgacacatatatttaggggattcagagcaggtgattctatgtcaagacttgataaatccctctccagctcctgttctgaaaaggatatctaagagtccccagatagcgagtaaaatggaacaaagaaaatgtttccacgtctactgtaaacatcaagcctatagagatttctcctgatttgagaaaactaagcaagtaaatacatttttagattagcaaacacctatagagcaatacaaaagaaaaaataattattgcatgccagagttaaaagtttctttagagaacatgcaacaataacaaaaattacctgacatacaaagacaaaatttgaaaattgccttcctttttgttgtcagtaaaactcaagatgacctcgataggtgaaacaaaagatgaagggtgagatgataaggcaaccatattgagaagaaaagaaagtcactttgaaaggcagatgaaaagggaactcaataacatgagaaaagattttaaggggaggaaatgtaatattagaattaaaatttgcatgagatgtggtaaagacgagaagcaacactatagagaatcgatttagtgatatgaggacaagctggaggagttctcccaacacataaagagaagcacaagcaaagatgatagatttagggaccaaggagtgaagatacagctcatgggtagaagttcatcctgaagaagagactataagaatgttacagaagcagaagtggccagtataatagaaaaaaacatgctcaaactgaagttttcctagttgatggaattcctgcatgtggatcataagaaatcaccaaaaaaagcaaacttaatggggagagactacattgaaatgtattcttttaaatatttgagtttaaagtttaaaaaaaaagttctgcaagcatctaggttggaaataagaaagcactacaaatgaacaacaattaggttgttctctgacttatccatatcaatactaaaggtcagaagctattagaacaacatacaaattttgagcacaaagaaacacaatacagtaattctaccccaagtcaatagttggtcatgtaggaaagcagcagaaagacattaccaattacataaggtgctagagactttccatagaattcctaaaaagcattttatgaagctatattgcaattgactggaagatgactcaaatcaaggcagataggtgggaagacgtgataaagcaaatgtggtgacatgtctattgaggatcctaggtggtgggcacttggaagttcattgtatgattctatgtttttgaaattttttaaaaatttcttataatgttgagcagaaacccccaaaacatgtttaatggagacatcataaagaaatagagcagtgtttagtatttaaattattgaaatgtgtaacctaataattgttgggttacaaaccaaagatctttctcacagtgttagagtaacatttaaaaatgaaaccaactagtgtttaatgctaatagaactgttaaataacttgataaatagaataagcaataaagtattatatatccattactataacttttctcagaaacatgactcatgttttgtaagataaacccttgtatgattagaaaatgaatacaactaaatatatcaaaatgttaccataaattatttcttttattattttaaaatttgttagaaaaaaattttttaattgctttattagaaaaatgcctatgatcagttacaataacctactttataaataagtatggaatttcatgctgggcagaaggataatgaaagtatcttcaattgtctcatcccgaccagttgcgtgattgacacactactttcaggcattggtcagagctaatatcacaaagaaaacaagcaaataagtaaataaatgagtgaatgaatgtatgaatgcatgacataaacctcagagacgacaagttctcttgagcctatcactactctgacatgtttgggggtcttggtccttgttgacctgctttcatagcaccatctcatagcaggactggctagtttctgtcacccagttgtgtttccctattttacatgattgataacctaggctattgttgcatttcattcatgtcattacatttccagaaaattttgctaaagcaaatttaaactggtgtttaggggaccctggcatgaatgccataattatgtggctttccactaaggagatgattgagacagaagattagaaagcaatgaggggctgggcacggtggctcatgcctgtaatcccagcactttgggaggccaaggcaggtggattgcctgaggtcaggaattcaagaccagcctggccaacatggtgaaaccctgtctccactcaaaatacaaaaaaattagccaggtgtggtggcaggtgcctgtaatcccagctactcgggagactgaggcaggaaaatcgcttgaacctggggggcggaggttgcagtgagccaagatcacaccattgcactccagcctgggcaacaagagtgagacttcatttcaaaaaagaaaaagaaagaaaaaagaaagcaatgaggtatgtatggtgcagagagccaccacctactctctccagaaggttttgtgctggtcgctgtgatttctgtgtgatggacaggcgggttagcaatactcctagtttctgcacctcatagacctcatggatatagtaaatatgtgcccaaggtcaaggagaacatttttagtctctgtttgcaatagctgtttcccccataaatatatttgaccaatagatagtataggttgggcagaagataggataattgtgtttttctgaacatttagagtgaagagaaacatttgatagcactgggtatgaaaggcttgaagtactttcagcagattcagtccctggtctttgtgagtaacattttttaaaaagcaaatggtagtcatttatcattgtggtttttcctagcaggtataacatgtactgtagcaagcagagcatagaaaatgttttttcttttatagctctacaaatagctaacaaattgaaatgcatgacaacaacaataataataagaggtataactttcattgatgaaaacctttttactctttccttgattttatctacagctaacacctaatctgaacaaatgggttcctgttttccattgtatttttatgttgttctattcttgcggtcagtaaatacggcattggaagtattttggtaagagcaaaacatctggaccagattccagacataaagggaggactgatgccccctgatcatcagactagtgtcagaaacagaaagctatgaggatacgcagatagtggatgatccttctctgtttatgtagtttttaagccctgtaaaatcaacgtggtaagtaaacagcagctggaaaaatgggaattcattactaatggactcaaagtagggtgtaggagtgttgtttgttttccaagtagatcattaaaattgtttggcttctctttaaagtctaaagtgccaattccttagcaccttacctttgccagagttgttaatttcggtattttcctgatatttatttatcattcttaaaattcgttttctgcatgctgcagttcttttttatgtgacaaaaatcacagctgaggtgctgaggctgaggtatttgctcctacaacgtcaggaacgtcagagcagtcaggcagagcctttggccgccacctgctggtggttggtgtcacagcagctaatacctgttttttattattttattttatgtttatttttaacttttgtgggtacgtagggggtggatatatttatgaggtacgtgagatattttgatacagatatatgacatgtagtaattacctcagggtaaatatatctatcacctccttaagcatttatcctttttttgcattataatccagtaatattcttttagttattttaaaatgtacaataagttattgttgactgtagtcaccctgtttgtgttatgaaatactaggtcttatttattctttctaattattgtttgtgcccattaaccatcccccctacttcctcactacccttcccagcctctggtaagcatccttctactctctgtctccatgaattcaattgttttactttttagcacctagaaataagtaagaacattcaaagtttgtctttctgtgcctggcttttttcccttaacataatgacctccagttccatccatgttgttgcaaatgacaagatctcattgttttctatggctgaatagtactccattgtatatatgtatcacattttctttatccattcatctgttgatggatacttaggttgcttccaaatcttggctattgtgaatagtgctgcaataaacatgtgagtgcagatacctccttgatatattgatttcccttttttttttgtttttttttttttttgagtatatacctagcagtgggattgctggatcatatggtatctctacttttagtttttgtgtttttttttttttttgaggaacctccaaactgttcaccataatagttgcattaatttacatttccaccaacagtatatgaggtttcttttttctctacttcctcgccagcatttgttattgcctgtcttttggataaaagccgttttaactggggtgagatgagatctcattgtagtttcgatttgcatttctctgatgatcagtgaggttgagcaccttttcacatacttgtttgctatttatgtcttcttttgtgaactgtctattcagatcttttgcccattttttaattggaattattagattttttccccatagagttgtttgagatccttatgtattctggttattaatcccttgtcagatgggtagttcacaaatattttctcccattctgcaggttgtctttgttgattgttcccttggcagtgcagaggctttttaacttgacgtaatcccatttgtccattttcgctttgtgtgcctgtgcttttgggatattactcaagaaatctttacccagtccagtgtcctagagagctttcccaatgtttccttttggtagtttcatagtttgaagacttatatttaagtatttaatccatttttatttaatttttgtatatggcaaaagataggagtccagtttcgttgcctgcttaaattatctagcaaaggaaaggtgataacatgtatatttagtgatggtaaaatcttatacaaccaaattgatagatatctagagacaagttacaggttaataataaacattatgttcgtatggaacaagtttaaaaaatcacctgtggcaacaccatctataggtcatggaaagatatcctctcccagagatgtagtatcaattcaactgagactaaaagccaattagtaataatgtgtggttggaacatatatgtataaaaggatttatgcataatcacttgggagagtagcccatggaataacatcctgtctgctttttcatctgtagcagtgcctctgctgcatgtgtgtgtagtggtggtgtctgctgctctgtttgtccataccgtctgcatgtagatagagtccatctgcttccaagctgttgaaactagtgggatattcataggtgtgattttccagacagatggagagaataagcttgtaatcatgacacaacttattttctacatttgagctcataagtttattgcatgcacattttctttcagtatagtttttaacatagaagaaactttattaggtccttagtgtcgtagagaaatcctgttaatgtctccgacaataaagctatgagcaattgctccttgttcttctcaggattaagatgccctactaatttatgttctgattactattctcttgacaacagtaacaatagcatccataaaaaggtcggtgcttatttaaaacagtgatgaaagtctattcgatttcaaaataaactttttattataggaattttcagccatttgccaaaatataaaccctcatgtacttgttaccccacttcaataatgatcagcatttataattcactttaaataagtgtctgttacaattcatgagaaatcattacttttgtgaacccatattgtattagtccattttcatgctgctgataaagacatacctgagactgggcaatttgcaaaagaaagaggtttattggacttacagttccacatagctggggaggcctcacaatcatgatggaaggcaaagaggagcaagtcacatcttacatggatggcagcaggcaaaaacagagcttgtgcagggaaactcccatttttaaaaccatcaaatctggtgagacccagtcactatcatgagaacagcatgggaaagacccacccccatgattcaatcatctcccaccaagtccctcccacaacacatgggaattatgggacctacaagatgagatttgggtggggacacagagccaaaccatgtcacatgtactttcatgacagggcagaaagaaggaagtatgtcatggctagggattgcacatttggagagccacatcctcgtaataggagattctcataagagagggaaataagtttctaagaatatgagtaaatacttggacatataatgagtagtatagctgttaacatttctttttcattcccaaataaaatattatcttatagaaaaatgtactgtatatattctgtaacaggcatttttatttaaactattacctgtacctttgagccagcagaaacgtttttaaaactgctttgttataagtgtagatgtgtggttcatgttcttcatctccgatttctgatgctcactcggaggtactcttcattgtccttttctgttttctgagtttgaaagttaatatttgcaatattagggccttcctaacttaagatgttgaactggatagaatgtattcaacaaagaaaaaatagttaatcctaatcccatcagatagtaagagccatttttgaaatatgtgtcccggatatattatataagatcaacctgagattcttctaacatagtctttctcacgtgaacctctcaaatcaagtctgccaagctgatgttgtcagaatcctgtttaaagagttggactccaacccatttgttcaaaactaaaatttctgattgcatttcctttatttcattatctcaaattttaaatagtacttaaaactcttcttctgtgtttctaccttagaaagaaaattctgacttttttctatttcacttctccttactggacctaaactatgattttggcattttgcctataacaggctctacagctatttggagcattaccatgcatatttgattacaaaaatgatttccccttcattctcgagggttttcattgagaaagcttccttatgtatttttttttcctgtgaaagtgatttggcttctggaaccttcctcacaaagatttgaaagtttatactaaaatgcactctttctaaattttgactttgtgtgatgaggatgcttttctgatatggcttttctctctgacccaggccacttccatcctgtgacccagatgtgccatgtaaatcaaaaagtgaccaaggcacgtcttagtcatggagaggcttatttagccaaggttaaggatgcacccaggaaaaagagacacgagtcaaaggaggatctgtgacgtgtgctttttctgaagagagttttgagaacttcagtatttaaaggggaaatagcaagcaagaaggaaataatttttttaaaaagagggtggttaggcaatgaggcaagtgtcacattcttgtgaggctctgattagcgctcagtgaatctacattttacatgtgaaaagagggagtggggacaaactcactcatgccttcatctcatgctctgtagttctgcatgttacataagatgaaggaagtgtgtgaaattacagccctgtgtttgggaacaaaaggaaggtggttttcgtgtgactccgttcccaagcttagctttcctttggcatggtaagtttaaggtcccgagattcaattatatttctttcactcccctaaggcctcatttgttgcttccagccaataaaaatggaaatagcttgtggagaggaccacctacaccttaaaagccatgtctttggaatggtgtatgtcacttccattctaatcccatttgctacacctgacagcagggaaagctgaggagtgtagaattgttgggagctcagcagaagagaagtcggagtgttgatgaatagatggcagattctgctgtacctaaatcctgggagtgcaaagaatgttccaaatctgaatagcctccacagaggggagattagaaataggcttgagtttgactcctggcagaggcccatggagatgcagacgtggcctgctggtttctgccctgcagatcatacctggagctgatgctgatgcagctgttggaaccttggtgtcagcagctgagggggccccaggagaggaagcagaggcggagaaggccactgtccctgccggggaaggagtaagtttagaggaggccaaaattggaactgaaaccactgagggtgcagagagtgcccaacctgaagcagaggagctcgaagcaacagtgcctcaggtgagtgtcccatgtcgcagccaggggagctcctgggaagtagcatgggctgggtgctctgttggttggttcatggtgataactctttggatgtataataggtttgtagcaattttgtgactccaccaaacaacattattatcagattctcagaaagactaatcccagctgctcagtatcagcattgcaatgttgcatataggccctcagggcctgtggctgactgggcctaagcatggaaacgggaatgggaaactggggtgacgtggagaaaggaatgaagcaggacagtgaaaaggatgagaatggagccgggagaaagagaatgtgatgaagtgagcactcagcccagggagaactcaatagtatttagatcttattattcttattactgtttggtggttattattatcattagagtgccccaaattcaccatcaggccccttttaccaagagcccaccactgggtggcactttgagaagggaaacaaagggaccagggccattaggtccgtgcatgaggcgggagggggccctgctcggcactgcctcagagcagcattgagaggccacaaagccacatactctaccactgcgagggcctccaaccccagggcctgcctccattgtctggttcttcggtattctagaaggcaacattaagagagggcttaatggtatgcattgttttcttctgatgattttactcccaataagttttcaaaaatttctccagggttacttaaaacttgaaactgaattatccctttcattatccctttttgggctgggggctgaggcagataacagtgttatgggagaaggaacttaaaagaatattcctttttccccttagattttctcatcacagtgcccagagtgtttttgtgtatgttgttctactcatggaaagacggtattatctctccaagttgacgaatgttagtgctctagtctgctgatagcagagggaatatagaaagactcccgttctgctgatgaaactcccctccatgctcatctttgttaaacaaatgaaagggtggtcctaatcctttggttcagacactagagtacttggagtggattgtggaggtgtggtccctccagcggccacagcagtgtggggctggaatgataatcacaagcgaaggactagtggatgatctccaaaccccggctggatcttcatcagcaagcatggttcaggcactgggggcctcctgggactgggggaggggaggaaggggctcacaggaggtgaactgccaaccgcaagagttagggttccgtgggacaagaaccaggctggcctgcggggctgggcgtggtggctcacgcctgtaatcccagcactttgggaggccgaggtgggcggatcacgaggtcaggagatctagaccatcttggctcacacggtgaaaccccgtctctactaaaaatataaaaattagctgggcgtggtggcaggtgtctgtagtcccagctactcgggaggctgaggcaggagaatggcgtcaacccgggaggcagagtttgcagtgggctgagatcgcgtcattgcactccagcctgggcgacagagcaagactctgtctcaaaaaaaaaaaaaaaaaaaaaaaaaaagaaccaggccggcctgcattgactcctcctgcaatccctctcaggatggcctccctcacccttcaagactctgtctcccatcccctatccctcctcccaattcccaccgaaacctcatgcttaccaaactgcctggctattcaaggatccagaaattaattccactaagggtttaggcctcaggaggaacagaaggaggctgtgtggcacagcggaaggcccagacctgagtctggctagtggggaagtatggaagtggcagccccagctttgggctgggggctaaggcaggttgtgcaggacaaggaggttctgttttccaggccctgccgggcatcgccacggtttttcttcccccaggagaaggtcattccttcggtggtcatagagcctgcctccaaccatgaagaggaaggagaaaacgaaataactataggtgcagagcccaaggagaccaccgaggacgcggctcctccgggccccaccagcgagacaccggagctggctacggagcagaagcctatccaggaccctcagcccacgccttctgcaccagccatgggggctgctgaccagctagcatctgcaagggaggcctctcaggaattgcctcctggctttctctacaaggtattcttattttttaagtctcatttatcctttttttgctttaaggcccttttgctcaagcctttggttttccagtttttacttttactttttgcaattattatttctgtgaactgctttcccttcaccacaacatcacttggacaagccaggactacagtaatagattttcatgttttaacaaagaataattaaagggaagttcaccacagggcaaacagtatgcccctgggtaatgaatgggagagtcttttccagccctccctcctctctactcccccaggtgcctgtgaatctgtggagcctggctcagaccaggccttggaatcaccaagagctcctgactcggctatatcccctgggggtcgggcagcaatccttcagtcaactctggcaccttgtagggtgcatgacacagagtagggagcccataaatatttggtaaattaatggattcatgtatgaatgaacttgcaccaaaaggcagaaaaaaaaggcggctaagttaatgggaagaaggttttgctcagacaggctacttagagccttcataaaccaaagggttcttaccaaaaaaacttagtaaatacctaaaaacactggcttaacctaagtgtttcctgtctcagatgtttcctgatagaatctgaaaaggaattttaagtttttaaatttgattttacatttaaaaatcagctctttttcttctaaagtgtaaaatgttgtatcattccctctctctctctctctctctctctctctctctctgtctttgtctctctccattagaaagtaactgctaccttgctacctcttgtggggacaggggtggctataatggatttatgaataaattaatttggaggaaaagctaaacctctagataaggggttgtttcctgccaggttccgttttaactggagcacaagcagtccaagaagccttgtgccaagcacggctggagcttgctgggcccattctggcctcctcactaactgtagaataacctaaggcaccccatatagaccctctctctgggtatcagttttccaatcagaaaaattaatttagggataacataatccatttccagctctgacagcttgtgattctatgaatatgctcaatggcaaaatacacactttaaaagccaatgtttactctcaggggtggagttgagggaaaggtgggaaaaataaaatcagccatgacggtagagtgattcagactgggtgacagacgcataggggttcattatgttatttcttctgctttaaaatatttttctataataaaattttaaggaaatctttttcaaaatgggaaaggaaaagaaactggttgccattgtatataaggtaggatagggaaggaaggaaatatatttacacagaattgatcacagagttttatttagtagtaattactgtataacctgcaagtggtggttttccttattattatttgacagaagctggggttagaggagctttagacattttgggttccagttaaacaacaaacagtaataaagcatcagcgataataaaatgcaaatctctaacaaaaataagatgaattaaaatttgattaatatagtgcttttccctgttgtagagggcattgcattactattaataaatatacatatgaatggcctcatatcagagaataggacttcccttctggctttagaggccttcttcctccttgggatatggcaaatatcttcctcttttcatccaggttggagagtgacttgtaagagtgtctgcttgaaatctggctgggaaattgatttttatgtattcttatcttctgcaggtggaaacactgcatgattttgaggcagcaaattctgatgaacttaccttacaaaggggtgatgtggtgctggtggtcccctcagattcagaagctgatcaggtaaaagaaaagataggaagatgctttgggctacgttgatttttttctgagggtctgttggacacaatcacttcctaaagatgtttctattttctgagatgctacaagccatctgaaaagggcttaagggcttgtgacagcatagatcattaacgaggtttctaggacacccttttgggatgctgttgcattctttttttatataatacaaacagttgactgtttcttatcacgtaaccactttctgggaatgttatctctgtaacacctgtcttcaggaaatgcagacactatgaatgtgaactaaaagaccccttcaaaagtggttgcctctgggtgtgtggatattgatgaggaaagaacctggggaaccctctggagtgatggaaatgctttgtatcttgagagggatgtctgcatgtatttgtcaaaactcattgaactatatatacctaatcatctctgcattacacagtatttaagttatacctcaacttaaagagattctttaaaaatatcacttcctaaaagagtggtctgatgtaaggtactgagaactcccatcttgttctcattcataaaatatgtgaacccttgaaatggtatgcagagcaagtaaatgcatctgtaaacatatttttctggagagaaaaactctaacttccatactattctcaaagagatttatgagctctccccttaaaaaataaattcaagcatcactgcctttgaggttaagacttaatatgttcaacattttgttctttcttttgacaacacacttaccaagatacatcaggtgctgggtcaagcagtctctaccacaataaaatagattggaaatttatataacaataatctgctgggcagggtggctcatgcctgtaatcccaggactttgggaggccaaggcaggaggatcacttgaggccaggagttccagaccagcctggtcaacatagcaagacctcatctctacaaaaaaatttttttttaattagctgggtgcagcagtgtgcacctgtagtcctagctactcaaaaagctgacatgggaggatcacttgagcccaggaattcaaggctgcagtgagccatgatcacaccactgcactccagcctgggtaacagagcaagaccccgtctcaaaaaacaaaaaattaataacaataatatatctttaaaagcccccaaagatttaaaaattttaaaatacacttctaaataacccatgggtcaaataaatcatagtgtgagttaaaaaaaaatttcataatgatcattaaatagaaattaaatagaaaaatgcatagaaggaagaaaataataaaaataaattcacaaatgaatgcaataaaggactataacagataaaattgataaagccgaaagtaggtttttgagaggattaacaaaattattaaaaccttagaaatactcaagaaagaaaagtcacaaagcataaattaccaatacaaagaaaaggtgtcagcatcacacatctcaaagatattaaaaatcccatttataatgggatttttgtctgcattaaccagaagttattttgtaaagaaataaaaggaaaaaaagttagtcttttatgtttaccaccatgtttaccatttccaggtcttcattctttccttaagtccgagtttctatctggtcttaatttcctttctgcttaaagaacttcctttagctatttctgaagtgctagtctgctggcagcaaatcttcttggcttctgtatatctgaaaatgtctttattattcttaatttttaacaatactttcactaaggtagaaatctgagttgatttttttttctttcaactctttaaacatgtttcattgttttctggtctctattgtttataattagaaatcagctgtcatttgtttaatattgcttctctgtatgcaaagtgactttccctgactacttttaataaatttcgctgtatctttgattttcatcagtttaaatatattgtgcttgggtaggttttttttttttatggtcttcatacttgaaaatcactgagatccttagacttgtaacctaatgtttttcactacatttgctttttatctttaatttttttctgaattattctctttgttctttttttctgggtttctaattatacttaagttggacttcttgatagctaagatgctgttctttttctttcactatttctctctggtagtcaggttggataatttctattgatctgccttcaagtgctatgagtgtttcctctgctactttgagttcgtagttaaatttatccagtgactttttcatctcagatattagattcttacaattcttcatttccatattgttatttcatatgggtttccatttcttggctgagatttcccacttatagtctttcattattactgtctctcaatttatatacttgaacaaatttataatagctgccttaaatttcttactgctaattccaacagctgggccatctcagggcatatttctattgtttgctttttaatcttttggtcatattttcctgtttttccatgtctaataattttttaattgatactagacatagtaggtagaccatacgtggtaaagagtctgactctgttttctatatctgaaaattgcttatttttgttttagcagacatataaattactggataattcccttgaattgatgggagttggttttatactttgttagggtgggtctgtaccctttatgcatgcacagcttgggggtcagcccaggatttcaaggcagtttatccacatacgttaggatacccatcccccagtgattcctttcttttcaagataacccccctgagtgtacagcttctctgggagccttacactctatgctgtgaatgccccacatcacactgagtgaggataatcctcaggggaaaagctgtatcagcatagatctcaccccttgcagttctctactttcaagggtcaaatactttctaatttctgcctccttttggtcatttccagcatcttcaaatagttttacccattatttatacccatcccattatatataaatttacactttatatattgtataaccaagagttgtttgtttatataaatagttgcatatgtgtatatatagatatttggagatatatagttattccaatgtttttaattattctctccagaaggagttgtctaatacaagccattctaccattaccaagacaggaaatctttttctaccacatattttaagcagttaatatttaattttttatattttcctcagctaaagattgatgttggctaatattctttacaagttgtctttcagattatatgtgttggaatatatcttgattgtgggtttgtgtagtcctttacttgttttctttattgaaacaatttttaagtgcttaactctacttggctccattagatttttcacctactgtaaataaagtcaaatatagacacttgtgggggaaaaatgaccttttatatgctttctagagcttcagaaaatatttagctatcatcttttattttaagcatagctttgtccttcacatatatgacatcataattttaaagagggcacttttcctcatcagctaggatattatcagttattttattgagtcgtttttttcctcagcggtttttttcctgccttcaaaaattgggctgtctaaatacttatatttcttgtctatatggcagcatcaatttagagtctcagattatatcaaaagggaatgaattcagcttcttcatttaatttttgaggcctcattttatctgatatacttgaactatgttgggggtttgttcagactaaacctggccatccctcatctgaactggaatttcctttctgcactggttaacataataaagatagtcatttcccactccttgcacttcctatggtctcatttcccactgttcctttcaacacagcttttccagctagactctgcttaacttcaggaagccaagggcagaccacagcctctgtttctcagttttaagtatcatctcccattctgcatgaccatatatggatgggttctttaccctttctggggcaaactgtttcatttttgtgatggcacttctatatgacagacaaatgtttatgaggaataatttataaaggatataggagcgcttccagcaagaatgccatgacatccaactgctttgtagtttatataaacttgaaaaattaggtattataaaaacaaaaatagtaatataaggcaacacacatctagcttttagtatttgatgagccctacatctacataggtagtttattggggttataggatatgagctgggggtcagagttctttcttatgagcaagtggcttgggatgaaatataagatattccatggcctcatcagtattccattctaacccaagcaacctcaaaccttttttacactgtgaccccagaacaggtcatgctcttgtgcatgaaatgctttcacatggtattcctgtctttgcactggttgtaattgtaatccttttctcctctttaagaactcatattataatccagttaatatcaattaactatgctttgtacagtcacaatgtacaaagcattagctatactttatacagtcaataagtcattgcaaatgtttattccttctttttctttttctttttttttttaactaacaacttatttgggataggccttcccattgatcacggcacagcactttacctgtaatgtgacatcctggttcagaaccacaacactaatgtaacacattattaattaattgtggcagtgtggattttccagtagtttgctggaccctgaaagttctgtcattgtttttcaggatgcaggctggctggtgggagtgaaggaatcagactggcttcagtacagagaccttgccacctacaaaggcctctttccagagaacttcacccgacgcttagattagggcaacaagtactgcaagaaggagctcagttacggggtttttaaaccttcatgaaaacctgaagagttcacttttgttattatgctcttaatgatttacagactgatgccagacaaaccttgggaagatgtatcaatggagcatgtgtgcaaaaaaatgtaagaggaaaaaaagtaaattaaggaaaaaatcctcactcattcccatgttgtcaataacaggtttgtttgtgctttgtccaagctgtggagactcttgtacttgatcccctcccaccaattctaaagtagctttctccagatcagactttaatttctctgcatcaggtgtatcgtattgagtggctgccctgcagaagatgtgatgaattatcctgtagtacaagattatcttattcccctgcccaggtgtgagcacgtgctctcgctccctttcaggtttactatgtttaaaactaaactgctgcaaaagttctcaatgttcttttccaacacatctatatatatatggacacacagtcacgcaagctagttcccatgactcctggatctatgtgtatgcagaaggctacatatacatagttgcttctttcctttccattgtagctctttgcctctcaattgtcattgatacatgcattgctcttattctgtctggcattacaattgcagttttgcctaatggcaaaaccagccatcccattggcaaaagagtcaacagtatctgtgtttgtactgtgcagttttcaggatgagatgacagatagcacgactacactgaggcaccctcagagaaggcagggcctgatttatctagctgtccagccgctgtggctggaggtaggctagttgggatgggcagctaagcagtcttctcttctgcctttatgagattgggtagaaagatggggcatattcatctacccccaaaagaacactataaaaacagctcctctatatttccacctctttctatttatgcaactcatcttcacagattgttctaaagtaaaatagatggtgtatgctgtatccacaaatcatctgtaacaattatgttttcagtgctgtgtcattccaaataaacctttggtaatcttcaacgattaccctaattccttttgatgagtctttttttttttttttttggaaattttgttccagtcggatactctgcttgaaacagttggtattggagttgttatttgtgcagaaatatgcttgttcttccactaggttgcactccacgcccccaccgcacctccccacttctttcattccagtcattgctggtcactcggtgttccctgacatccagcaattactgcagcaccaataacagctgccaacggagagcccttaaaggtgccggctgtagactcccagtccgtgaatcactgataatcttacgaccttcataatcagcaatttcttctcacaccagcttcattttctggtcactttcctttttggcatgtttatgttcgtaggtacataaaaattagatcagttggaatagaaaagtgaattcacttggccattatttccaaaagagaattcttaacgcaaatccttttagttgatttggactcttttctgctaatataattctttatacaacataggctgatcaagaatgtatattattagacttttagatttagtatgtattcctgattcatggtttgaatcttcctggtgtattactgactttgttgttttaagtgtgaatagggaaataactgtttttgagccaagatttttccaggggctaatatacagagaagctgggtcatcatgaatgctattctagtgcaagaaaagcaaatgtcactgcccaggagcatgactgataattcagcaagtggaatgcagcaatgtaagattcgtaatagaaagccactcctgacagtagagtacacacaggatgttaaaagccaagactgaaaaattcgctctaataataaaatgcacctaatgttctgcaaagataattggcttgccacatctcctggagcagaagatgtgatgaatcattcttaaattcctttcaccctcctgcccacagtggctgctcacagtgtacagtttgccaggacatggcccagataactgtagccctagatgaatgttcctagatgaatgtaacaagttcttctgaaatgacgtgattttaattagctatttagtcctgttttttaaaatgcctttggatttttttttacactaaataagagttatcagattttttgtttgtttgtttcaggaattgccaaaatccaagaattcctaatgcattgaaaatgaaggagatggaggggatgggcgtgtggtggtggcattccccagaaatgtccttgaatgtggagtgaacattgttttccatttcagtggattttctaaggaatgttagtttcaaggactttctgggattactagtgtaaagttctttccacttctctttctcagttattccgttcaagttctcacaccaccaacccatcctaggcacatcacccagtcatataatggcaagtttgtattgtatcccaaatggccttgaaccaggccttggtcctttcattttttttttttttaaacggagtcttgctctgttgcccaggctggagtgcagtggcgtgatctcggctcactgcaagctccgcctcccgggttcacaccattctcctgcctcagcctcccaagtagctgggagtacaggtgcccgccaccgcacccggctaattttttttgtattttttagtagagatggggtttcactgtgttagccaggatgatctcgatctcctgaccacatgatctgcccacctcagcctcccaaagtgctggaattacaggcgtgagccaccacgcccagtcaggccttggtcctttctgagcttcctctccatgatttaagattcttcttagaaacccaatgtcatgcagaccttcaaatagttatgagtcagaactgtttggaaagaaagccagtagttcttattaaacatacacctacctggcattcctaccaatatgacaaatagtcactcatgtaaacctgtgtgatgcatataattgcaaagtaaaattgcctgg

SEQ ID NO: 11974 - DNA, 19207 bp, Human
  misc_feature (1)...(19207): n = A,T,C or G
atttgttttatgctgcttaagaatttgttactggctatacattccagaaacatgtgaagagaggatttccctaaggaatatatcacttaccaatatttacagaaaaaatgaactgagacctaggaagatcgtgtggcttttctcccgctgtgactcctagacctggaccttcagctccatggttgccgacttcagtgctgagggctaaaatacatagatatctccaactccaacatacatatttggaaacttaggcaacagtgctttgtggaaaactgtgcaactgcttagaggagagagaattttttgtaataggctgaaaagaggctaactgtgtatttcttcaatgacaggcaattcttggtggcaaatgtgatacaggtgaagaagacagaaacatacaggctagtgcttctccagaaatacaattgaaatcaaaatcgcgtgaatattacctctggggccttttgtatatcttagaaactcattaagttctttggatagcatccatttaatttataagtatttactgagcacttagtatgtgcttagccactggggcacaacacagagtcaaagagacaaactcctggcacgcctcaagctcctatcctcctggggaaaacatactaagcaggataatgtataaataaaggagagaatttcaggtaaagatataatgaagcagggaaagggacagtgacaagagtgctatttttgaaaggtcaggaagctttttagggaaaagtgtcatctgatcagggacctggagtggggaagggagctacacagagctcttaggggagggcagcacaggaggtcagcgagaggcaggccctgggtggtagtaggaatttcttatgtttctgaaaaggcaaagaacatcttaaagaaagcgctcacaacgtttgggatgttacggatctgtgttgttgttttcatgtttatagactcagtgctgtaaatgtatctctgttgcttacatattttagaatgaatttcatttaggagtctaagtctactacgaaggcactgccttatctaaatgtctctaaacatacctcctgcctatcacaaagacatagaatctcactcacaagagtcaaagttgttcattccaccaggagagataaggctggaccaaaagcacccctgggtttaagtccacactccccaccaccccggcccccacccccaagcagtgacagactgtcttgaacttctcgctgcaagggtcataaaagggacagagaacagagcgacagaagatgtcttctgcattctcaacttttagccccagttgttagagaactggtatctcccctacacgtctggctctggtggagaaagaatgacagcccctacttacaacgaggagactgtggctcagagaagttagggggctgcccaggatcctggagaaagccagctttgactcataaccctcgcgccattacctgactcccattagtggagtcaggaactccatgttccacttcaggaaatgagcttgttgatttttcatttacacaaaaatgaaaaataaataccagatgtttgaaaacatgttgcaacacgtcctgctggaacttaaaagtgcattctgaccaaaaaaattaaattagaaaatccacatagcaaaaaaaaaaatgttttggatgaaaatatactttatctttctctcacacatactctctctctctctcgcacacatacccacacacacacacacacacacacacacacgcgcgaaaacaatatctcatttcttcttcagggagcagctgtgaaggaaatcgggggaggaggatggacacaacatcccatctttgtgtttcgatacagactaagcttttaggccaaccctcctgactggatgggggcggcgggcgtggcatgcatgaaaagtaaacatcagagacctgaagaagcttataaaatagcttgggagaggccagtcaccaagacaggcatctcaaatcggctgattctgcatctggaaactgccttcatcttgaaagaaaaggtatgtactgtagttttaagcttttcatttatgataataatgtctaaaatagaaacagtctagactctccattgccccatttcagctacatataactaccactgattgagagcttgtgccggtagctttagacttgttctcatttttcctcaaacaaatgtacaaggtaggtatcatcagagccatttttccagtgataaagctgaggttcagatacactagcaacatgcctaagataaaaccaaacccagtgtgaactcatcccagcgtcttttgcttacccctccaaactggacaacgaggtgtttccatgcacaaacaccgtcctaggtgaattctcagcaagctgtccaacggtgcatcgcagtaaaataatctggaaactggaattaatggtgtgaatagaaaatgcatttgacaatatggcataaaatattgtgtttgggagatacgtgtcttgttatatttaatggctaaatgagtctttgagacctaatgacttattggaacctattttattttatgaggtgaaatttcaaaatctagtccttcacgttctgcagatctttgaggtcaggggctgtgtccccaggcactaagagcgcgggcttgtgggagacctaggcttacattctagcctgtccccaggcctaggcttacactgtggcttcgtagtttaccaggaagtaacccgggcaaattcacctcgttggtatgaagagagtgtcagcagaggtcgcctccagaggaggtgctgtggagactgagcgcatagcacccttaaaatcctgggaccagggcttctccacgggtaagcttaatgcaagtggagcagtgatttccagctagtgccaggcccaaggtggatgcactgtcaccttagttggattgctttttaattacctcatattctgttaaaaatcatatttctttttttttttttttgagacggagtctcactctgtcacccaggctggagtgcagtggcgcgatctcggctcactacagcctccgcctcccaggttcaagccattcttgtgcctcagcctcccaagtagctgggattacaggactgcaccaccatgcccagctaatttttgtattttttgtttgtttgtttttgttttgtttttttgagatggagtttttgctctgttgcccaagctagagtgcaatggtgtgatcttggcttactgcaacctctgcctcccatgttcaagcaattatcctgcatcagcctcccgagtagctgtgattacaggtacttgccaccacacctggctaattttttgtatttttagtagagacggggtttcgccatgttggccaggctggtctcaaactcctaacctcaagtgatctgcccacctcggcctcccaaagtgttgggattacaggcattagccatcatgcccggccaaaaataatatttaaattatacttattttgtaaagtatttaaactcctcataagaacaatcttcctattgatatcagaagaagatgcaaaaatatatgtcgtatataatccatatgttacccaaagtcttaagtacacattaataacatgctcaataagtaatgagtaaattagaatgaaaggacattgaaaactataatggatgctgtccgccctttctctcacaaggagtttttttgttgttgttgtttgtttgcttgttttgagacggagttttgctcttgttgcccaggctggagtgcaatgatgcaatctcagctcaccacaacctccacctcccgggttcaagcaattctcctgcctcagcctcccgattacaggcatgcatgtaattacaggcagcatgggattacaggcatgcaccaccatgcccagctaatttttttatttttagtagagatagggtttctccatgttggtcaggctggtcttgaactcccaacctcaggtgctccacctgcctcggcctcccatgggattacaggcttgagccaccgcacctggcatcacaaggagttttaaccacaggaataaaactaatgtaaccaagaggcatctttggaagagggtcagtcaaaggggttgttctgaaatcctcctactgaggtaaagaatctgtttcagctcacaagagagcattttgtcagagtaagatgtagaactgacttttgttgcagtgtcatgtggtggtgagactcatcaggtcacagaggtggggggttattgaaaggccctatggcggtgcacagaagaagcagattcggggtgctgcagacaggagagggggagatggagctcgagtcccagctctctgccccttccaggccccagcttccccatctgtacaccttggaagtagagctagaaagatgacctctaaggtcctatccagtgtggggaccttgtggaatgtgcatagtgtgtggccagtctttgaggtttgatcctctgggccaggctttcagcttgggcctactaagtagaattcaagatctctttaaaatggatgcaaatttgtgtgggtttaggctgcatttctataaattcatcatcccccaaaaggttaaaagacaggttttgtttatacagtggtggagccgatgagaaacggaacctcagagaccagggaaagtggccctgtggcagacttgctcaaaggggcctcagcaaccatctccccctgcagcaaccccagctggcaagctgccactccttacataactgttctttggaaaaccaggcaacaaaacctccaggggaaaaaaagctattgattattaaagggtatttagaggtttagagactcacaataaagcagttataattattcctgtaatgacacatccttcgaaatgctcagatctgagaacattttgcttgcattgcatcagtcatcatcattacagggagaaatgcagagagctggaaatagctcgtgtgcaagctacaggcaaggagtcacaaggaaaggagcagattgacagcgagtcagtgaaggaaacaggggagcttccaatgcccagaacctgcacacagtcctgcagcctctgtctccctgccttgctgccccgcttcaaagccagcttctgctgccaaaggactcttggggttgaaatgcttgttgcacagttacacatcagctgacagtccttctctgatttaatgaacttcatctatgaaaaataccctcaacaggccgggtgcggtggctcaggcctgtaatcccagcactttgggaggccaaggcgggtggatcccctgaggtcaggagtttgagaccagcatggccaacatggtgaaaccctgtctctactaaaaataccaaaattagccgggagttgtggtggacacctgtaatcccagctactcaggagtctgaggcaggagaatcacttgaacccgggagacagaggttgcagtgagccgagattgtgccactgcactccagcctgggtgacagagtgagactccatctcaaaacaaaacaaaacaaaacaaaaaccctcaacagaatgtcaaaaaaaaaaaaaagaagaaagaaagaagaaaagaaaagaaagaagaaacctgggaaataccatcatctttctgcttttgataataacaataactagcatttattgagcatttactctgtatcagacactcctctaagtactctctgtatattatctcatttaattctcacaaaaattcatgagctaggaatgataattattcccatttactagacaaagaagctaaggcataaattggacacagttatacttagtatggggcagagtcacaatttgaacctggctggggtgaccctggagcccccagcaggccgctccctgttaaggtttccaagcgcactcttgggctggtagaacagccagcaagacgagggcagggggagggatggtgtcagagaggcatctccctgaagaatctcagaggacactaagtgttgggcaacatttggtttggtttcgtgtctttcgtggttcacttggaggctttaatcccccactttacatagccctctccacgctgtttctgttcatttgacaagtatctactgagccgacactttgaggtccgtgggtgattctgaggagaactagacacagtgcccatcctgggagatgcataattaggtgggacaggggtgaaaatcaatccaacaaaccagaataccaggcagagagcgccctcgtggaggtgcagaggctctgaggaaggcctcacagcaacaaggacaggcaggtgttcccctgcaggatgagggttcacatgggctggggagagaagaggagggaccgcccacagaggggaccatgggcacagcactcttacttcatgattgtgtggccttagaaggctcagaatgacaaccccagctgctttgcgttcccgcagctccaggtcccttctccagccacccagccccaagatggtgatgctgctgctgctgctttccgcactggctggcctcttcggtgcggcagagggacaagcatttcatcttgggaagtgccccaatcctccggtgcaggagaattttgacgtgaataaggtaaaaggcgaacctcccgtttgttttgctgcctccgctgtgaataagcgttctacaaggttcaatgtaattatgctgctttaatttccactgcacaccttgggacaagtatttatcttatttggggtttccccaaagcagacatctgctgagacaaagactgcaggcagagaggtttgggatgatcccgggacgcacgagagcaggtgggaaggtgagtcggagacagcacagaagcaataaagggtgcgttcctgagctgtcgccctgggccgtcagggtcagtcacactgggcaccctctgaggacacgtggagcatgcccctccgattgtcccacagctgctgccagcaggtcatgggagcatccgtggctctagctgagccccctggcagaggagagacacagggtctcaggtgggaggctggcagtgtctgggaattgcctaccgtggctgcggtgaactcagaggtgggctgaggggaacaggaccagggaaccatagtagctgctacagagctattatccttgttctacagatgcagcatcggaatctccctccccagctcacgcagctggtaaatgcaagtaggattcaaaaccaggcttctcagcagtgcagggcacccaaaggtcactcaaacagggctcaggaaagcccaaaattctccagggggctttcttggtatctgcaccaaaatgtcatcaatacaacgagctcctccatagatggtctttcttcctggggtttagcgggaggggaaggaagagggcggcagaaagaggcagctattggaggacaggactcacaggctcccactgttgctactcaagcctggaatctcacccttaagacttcctctccttaggagaaggtttggatctcttttaagaatggcaacagtaacatcgaagttgttatcatacactcgcacctcaaggtgaatgagtgttgggacctctgaggggacgctgggtgggagaaggagcaccatccatgggatcaggagatacaggtgtggtaggaagaggccatagagtacactaacgtctacactgacttgctccacttacaggctgatccctttattcaggtaactctgatagaccacagagaggctttaaagaaaacatccaaggaatctgagttatactttcgcttttggatacaaatcccaaagcactttggaaatgataactgatctgtatttatagaagtcctttgagaattaaagcaggatttaaaaaatagcagctttattgagatataatttgtatagcacgtaattcacttgtttaaagtagcttttcactttccattgttgttagtatcatcacagagttacgcaaccatcaccaccaccatcgatttagaacatttcactgttccgaaaaggaacctcatacccattcacagagtctccatctcccctccaacccttccagccccaggcaaccactaatctactttctgtctccgaatttgcctattctgcatatttgataaaaatgaaatcatactatatgtggtcttttgtgactggtttactgaacgttttcaaggttcatccacgttgtagcatgtatcaatactatatccccttttattgccaaataatattcttgtaggaaatcgttataggaaatcaattgactgtatatgtgagagtttatttttgcactctcagttctattgatctatatgtctatacttatgccagtaccacacagtgttgattactatagctttgtagtaatcaaagccttgaggtaagctttgaaataagaacacatgtgtcctccaactttgttcttctggttattccgtgtcccttacatttttatatgaattttaggatcagcgtgtcaatttctgcaaataatccaattggaatttgatacagattgcattaaatctgaagatcaatttggggagtactgccatcttaacaatattaagtcttctaacttgtcaacatagtgtatctttccattgaattaggtcatctttaatttctttcaacaatactttgtagttttcagagtataagttttatgtttctttggttaaatttattcccaaatattttattcttttgatgttattgtaaatggaattttcttctttttcttttcttttctttttttttttgagacggagtctcactttgtcacccagggtggagtgcagcatcaccatcttggctcactgcaacctccgcctcccgggttcaagcaattctcctgcctcagcctcccaagtagctgggactacaggtacacgccaccacacccagcaaagtttttttgtattttagtaaagacggggtttcaccatgttgcccaggctggtctcgaactcctgagctcaggcaatccatccgcctcggcctcccatagtgctaggattacaggtgtgagcaagccaccgtgcccggccttttaaatggaattttcttaatttcatctgcaaattgttcattgcaagtagagaaatatgtttatatatgtatatatttttgtgtgtgtgtgacagagtcttgctctgtcacccaggctggagtgtagtggcaccatctcagctcactgcaacctctgcctcccaggttcaagagattatcctgcctcagcctcccgagtagctggtattacagttgcgtgccaccatgcccggctaatttttaaattttttatagagatggggcctcgccatgttggctatgctggtcttgaactcctgacctcaagtgatccacccgcctcggcctcccaaagtcctgggattacaggcatgagccactgcgtctggctgagaaatatatttgatttttgaatattaatcttgtatcttgtaaccttgcttaactcattagatccaatagtttttggttttgtctctgttttagatttcttaggatattttatatgtcatctgcaaacagatagagttttacctcttcttttctaggattatttttcaatactgaccagagatctgaaaagattaagaagcctttgcaaaaataatatgagatcataaggaagctctgagtttcctcttttctgaaaaatcatgcttccttggtttttactatggggcactaaactcactttaacagaaatagaacagatttgaatgcaccatagaaaatggagcttcttccgaggaatgtctatgaaaccagttaacctctaaccttattctttggtactttaaatgaatgttaagttcagtggctttaattgnnnnnnnnnnnnnnnnnnnnaattgaagctgtgctttaataagtgagtagaactttatggtcatgaatgtggcatacatttgagcggaaagccgtggctgaagcaatactcacctgtgtgcagcatcctctcttttcaagttctgactctgaaggtgagcgcatctctttttgtttttaaatttctagaataggccaggcgcggtggctcacgcctgtaatcccagcactttgggaggccgaggcagggggatcactaggtcaggagattgagaccatcctggccaacatggtgaaaccccttctccagtaaaaatacaaaaattagccgggcatggtggcacgtgcctgtaatcccagctactcgggaggctgaagcaggagaatcacttgcacccgggaggcagaggttgcagtgagcccagattgcactactgcactccactctggtgacatagtgagactccatctcaaaaaaacaaaattctaattagtattttaactagataaatatatttacattgttcaaaatcctaaaggtgtaaaagaatacaccacataaagtttccctcccacctctgtacctcagtttccctccccagtagcaactagtaaaaaccatgtattatgtaattttacagataatatatacatatacaagcaaatacttaataactgtggtaagcagaagagtggcttccaaaggtgtccacgccctaaccttgtgaatgttactttgcatgggaaaagggcttttgcaaatgtgatcgaagttatgagccttgagatggccagattagccttgattatccaggggaactcaatctaatcacataaatccttaaaagcagagaatctttcccagctgtgataagagagagaggtttgatgatggcataagagtcagagagatgcaatgtgagaaggatctgacttccttttgctggctttgaaaatagaggaagcctcaagccaaggaatgtaggcggcctgtagaacttggaaaaggcaaggaaactgatcctcccctagagctcccagagggaaacacagccaacactttgagttcagcccagtgagacctgtcagacttctgacttacacaactgcaagataataaatctgtgctgtttgaagcttgtgctaatttattatagcagcaacagaaaaccaacgtaataaacattttctccatttttacacaaaaggtgccttaatagatacactattttgtacctgactcttttgtcattaaatattagaaatcactgcataccactcttttgaaagaggaagtaaaattccattgtctggatatgccatcgtttactcacccagccccctactaatgctcacataggctgtttcctatcttgtattattacaaacggtactgtaatgaataactttacacatacatcatttcttatatcaggaggatgcattcccagaagtgaaattgctgggccaaagagtataatatgtatttttagctttgctagatattgccaaactgccctccgcagaggttgtaaactggtatggtctccctgcaacgcgtgccaggcagcctaggagggcctggttccctcgaccttccccacacagtggcagcttcctttaaagctaactgtatacacctgaagtctggactgagcgcaggcccctagagaaagcatgatacagacctttcaaatccccaccacctctccaaagccttgatgactaaatccctcctcagggtcagatgaggaaagttccgtgcgctctggagtcctagctccccacagcgaacgcatctgactttgcacaggattcaaagatgacttgtagaattgtgcactgtttcagatgaaaggtatttcccatcatcccctttttttacagagtctagaatgtcacagcgattttggctgaagtgggccctgagaagagccctttactcagcattcaccccctgcccgcacatcccatcctagtcacagattctcattgcaatcaatctcttgcccagttgccactgggaacaatgaggcccattttgtctggcttccccaggacagggctctgcgtctgcacgacaatggggaagaagttgcaggtccccagagaaccacagggttttgctctgcttgttgtctctgcagtatctcggaagatggtacgaaattgagaagatcccaacaacctttgagaatggacgctgcatccaggccaactactcactaatggaaaacggaaagatcaaagtgttaaaccaggagttgaggtgagtggctgtgggcgtccggggccaggcctgcggagtgctgacgcagagtgactgggtgtccggcagcctgggtcagggaggatgggaaccttgctggatcgggactgcctgctcctagcaggaattgagaggaaagcgtttggcaggcaaggatggcaaggactaggatccacttatgcatttccatgaccacctgcggggcacaaactgacagggttcctgcactcactgcaaaatagatactctggtagcaaagaacatcaagaccatctcttctgacctccagtctgggagagaagccgcttcgacaccatctgctgacagaagcatccagctttgttcaaacacttccaggaactgggagctcatcgccttccaggacagttcatcccatctctgggcagcttaatctatcagaaagctccttttcttactaagcaagaatcacatacacaacattcacactctaggttatgtaaacaggatatcctttagaagtgtacatttctattactgagggcttctaacacaataattaatccaaaaagctacgctttggaaagcaactataaacttaaaaagagccccaggaagagctccttcctacccaccttccactcttgaaaatacaaatgcagtttttccatgaacatgttgtgacttcatggtcagagactggtgtcctgaaaaccgttctagagcaaaatgcaattgacggtgaaaagggcagaatctgctgggaggagactggtttgttgctaagttaacgtatgcagatagaaacagaccatcttccccagctgtctgagatccagatgagagaggagggcacggtctccagctttacatggtgataaacagagaaagtacttgggaacatcagagcacagttcccagaatccctggcctgttgctcattgtcctgtttctaggacatccgtcaccactaaccatagcattaacctactgactttcttttttttttttaattgtattttagtagagacggggtttcaccgtgttggccaggctggtcttgatctcctgaccttgtgatccgcccccccttggcctcccaaagtgctgggattacaggcgtgagccaccacgcccggccaacctactgactttctaacacatacgactgctctaatttcagttggcctccctgctctgccttgaggattgataaacagacatcctctcctctgttggcttcctaggaagagcaccctgatgccttagcaccctccctttggtgcctccatctccacacctttccccttctcccaagttcatggggccattgggagtcatctagaaagcaggctcattcaaagaggtgaaagtattgcatccaatctaagcccccagcttttaagacacaccactgcgttatatgccactaagaaaggaatgacactgctaattgtcaggtgacatcaattgtgagatatgcatttcttcacatttaatgtctctgaaatctgggcatacctgagaatcactgagataaagtaaatgtttcttcactgcctccttttacttggcctacattgaaatcccccacactcactcagaggcttgctgaactagagggagtctctggactcaggccccttgatgggacaggcgatgtcacatgatatcactgaggcccaaagaaggggaacgcttttatgtctccttgttttgaattattttcagtgatcaagtccatcctcatctgtacctttggcccttctcgttttaaaaagaagtgaatctgccaggcacggcggctcacgcctgtaatcccagcactttgggaggctgaggcaggtagattgcctgaggtcaggagtttgagaccagcctggctaacatggtgaaaccccgtctctactaaagatacaaaaaattagccaggcgtggtggtgcatgcctgtaatctcagctcctggggaggctgagggaggagaattgcttgaaccggggaggcagaggttgcagtaagccgagatcgcaccactgcactccagcctgggggacagagcaagactccatctccaaaaaaaaaaaaaagtgaatcttctttgtgtgttgggttgttttgtttgtttttccattctcttttctccctttctttggagcctgggagcaggaattggtctttcaggccatagaagatagtcagagatagtgttgaagtgcaagggcctaacatactgtcccatcctggagcttgtcaattgcggcttcttatcatcccgctgctctcttcccctgcttggcctcagagacagtcacaagggaaaggccaggccatggagctagggtctagcctgcctttgagagcctctcttaccagaaatcacggtgttggctgccacggtccttagtggcacaaatcttgcctttcgttgcttattggctttcaatgagttgtttttcttttctcttttcgttttttgtattttttctttttttaactcactgcagagctgatggaactgtgaatcaaatcgaaggtgaagccaccccagttaacctcacagagcctgccaagctggaagttaagttttcctggtgtaagtatccacttttcccaggaggattcagggacaggaaatatgcaaactgaaggctagcgccccggcttggagaattcctgagacacctgagtgtcatctataatcactcagcacataattatctgtcaaacacttactacatgtcacgcactagggttgccatgatgagccggacagagctggccttggtacttatggagctcacatcccagtgtggatactgacacgtgaccccgcaatttactataactagctagcgtttcaacaggtgaaacacaagtaggtgcacaccgggtgtgggctgcagaagacacaacccagtcttgtttcccaaaggaaactggggcccgaaacattagcagatattagcagaacaacctgcacggcgcagaaactaggaagcaagagatgacaagagtgacggcaagtttgaatcctgcttctgccactttccagtcacattgttggggatcctgtgagatacctaatgacaggcatttgcctctgggttctgagctaactgaggaagggacacaggcaatagagaaagcaccaaatattagttttatttccgacgaagatacactagagagttcaacccagaactgtgaggctttctaacacgaagagtgcttgaaagcccctttcccacctgcagggtagacactgaagtcatcagctacaaaagttactccctgcacttcctacttctcacctctgccactcctccaccccacaccagtcaagtgcctagagcggggaggagaggaagttctaattttatagaccaagaaaggaatgctgggaggagaaaacagttcttctcacactatgaatatggacaactaacttcacatgtacaagccagaaataactgcccagtgtcgtgaaaataaaccagatacacacgctctgtaaactgtaaagggctttatacacagtttctcttgttatttttatcaagaagggagctaaagtgcaggtgggctgagtgacgcaggccatcactgaactcattagaagtagagttgggacctaaacctaggtctccaaactctcaactgagtatttttcccatagggatcagggacggggattggagtgaaagctaactattacatgcataacaaggattagatgtttgcgttaggccttgtaggattatgggagattatggaaaaggatttccaagtgaagggaactggaacatagaagaaggcctgaatacaggcatatcacgaagtcaggagttcaagaccagcctggccgacatggtgaaaccctgtctctactaaagatacaaaaaattagctgggcatggtggcgtgtgcctgtaatcccagctactcaggatgctgaggcaggagaatcgcttgaacccaggaggtggaggttgcagtgagctgagatcgcgccattgcactccagcctgggcgacaagagtgaaactccatctcaaaaaaaaaaaaaaaaaaaaaaaaaaaaacgaagaagaagaaggcctgaataaagaggcctagagcctgggagtgtacatgaagaggggcatgaggttaggaagggccttgaatgccacattaaaaggcttgaagtttcttccataaacaataggagactgtcaaagttttcaaataaggagagacatgtgaagttttctgtattgtatctgggtaaatttattcttcggaactggaccacgagaggaaggcagaatgtgccagcctgggtgagtgcaggtgggccatgatgccgctgctggcagaggtgggagacagatttttgcaaaatcactctgggcttaagagttctcagtccacctgggaatacacagagcagctgaaatgtgcagatgggtgatgactataacgctgtctctctctctctctctgtctctctctctgggtgagtgaggcaggcaggcaggcagggcaccaacagtgctagaaagggtaagtcagaaacactcagtctaggctttcgtccaaacttctttccagggtctttctgtttctggattgataaacaaaatcagaggtggggggcttggtgggtggttgtctgggccagccttcttgtgttgtcctgagatttctcttgccctctccctccaataatgctgcctctctctggttctcagttatgccatcggcaccgtactggatcctggccaccgactatgagaactatgccctcgtgtattcctgtacctgcatcatccaactttttcacgtggattttgcttggatcttggcaagaaaccctaatctccctccagaaacagtggactctctaaaaaatatcctgacttctaataacattgatgtcaagaaaatgacggtcacagaccaggtgaactgccccaagctctcgtaaccaggttctacagggaggctgcacccactccatgttacttctgcttcgctttcccctaccccacccccccccataaagacaaaccaatcaaccacgacaaaggaagttgacctaaacatgtaaccatgccctaccctgttaccttgctagctgcaaaataaacttgttgctgacctgctgtgctcgcagtagattccaagttggattaattattgtgggtttttcattataagcttatgcttagaaatccttaaacaggctggtcgtggtgcctcatgcctgtaatcccagcactttgggaggctgaggcaggaggatcacctgaggccgggagttcaagaccagtctgggcaacatagcaagacctcatctctacaaaaatgtttttaaaattagctgggtatggtggtgcacacccgtgctagctactcaggaggtggtggcaggaggatgacttgagcccaagaattcgagggtacagtgagctatgatggcaccactgcactccagcctgggcaacagagcaagaccctgcctctaaaaagaaaaacagaaaaaaaaatccttaagcagttatgttgaaaaaaaccaagcactgaattgtcctcgtttaaaggtaacaatcctgtttctggagtgggggaagctgatggcaaaggcgtattctgggtgacctgaatccagatgcccccgttctggagtagatgctgctttcagggtgaattacttgggcgttcggagtccctgtggggcagtttctttgaagtgtttactttctcctcgggtcttcagagccaggctgaagaatgaacccatctaggggtttatgtaaggaagaggagaatctatgaggaagaacatagggagtttcttttaaggaaaaaaatacatatatatatgttgtctttcattcaactgatatttacggaagcccaatcgcattccaggcattgaaaaatacagaatccctgtcctcccacagaagctcacagtctagtgagggagaaacaaataaagatgcagttataatccaaggtgaagaatgcaaaggcagaggcacacagagggtgccagggagctccaggaaagtcccaacccctgccagacacaggtgggcagtagggttgtgcagctacacctatgagcactccaatttcccaggaccaacaggtctcaagaacgtctttgtggccgggcgcggtggctcatgcctgtaataccagcactttgggaggccaaggcgggtggatcacctgaggtcaggagttcaagaccagcctgcccaacatggtgaaaccctgtctcaactaaaaatacaaaacttagccaggtgtggtggcgggcgcctttagtcccagctactcagaaggccgaggcaggagaatcgcttgaacccgggaggcggaggttgcagtgagccgagattgcgccactgcactccagcatggatgacagagcgagactccatttcaaaaacaaaaaaaacctccttgagtttgttttttaacattgtgacttgtaaaaccagaaagacctcagaatgatcgccctgtaatttaacttagctcacataactgacaatttactaatgttttgggaaatgaatagaaaattcagccatttcattagatttttgctttcttagcatgaatatgaaatgttcattttctggagcactcgagtctctttgatgctttaatgattacaaaaatcccaaggattttaatatatacaattttcatttaactaaataaatacgacctcagaatatagcttccaattctaaatcccaaaaggctgaaagccgttagcaaaaaggcagtgaggaggaggtgggcatggagggaggagggcctctcctgggctctgcctgcggccacaccctacactctgacacactggccccaccgccccccgccagagggcatttggctcctctgctgaaagacagttattcctgagtgttgctctggggagctggcttttatctcaggctacaaaataagttgtgatttcgttcctcttcatagctgtctagtaacatctaaaacaatgaatgtcactatattttgcaacatttttcatgtcttgaccaacacataggttcattttttttttatgtgaatgaattactgaataggtagatagacaaatggactggagtttttggtaaggaag

SEQ ID NO: 11975 - DNA, 5931 bp, Human
ttaatactgaattacacaataaataaaataatccacgcctgtaaatcccaacactttgggaggtcgaggcgggcggatcacctgagatcgggagttcgagaccagcctgaccaacatggagaaatcctgtctgtactaaaagtacaaaattagccgggcgtggtggcacatgcctataatcccagctactcgggaggctgaggcaggagaattgcttgaacctgggaggtggaggttgcagtgagccgagatcgcaccattggacaccagcctgggtaacaagagcaaaactctgtctcaaaaataaataaataaataaataaataaataaatagataaagttacaatttacaatttcattcttctttgattggccctcttctctcccccacctaattgctgttgtccttttggtcacactgccctttgtgacatctccttcctttcagggctgcccagactgtagcaggctgcagtggctggggagaccctactcattcctgtgcccctcctaaccagtcctagatagggctaaagaacgtctataaaccttttcagaagcttccagttgacacattctctctcttctctgaaatcctacaagtgctatctcatgatttacaaagacccaatacatgtgctgtctcattctgtcattgccagtcttaagtcttaagccctttgaggcctgattctacagctgagacatcctctatttctccaccatctctctgtctcattcagagcacacagtatgaatgaggtcaataaacacagtgttttttgttttgttttgttttgtttttgttttttttgagacagagtcttgctctgttgcccaggctggagtgcaatggtgtgatctcagctcactgcaacctccgcctcccgggttcaagtgattctcctgcctcagcctcccgaatagttgcaattacaggcgcccgccaccacacccagctaatttttgtatttttagtagagacggggtttcaccatgttggccaggctggtctcgaactcctgacctcaggtgcttcgcccacatcggcctcccaaaatgctggtattacaggcgtgagctaccgtgcccagcccaataaacacactggttttttttttttgtttgctttgttttgagacagagtcttgctctgtcgcccaggctggaatgcagtggcgctatctcagcttactgcaacctccgcctcccgggttcaagcgattctcctgcctcagcctcccgagtagctgggattacaggcacccgccaccacgcccggctaatttttgtctttttattactgatggggtttcaccctgttgtccaggctggtggaactcctgagcttaagtgatgtgcctgcctcagcctcccaaagtgctgagtttacaggtatgatccactgcgcctaaacatactgttgagtgtaacctcaaataggtcatttaacccttcagggctttgtgtatctgtaaaaggcagacaacagtccctaacaggctattgcagataatgggcttagcactatgaagcagctgttttatggggctccaggttcaccttaggtttgacaattgaattatgaaagataaaggagaaagacttgtcagcctctccgagtagatcctttggccgaaggagtgtccatgtggggtggtatctcggcctggtggagggggatgcgatggtagtgagaatattagggtattcatatctttcctcccgagtcaaacgttgccaggcacgttcctttcgcccctcccaccctccattctgcattaattccaagtttaattccaaatattagagtgtggtagaaaaggtcaaatagagcagccacggattaagcaaacgcccctccgcgtatggtgggggctgcagcgcccgtagctccacgctccgccccgccgccgctgattgtcccgcgccttgtgacgtcacacgcgggtttttaaggccgaaccctaggcaggctctgcagaggcagcggttggaggcgcggtgggtgtctgcgggggtctcgcggggcggctgcggtgtttcaccgggaaaggctcgaggagagcgcggctcacgagaggtaaacggaccctgcagaccgtgctgaggcggtcccggtgccgggccgctggagctggggtcggccatcggaggagggcgggcgggcaggagagtgtcgcggggcggtggggcgagggtcgcggagtaaggaagggcaccgtgtcaacggcttggggctgcggagggcgggtgggagccggactcaatctccggtctcagcgtctgcaccctagctcttagtttgggggcactgtcgacttcccccgtccctcggggatcttgcctgggggatggcgccataagctctgagaagaggctctagaagcccactgtccatggatcgagccctcaccccccacttgagtggcccaggacctgggagtctctctaggtcccatcgcccccctcacgacccccccagggagtgggggaacacctctgttatgccttaaaaaaaaaaaaaaaaaggaaaggaattttaaaaatgaaggatgggagggtgatttaggaagggatcaagaagttgcaaatcttgtgtgtattattaaacgtctcctttttctcccatgaccttttcttggttcagataacccagctgtgctccctggaaccttcaatttcaaggcctccctgcctctactaggcgccttagctcactatggggaaccacttgactgagatggcgcccactgcctcctccttcttgccccacttccaagccctgcatgtcgtggtcattgggctggactctgctggaaagacctccctcctttaccgcctcaagttcaaggagtttgtccagagtgtccccaccaaaggcttcaacaccgagaagatccgggtgcccctcgggggatcgcgtggcatcaccttccaagtgtgggacgtcggggggcaggagaagctgcgaccactgtggcgctcttatacccgccggacagacggtctagtgtttgtggtggacgctgcggaggctgagcggctggaggaagccaaggtggagttgcaccgaatcagccgggcctcggacaaccagggcgtgccagtgctggtgctggccaacaagcaggaccagcccggggcactgagcgctgctgaggtggagaagaggctggcagtccgagagctagcagccgccactctcactcatgtgcaaggctgcagcgctgtggacggtctgggcctgcagcagggccttgagcgcctctatgagatgatcctcaagaggaagaaggcagctcggggtggcaagaagagacggtgacccaagccccccctccctttcctcccacctagtaggggtctgcacacttggacagcagggtgggaccagcctgtgacctctcagtcagactggggtgcaggacctgtccacctcaatgaaggagagaggagcatggggtgtcccgttttggtgccacactggggtggggatgggagatgggatgtctttgcatatctctctcatcctctctggagaagtgggcgctgcaggactgtggagacgtaaatgtaaactgtgactctacctcgaccctgtttcttatttttcttctctggctaaaaatttttaattggatgtgtttgggggcggggggatggaagtgacttggagaatgtgtttgggatgaaataactatctccccttcctctgtcccccaactggggagtctccccaggctgcttttctaggaataccagtcacatagtttttatttttgtgtctgtgaaagtgccaagaacccctccccacatttgtagatccatgaccctttttataagctgtgtgtgtcctctgtattattgttattaactattttttagcatttgcctgtaagttattaaagactgataactgtagctcttaccttggtctggggcattttcctctccttatcttgccccagagacaattcaagatttctatatggggttgtggcgcagggggagggagatttatcttgaagctgaatttgcaaagcaagcacttataaaaattagattgtgtgttacgggatggcttgtgaaaattataggggggagtggaaaacccctcaagctattgcctgatctctgtagttttttgggtggggtcacttcctttttctctgatttaacacccctcccctcatcctctgggtcttacttgtcccttatatcaactgctccttgcagatttaacttcaaattttgctagtctgagctactcctaggttcttgaccttggtgacacctaagtctatataggtaagtcctcaaagagccattctgttcccatcctccccacttccccagtcttaggttggtttgatttttttcctccttgtaagatgtggtgagagtggaaagtaattcctccctggccttaagtcacctctgtgtactcaatcctgctgactggctcactggcatgatggcagcggctggtgctagggaggcctgggctggattgagccagcctggccctggtgactaagccatgagttttccagctctgggaatggtagctcttctcacgagaggggcagaagtagtagctgtttgtgcttggtggcagagaggactgctggacatacaccctccagactccaagatagaagggggaagacataagcccccagtatttgtggtgattgtaagaataaaatgctaatattacaagggcttgagtgcccctactcaccagcaccagggccagctatgtctgataacagaacccttagatcctcttaatcttctgggtgggagcagtgagtaagaactaagcacaaggccgggcacagtggctcacgcctgtaatcccagcactttgggaggctgaggcaggaggatggcttgggcccaggagttcaagaccagcctgggcaacatagggagaccatgtctctaaaaaagaaaaaaaaacaagcacaattctttccagttgtcgagccctccagccaccccctgccaccttttgtgcaaacacacaatccccagagcaggttcagcgttcacaccctgcttctccccaattctgtctcctcttctccggaatcagatgaaaggacctggggagaaagagaaggtgccggcaacccccacttctggggaaggtttcctaaagaacttgcttcttcctacccagcgctgccagaagctcagatttggtcccctccccatccctgtagctggcaggattggggtgagtgtgcattgatccggaagggtgcccaagtgtgcgtcagtgctagggcctgcttgacagaactgctgggctggttctgctgggaacatgtgctacctgcccctcccccagacacacctgcgactcctctcccagtctttttggggcacagtcctatagcccaaggacaggttgaggccccagtccaggctggaaaggaactggccagaactgaccctctgtcctgccaggagatctttcctccccaccccaccccacccaaattctgctcttttgtcttaaaatcttcaattatacattttcatttcttgtcacttggtgtacttaggtctccagatttgggggaagaggtgcagaggtgttccccaatccctagcagaggggcctccaagatgtcagctcctgattctggctcttccaaccacactccttccctacctgcttaaaacaggtatcttctgcttccccatgcccagccctgggggcggtcagggatcatggtccacaggaggcctttgaatgtcccaggctcttccccagtccctctggcctgactgtccagctggtggcactaaaggaagatgggggcttgtgtcagagagagacggagaagccaactgctctgccagagtagtggggagaggggaacactggggaattctgagtagaaagccacaaa

SEQ ID NO: 11976 - DNA, 22874 bp, Human
cggccgcgccccggcaccggtggaagggaggtgtcccaggctcccacggcgcccacggcgccctccttccgccccggccaggcccatgggacccggcccgccctctgccgtccgtccccggcgggcccgatgcctgtcggccgctgagcctccgtccccatgcgggcaggtccgcgccttctgcgggctgcctggcttttggatgctttgaaggggaacaatggagcgaaggatagacggagcagcagggggcagttgcgttcagggccttaaatgccaaacaagtgccctaaaagccagggcccaacactcaggccctaaagtacgggctgaatggggcatcctaggaatagctctggagtgaaaaaaggagtgaagagagcgtttgaaggcaccggctgaggcctttcctgcctgcctgagccctgtggctggctctgctgggtggagggacctttggggaccagtcagggctcggatggaggggcaagatgtgttggggccagctagtgagaggcggggctccctggttccccttggcctgaggcagcggtgggacgtgtgagtctcccgaccaggagcaggttggagtgtgggtgcggctgtacgcgctgtgggcaggggcgcaggctctctagtctcgctggaggactcgaacatcggtacttccgagaccagctgctggaagtccaggtcctgggtctggctagctcccaggccttgaagccccaggtcctgcagacacacacgacgacgtgttcgagaagggccttggtactgggagaagggggcggggagctgagggagtgtttttttccttctgggcaagagaattaattgctcacagttgaaaggcaggaagtacccgcacagcctcccctccccagatctgcaggtcaaggtcatgtgtgcccgcatttgcacagagcctgactctgacatccgtgcacacacacgcctagtacccctgcactagtgcccccacgcccgccttcggaacacacgcctggtgcccaagtgccttgcctctctccccacatctataccccagggatttccctcccaccaaattgaagccagttgtctgcttggcttgtcaaccgcctcccgcctcccgccttcccgatttcccggagaaaagctgctgccctgtggtagagggtggaggaaagccccaccacccctggatgaggggggccccaagacttgcccccagggtagctaagacctcactccgagggggctgcccccctcaggcctatgacgggcaggtgcagctgcaggggaagggaggcagagcagtctcttccggcagcaggaagtggtaaccgcctatggggaaattgtggggctgagcagaaggggaaccggagctgaactctcctcccctaccaagggggcctggagggaacggcagccagctgctgaggttctgctctctggtgctgaccttccttccccctcccctctgaacttcccaccccagctctcaaggctccctggggctccctgggcctctctgggggctgacttgggaagggaggaccccatcggatgtctgggggaaggaggcaacccagggggagtccagagcctggggcagcaatggtgttcatggccactggtacagtgggccagcggccccgctgtgaatggtacagtctggcagtggtgaccagggacagccttctggaggtggtgggatggcagcctgggatgccagcttacgttggggctctcacacctgctccggctgcttggcagcggggctttgggcacaaggcagcctaggtgcaggcccaatgggaggggacggcaaggccggggcacagtggggctggaaggggcgccctgcccccccaggagcccctcgcgggcagtgccagccctgggccgccccgccccaccgggagccgcgctgggggcggggctgggcggagcccgcgcagggtgctggccgcagcgcccccaagtcccggcgccgggcccgctcacggccgcgtgggagcagtggggttcgacggcgcggccgcgaggccgccatggccgctcacgggaagctgcggcgggagcgggggctgcaggctgagtatgagacgcaagtcaaaggtgagagggcgccgggcgctcccggcccgtttcctgcggagaacccaaggtcgtgagggagctccaagcgtccccgcgctggcccagggcccgatgctctccccagcgacctctggagcgggggtggaggagggagcctgagccccttgcctgcctcccgacgcccatttggcctcaaccgcctgccattttcccttccttctttcctgtcttccttcctttggtctctgtcctccttgggtctaccgcttctcacccaaggttcagtggagacactggtggccgctggtaaaagagagccagatgcaccaacgtgcccctcagaaggcagtattttagctacagtgaagtcaaccagcttgattgggctggggggtgagtaagggagtccgggtgagtggattggtggagatcacctggccgtaaccccactgcagtccctggagcttcagcaccttttgcctccctttagcactgagggggagcagaggcgagggccactgtctctgggtcaagctggcgcagtgagtcttggttgagagatttaacagggctggcttctcagccttctgaaattgaacctctgggttctgataaacacccatgtgcaaatcacatgcaaatcagctttgcaaattcttagccaatagcttgtgcccatcttattcagggcatggtaactcttgcaaaggaaagaggcagcagctcagtgccagcagctcgtccatatcactctcaatcactccattttaccaattacggaaacaagctcagagaggtgcagtgacttgcccgtggtcatacagcactgcaacttctaggacgtagaatgcaatgacccttgaagtgcctttgaacccagagatgtaggttctaacatcattattcagtgcaagcaatttataccaaagtatgctccagtcctcctttggaaaaggcagcctgtgtccagagccagcttgaggtgactacacagggtgagccagctttccaagcctcgccatcatcttgctcagatggaggtaatgatctccatcctgcttccccaaaatgccatgaagctgaaagacttggaaaacttcagtcagcaaatatgggtcagtgatttcacactgaaaagttggggtttcgagcacgactgtctaagggttcctcacttgctctgggtctgcatcccacaccctggaaaagcttcctaccattctacaaagtggggtcactgtcttgacaccctaaattctcaaaggtcagcatagcggtggttttggagaccatcttttcttctgttttgcttgtcagcagaagtgagaccaaatgccttgctcacaggaagtgctggtggggcccggggcccagctctgtaattcaggcagacatggattccagctctccttttgccagatgtttcctatacatctgtgctgtcccaggccctgggagtatactgctgtaccagagagaaccccgactccagcccctccagccctggctttttacccagagtaaaagcaatgattcaatgaggactcccctgatttcaaatggcgtcagtggccaccccgccctcacatggctcacgggtctagtgggggagacatagactttgcattatgataataagcactacaaagggaaggaaagtgcacggtgccaagaaggggtcggaagagggccagccctagtttagggggaggtcaggacagggtgtgctgacgagtttgtctgaactgagatccgaaagctctgccaggaaagccaccaatgcaatcgacttgcaattcacaagttgcctgctcaacaccagccggtgtgcatgcccggatctggactaggacatggcttccagtcagcttttgctgccggcagtgatgaagaaaggcagcggttccctctgctggttccttctgcactgttcagttgtcataagtccccagggattgtattcctctgggggaagcagggcagggcaggctccagagggccagtgaggcgagcagttgtctaacacctttcttggaatgaaatgaaatttacttttatcaaaaaatgttaaactgggccaggcgtggtggctcacgtctgtaatcccagcactttgggaggccgaggcgggcggatcacctgaggtcaggagttcaagacccagtctggccaacatgatgaaaccctgtctctactaaaaatacaaaaattagctgggtgtggtggtgcgcccctgtagtcccagctactcgggaggctgaggcgggagaatcgcttgaacccgggaggcggaggttgcagtgagccgagatcgcaccactgtactccagcctgggcaacatcctccgtctcaaaacaaaaaatcaaaacaaaacgttaaactgattcagtgaggactctcctgatttcaaatggcattagcgcccaccccacctggccttggagctgacgagttaaccacaggaggccagcctcggataggatgaagacactctccatctgtctcacttggcatcgtgggctctgccctgctctgtcgggaggtcccgtgccccaggcttccacttacccagcttgatctgccggtgggaagagctctcctgttcagtaattcaattggaagggtcaggctcctgggtccctcacctggctagtctggtgggggcagggagtggagggacagagggatgggtgacgcatgcagccagggctggggcacctggagtcaagggggctgagactaggaaggggacattctccaataggagatcaggggaggaggtagggatgctgggcaggcggaacccacagggtccccatgcaacagcccctgggaagtcactggcgggacagaaatccaatgggattgagctcttctcagcggagtcctccctcgctgctgctggtctgaatcctgccgtcttttgcctggactagcacagtagctgccacctgggctccacctggcagtgtgagggggccctgaaaacgaagctggaccacatcaccccactactgtggctcctctctcactcggagtccagctgggagctctgcccagaccccgggctctgtgccatctgtccctaccggtctctcggactccccctactgcccacgtacagccagctccagccttctgctccaacgatgcggcttgttcttgaccaccctcctttaaaaagaggtcctccctgtccccacccacccctggctctgatcttgctttgtgggttcatcttctccgcacccatcactcctgggcattctgatatgtgttcgtgccccattccaatcccagctccaagagggcagacacttggtcaaacctctttgcctttgtatttaaaacgtgcctgccacagaatgggtgcataatcaacattctgctgaatgaagacatcaattcatgtccctccctggggatgtggatggagatgagtaggtgggcagcctgctggccagaagctgagctagcatcttatttactcgggacgggcactcaggagatggcaaaagtgtcttccgcaggttgcttaaacttgctggacaggcacttctttgcttcaggcctgtgtgggggaagcagcgttgccaaatcaagccagtgatagggtgtcaaaaggccggcagtatggggccctgggtgtgactctctctgcagggtgggggaatgcacaggtggggcggggggtgattgggagtgggaagtggggtcagaagacgggggctagctccctgccccattctttcacttacaaggccggatcagctctccctggctcccagccctcactgtggactgtcctttcccctggggcctgagggcaggcttccccagccactgagactgcgagatcgctgcaggcttgccctgagcagcactgtgatctgtgtgttgtgtatccgtgtgtttgcaagggaggctgccacctcccggagcctgggtaccggcgggaaaggaagtcgcaggggaaaccattcagaggctttccaggaacgagggagagacaggaagccaaactgaaaggtgcctggctggcgctggggcggctctcccctctctctgggacacccttccccttccccctcaaccgggtggctctggccatctgttggcctcagcgcagaggtcggctggacagctgaggccagatctgcctgcaggggcctagcttctttcctcccctcttagctcttgccctcagcctaggctgggtccgaaggagccctcagagccgacgggactggggtctgtgtgcctctgcctctcccatcccacgctggcctggctgacccaggcagggcgtgctgaccaggcctgagccatggttccccccacagagatgcgctggcagctgagcgagcagctgcgctgcctggagctgcagggcgagctgcggcgggagttgctgcaggagctggcagagttcatgcggcgccgcgctgaggtggagctggaatactcccggggcctggaaaagctggccgagcgcttctccagccgtggaggccgcctggggagcagccgggagcaccaaagcttccggtaggtgatgtgctggcaggggggccacggcagggcccaagctccgctcccaggtctcagtgcccctctacccccaggaaggagccgtccctcctgtcgcccttgcactgctgggcggtgctgctgcagcacacgcggcagcagagccgggagagcgcggccctgagtgaggtgctggccgggcccctggcccagcgcctgagtcacattgcagaggacgtggggcgcctggtcaagaaggtgaggctctcatcctgggccacgggaagtgttcgaggctttgggatcaggaggcactgtggctgggagggcactggaggccaggtggggagcaggcagagcgaacctgtgtgcccccccgatggggcttgatctgggcagagcttccagtgcctggcggggccgctctgggcagtgccgtgctcacccttgcctctgcctctagagcagggatctggagcagcagctgcaggatgagctcctggaggtggtctcagagctccagacggtgaggaaagggctggggaggggcctgccccaatggtccagggagaaatgccactcacagtgggggaggaacaccgccagaccatcacatcaccccaagccaggctcagggagaagcacgcacctaggggcaaaggccctctctccctaggcacagggcgttaggctaagtgctcacatgggatcgcccagctctgaggtccaagttccagaggggcaggggtagagggctgggggctggcccagccgtggccttcaccagcaccaccttgctttgggtctccctgcaggccaagaagacgtaccaggcatatcacatggagagcgtgaatgccgaggccaagctccgggaggccgagcggcaggaggagaagcgggcaggccggagtgtccccaccaccaccgctggtgccactgaggcagggcccctccgcaagagctccctcaagaagggagggaggctggtggagaaggtgggcctggagggcacctcagacgcaggcctatgggccatgggccctaactaggacctgctgtgctgagggggaagtcagggctgggtgcaggggagggcaggagtggcaggacagtgccatcaggttccagggattccatacggaaggctcccagggcctgagagagtggggaaaacagttgcctggccctggacagccccatgcagcctctccatgctcccagcggggcccctgcagctctgctgttctgccagccattccgtaaggtttcagaggggggcaagaagacacttagggtgggtgatggggtgacacgcacggagaaagggccttcgaggtgagcccagtacagagagtggggaggctgggaaatgcctggatggagccgccaggctgtgcgtggctgacagtcatggtctctgggactctgggagcagaggagggagtcgagcatctcaggtgttcttaggggaaatgacagagtttggctgtgttgggggaaggtctccctggctgctgtggttagcgtgccagctttagccaggtgcggtgactcacgcctgtaatcctagcattttgggaggctgaggtgggtggatcacgaagtcaggagttcaagatcagtgtggccaacatggtgaaaccccatctctactaaaaatacaaaaattagccgggcatgatggcgggtgcctgtcatcccagctacttgggaggctgaggcgggagaatcacttgaacacagcaggcggaggttgcagtgatctaagattgcaccactgtactccagcctgggcgacagagcgagactctgtctcaaaaaaaaaaaataaaaaaaaaatagagtgccagttttagaacccaggtgccagcaggttctgtttcatggctcttgatgatctatccctaccctttggggtactcgttccccctcagctctggcccccgcagaggcctgtggccgcttccagctgtgcacctgtgtgctggctccaagctgggtttctcgtgcaccctccatggtggggtgccatgtgcgcaccttccactcatcaggtatctgtgaatagttctgtgtcatcccccacttctgtggggaatgttgtggctcgaaccaaggcaagtggcgggtgaacagccggggaatcaagtcacctcctggcactgggctgagcacactgtggactgtggcgtggggaaggcagcaggacttctgggcttgaccagttcaggtgtagttgtccacagtgggaggggaggcgatgggcattacatgaaaggctagagataggggctggccacgtgcgtgaccctggcacgcttgcattgtcttgagtagcggcaggccaagttcatggagcacaaactcaagtgcacaaaggcgcgcaacgagtacctgcttagcctggctagtgtcaacgctgctgtcagtaactactacctgcatgacgtcttggacctcatggacgtgagtccttggtgggcaggtgggaaaaggtgcctggtgcctcggggctgggaagctgtggctccaggacctacccaagcatctccttgtttcctcctcagtgctgtgacacagggttccacctggccctggggcaggtgctccggagctacacggccgctgagagccgcacccaagcctcccaagtgcagggcctgggcagcctggaagaagctgtggaggccctggatcctccaggggacaaagccaaggttctcgaggtgcatgctaccgtcttctgtcccccgctgcgctttgactaccacccccatgatggggatgaggtgagggtcaccccctgctgggcttggcattctctggccttcactgtaatggtgggcagtggagtggcatgacccacactttgctcaggaatccaagttctccatggtctcaggcagtgcggcagctagagaagtgtcccacttccatttgcagcctcactccaagggtgcacccccgcaatggccaaggagggcaagacactaactgttcaaaccgtgcagcaggcagccgtgtagctgcccatacattgttctaggctggtttctctgtgtttttaaatttcgtgacacaaacttggcagtaagatggaatggggcttctttatccttctccgtcgagctagtttttcctgcagcagtttatcctgatgggcattgtcaatgatctgggattacattgggcccctttcgggccgacttggaactttacgaagagtccggcatcaccagggcttccgatggcgtcacagctgctccctaacccacccctcccgttcccagctcccacccccagaaacagccacccacctcccggtgtcaagcagccattttccattggccaatgatgacccagtgccaccagcatctctcacagccaccacacgcttccctgcatcttgttctcccagtgggcttatcccagaatttttggctaaattaacattcaatgtttaaatcaccatgacaacaggtactgttggcagctgagccatgtactgtattaggatcacatgtccttccttggacaatttttccttttcttctggaatttataactctcttgcctcaggaatgctgcttgctagaacatgcccattgctaggagttgatcgctacctcgtcccagcactgtcctccacaccaggcacctgtgaggtcaaccttctcctctgcgccctcccccagagccttccagtctggagtgcttcacttctgcccagtgctctgtttccggattccacggcagcagctttcttagtttgatacccttattttggtgacaccttcaccaagggtttcctgactttgcacatctgaaaatgtctgtattctttgttttgttttgttgtgttttgtttttgaaacagggtctcactctgtcccctcggctggagtgcaggggtgtgatgtgatctcagctcactgcagatgcaaccttctggtcctcccatctcagcttcccaagtagctgggactacaggcctgcactacaacgccaggctaatttttctatattttgtagcaagggagtttcaccatgttgcccaggctggtctcaaactcctgggctcaagcaattggcctgcctcggcctcccaaagtgctgggattacaggtgtgccactgtgcccggccaaccctttattcttatttcatgaatacagtacttcttgaatctttctgaagcttttattttttttgagatggagtttcccccttgtcgcccaggctggagtgcagtggcacgatcttgacccactgcaaacttcgcctcctgggttcaagtgattctcctgcctcagcctcccgagtagctggaattacaggcacttgccaccacacctggctaattttttaattttttaaatttaatttattttatttatttattttttgagacagactctttctctgtcgcccaggctagagtgcagtggcgcaatgtcggctcactgcaacctctgcctcccaggttcaagcaattctcctgcctcagcctcctgagtagctgggactacaggtgcccgccaccacgcctggctgatttttgtattttaagtagagacagggtttcaccatattgtccaggctggtcttgaactcctgacctcaggtgatccgcctgcctcggcctcccaaagtgctgggattacaggtgtgggccaccgtgcccgacccttttatttttattttttagtagagacagggtttcaccatgttggccaggcttgtctcgaactcctgacttcaggtgatctgcttgcctcagcctcccaaagtgctgggattacaggcgtgagccaccatgcccggcctgaaatgttttttgttttctcctgttcctgcatttgctctattttcttgcttttgttcgtgagtccaaaatccctgctatatcctttccagagagcaaatagttagttttctgctgatcgtgtctgtttggtgattcttggccatcagttcatatttaagaagaggcctgaacacataccccacaaatgtgggtgtctgtggtgtttcctcctggcccggccagtttccccagtagaaactcttctgaccctgtctagggaggagagggggtgagagggctgggggctcactctgctgtgtggatttccttggaactacctggttttagttccacaccctccagccaaagcctagcaggaacagccctataatctccattgctggagggagccctgctccgtggggagcctggggcctctcagtgagagggtagtggaaaggccttagaggacttgggcttgccttaggggatctgggggagggcccaggtaagtggggcttggtcctggattggatgccttctggaagcagggtaattgtatgattggatgtcttgattaatcttatctagaaagagacagtgatggaggctgaagtgatgcaaggaagtgacagtcacttacattagccaggatggagggatgattttgtggctcggaagaagttcttgattttgtcctcactcatgcgtgatcgcagagtggtcttgtttctgtcttcgcccatcaaggtcacacagtggccttgcctgatgttgatgctctgggtcatttccggtgttcagcaggacagcactgaggccgggctgataggaccaggccagcttccgatggtggggctgctgtgttctctcatcttcctcatctgggaccagtgtccctgagtccaaaatccctgctatatcctttccagagagcaaattgttagttttctgctgatcgtgtgagtttagaggagggataaaatttcaatgttccccagagtatgcatacacttattttttctctagagagagggtctggctctgttgtccaggctggagtacagtggtgtgatcatagctcactgcagcctccaactcctgggctcaagccatcctcctgcctgagcctcctcctgagtagctgggactataggtgcatgccaccatgcgtggctaagatttgtactttaaaaacaattatttttaacctacttatttatttatttattttgagaccaggttatgagacagggtaatttttgtatttttggtagagtcagggttttaccatattgccaaggctggtctcaaactcctgggctcaagtgatccacccgcctcggcctcccaaagtgctgggattgcaggtgtgagccagtccagcctagatggacttttaaaaaaaggtgtggcagaatacacatagcataaaacataccacgttcaccatttgtaagtgtgcggcccaggggcagaagcacattcacggtgctgtgcagccatcaccaccatccagccgcagaacttgttcatcttcccaaactgaagctctggccccgttcaaccccaactccccaccccccagcccctggcacccacccttccactgtccgtctctacagagttcacggctctcctttgaggcccctcacaggagtggaatcctacagtgcgggcctttctgtgactggctcctttcactgagtcccatgtcctcaagggtcagccatgttggagcccatctcaaaatggccttactttctactctgtgacttgcgccttcatgcagtcctgtacggcggggcttggtggagatggagagcagggcaagtgtttagccacagctgaatcctcactctcaattttaactgtaatgtcaattttctagatgtctacatgcttaaaagagtaattccttcctttctaaagcgttggctcccactctgcccatgaggcaagctgctctcatcttgccacagggaaatttatgtctgcccagttacagtgagcagtttttccgtccactcctttccctggaagaggtggggctgggctctccctgttctgtctcagaccccagtcttccttaccattctatttcattttattttattttgagatggcgtctcgctctgtcgcccaggctggagtgcaatggctccatcttggctcactgcaacctccgcctcccgggttcaagcgattcccctgcctcagcctcccaagtagctgggactacaggcgcatgccaccgtgcccagttaattttttgtatttttagcggagacagggtttcaccgtgttggccaggctggtctccaactcctgagttcagataatccatccgcctcagcctcccaaagtgcttggattagaggcgtgagccactgcgccgggccaccattctgttttaaatagagttttattaaggtacgattcatataccataaaattcagcactgtaaagtgtacaatttggtggttgtgcagccatcaccatgtaattccagaacatttttgtcacccctaaaggagccactactccccgttctcctctccagccccactggcaccccactgctccagctggcacccactctgcttcctgtctctatggatttgcctggctggacacttcacataagtggattcattccttctcgtggctgaatcctcttccattctgtgggtagaccgcgctgagtttagccatccgtcagttggatgagtggtgccgccacgaacctctgtggacaagtcttggtttggacacgtgtgttcactcctgccattcttcagctgagcgtctgggctggtggtcctgtgcccggccgccaggccacaaaagggtgcttgcttcccttatgccccggggatcttggcacctactgcccaagcccagcccttagccccctggccgccgccctctgcaggtggctgagatctgcgttgaaatggagctgcgggacgagattctgcccagagcccagaacatccagagccgcctggaccgacagaccattgagacagaggaggtctgggcagcccaccgggggttagagggagacgagggcctggagcctgtacagcctgctgttggaagtggctgccctgcctgcccccctccctttggccccttccttctgacttggacttcctgtctccctccctgtcccccacctcttaccaccctggtgtggtctcctctgcaggtgaacaagactctgaaggcgacactgcaggccctgctggaggtggtggcctcggatgacggggatgtgcttgattccttccagaccagcccctccaccgagtccctcaagtccaccagctcagacccaggcagccggcaggcgggccggaggcgcggccagcagcaggagaccgaaaccttctacctcacggtggggagggctgggctggtgggcgggacccgtgggggcattgctggggcagagggaggggctcaagccagggctaacacttggggctcttcttggggctgcccagaagctccaggagtatctgagtggacggagcatcctcgccaagctgcaggccaagcacgagaagctgcaggaggcccttcagcgaggtgggcccagtgctgcccccttccccgcctctcccctgcccaggaccctgtctagcccacggtcctcccctcccgcctgtccttggctcttatccacacctttctctctgggatgccttgaagacccctggcccgagaggcagaccaatgttctcccaccccacaggtgacaaggaggagcaggaggtgtcttggtgagtcctccctgagggctggggccctgcgacggtccgccatctcttctcttcctggggcccagctcagctgcccaatcccctgggcctcacttccccagttttcgcactggattgtggaataacttcagagaattagaggccggcttggctggcctggggggtggggcaccctattctccacacctggccccctcagagccagctcccattcactgcaggacccagtacacacagagaaaattccagaagagccgccagccccgccccagctcccagtataaccagagactctttgggggagacatggagaagtttatccaggtactagctttgccccacatgccagcccacctgtacatgctgatctttcttcagctctgggtcacctcagtggccggagcagctgcctgatcccagggtcctccactctcaatcagtcatcaactgtccttttctgggtgggcctcttccaggccactgttgggctcccctatagcctccgctgattgaagggagcatccttaactagtaatgggaacgtatagaaaacctggggcagcggcatttttaggggcgagatattgagagcttctcccctgcgacttctggccagcatggtactgggggtcctggacagtgaaataaggggaagcaagaaagatcagaaaactaatactgagatcagaaagcatcagagggggccaggcacggtggctcacacctgtaatcccagctctttgggaggctgaggtgggcagatcccttcagcccaggtgttcgagaccagcctgggcaacatggtgaaaccccgtctctactaaaaatacaaaaattagccaggcatggtggcacgtgcctgtaatcccagtgaaagaaagaaagagagagagagagagggaaggaaagaaggaaggaaggaaaagagagagaaagaaaagaaaagaagcaagcaagcatcagagagggccaggcatggagaataccagaagatcagaactgatatcgtcattttcagtgatgtggttatgcgtgtagcatattcaaaagaatcaacagattctttaaacgagcactttgagtttctttctttttttttttttttttatttgttgagactggttcttgcactgttgcccaggctggagtgcagtggcacgatctcagctccctgcaaccttcacctcccacctgctggggttcaagcgattctcatgcctcagcctcccaagtagctgtgtgcaccatcacacctggctaatttttatatttttagtagaggtgaggtttcaccgtgttggtcaggttggtctcgaacttctgacctcaggtgatcctcctcccttggcctcccaaagtgctgggattacaggcatgagccaccacacccagcttgagttttgaaatgttacttgattcaagattggtgtacagaattcaattgcatttgtatattccagcaacaatttgcaaatacaacgtaaggcactgcctaaaacctcatcaaaaatatcagacacctacgagtggatctaacaaacggtgtgctaagcctctgtgccgacaacgatgatgtgttcttcagagaaaataaaagcactcagcctggtgcggtggctcatgcctgtaatcccaccattggggagcttgaggcaggagtatcacttgagcccaggaagctgaggctacagtgagccgagatcacgccagtgcacttcagcctgggtgacagagtgagaccttgtctcaaaaaaaaaaaaaaaaaaaaaaagcaattgaatgacaacacagggcatgctgtgtccatggtgaagtaaacaccctctgtccccagagctcaggccagcctgtgcccctggtggtggagagctgcattcgcttcatcaacctcaatggtaagcaggacccagcccctcccgatgtcctggcacccagcacccagttcccagcacctggcatgggaggccatcctggaggggctggggaagatgctcagtgcccaccagctccttgtcctcccacaggcctgcagcatgaaggcatcttccgggtatcgggtgcccagctccgggtctcagagatccgtgatgccttcgagagaggtggggacgggcagggcgggcgggggtgggggctcgggcagatgtcaccagcttcctccccctaccgcaccactcgcccatctgcaggggaggacccactggtggagggctgcactgcccatgacctggactcggtggccggggtgctgaagctctacttccggagcctggagcccccactcttccccccagacctgttcggcgagctgctggcttcttcgggtgaggctggggcctgaggctggcggggtagggcacttgctggggcagccccgctcacgcggctctctctgggcggctttggccacagagctggaggccacagcggagagggtggagcacgtgagccgcctgctgtggcggctgcccgcgccggtgctggtggttctgcgctacctcttcaccttcctcaaccagtgagtgctgcggggcgagtgctggggtgggggccaggggtcgaggggacagggggactcggggtgcgggctctctgcttgtgatgtgcgtgtccccccagcctggcccagtacagcgatgagaacatgatggacccctacaacctggccgtgtgcttcgggcccacgctgctaccggtgcccgctgggcaggacccggtggcgctgcagggccgggtgaaccagctggtgcagacgctcatagtgcagcccgatcgggtcttcccgcccctgacctcgctgcctggccccgtctacgagaagtgcatggcaccgccttccgccagctgcctggggtacacccttggtgctgccgaggggactggggggtccactggagaagagcccccctcatctgcctcgctctgccctgaacctcagggacgcccagctggagagcctgggggcggacaatgagccggagctggaagccgagatgcccgcacaggaggatggtgagggcgatgggcagagagccccaccctgtccccaccctagtgtccacaccccctcccacagcttggaccccctctcctccccagacctggagggggtcgtggaggctgtggcctgctttgcctacacgggccgcacagcccaggagctgagcttccggcggggggacgtactgcggctgcacgagagggcctcgagcgactggtggcggggggagcacaacggcatgcggggcctcatcccccacaagtatatcacgctgcccgccgggtgagtgagccgcgccctcaggccccagggctcccggagtctccccttcatccacccctcccccgaccccaagttagattctgaaggtctgggctgggccagagaacagagcctctctgaccactcctggctggcgcggaggctgctggccctggaccccgtgcagggaaggagcactcgaaacaggccggtccttcccaccgcaggacggagaagcaggtggtgggcgcagggctgcagactgcaggggagtctgggagcagtcccgagggcctcctggcatcggagctggtccaccggtgagcaagaagacggggctcagggggcccacacgtgtgctgttctaggccagaggggactggggtcaggctttggcccagtgggagtgggaggagttggcagatgaggacgtgacagaatgacccagcttgtgacagggagaggctctagaggagcttggggaccactgggccagcctcctttccttggccacaccccaggatgggaggagccactgcccagctagctcagggacttcccagggcccccaccaggctccctgtctgtcctgcaggccagagccatgcacctcacctgaggccatgggaccctctggacacagacgacgctgcttggtcccagcctccccagagcaacacgtggaggtggataaggtgagagtgggtgtgtggcaggtgagggacatctgtcctgggggatctctgcctccccttggaagccaaactcctccctcctcgaggttccagtcgttgccctccctggccttagctcaagggaacctgccgccagacacacaggcccaaggcagagcctgtggagggcaggaaggcaaagatgtgagggcgggtggggatggagagggacggctacggaggcagggatgagagggacagaagacacctggcttgcacgttgggattcatgttcagcttcagagcagggagtggcagggctgagttaaggctgtttacctggtagaggcaagggactccagggcagattcaaggctggcatttgtagctgggctaggtaacaggcggtgccattggcaggcgcttggcacgccagggaggatgaaagggacagatggcagggaggcaggagggggtggctggttggggattggggtggggcagcagcggctctcgaaggagcagagcgaaggctcaagatgtggccctggcaagcgcacaacctgggggaccctgctccgtgctctgtaccatgggccctgtgaacactgtcgggctgaacgtggaagcccgcgggacagttgctaagcccaaggaggagagagcccaagaacatgcgggtgtcccaggtgtggccaagcccccaggcccagggagcccagggagggtccggtagacacggaggagcaggagcgggagccagggacagggcagccaggagacgccatgggaggacattgactggggagtccccgcacgctggcggtccctgaggccatgggcagggggctgtgatctctgccagggaaagagtgggggcgagaagaggggggtccccacttccgggctaaaccaaggaattgctgtcctcagaggagactgtgacagagacaccaacagggacaggagggatgccaggtgcaaagtgggggagagtgacctggaggctgagggactggggatgttggctgagggcttgctttgggagtgggaggaactcaggtgggtcttgggcagggtcagtcgggggaactcactggtcactctccctttctttcccctccgctaggctgtggcacagaacatggactctgtgtttaaggagctcttgggaaagacctctgtccgccagggccttgggccagcatctaccacctctcccagtcctgggccccgaagcccaaaggccccgcccagcagccgcctgggcaggaacaaaggcttctcccggggccctggggccccagcctcaccctcagcttcccacccccagggcctagacacgacccccaagccacactgaggtgccgctgctggagatgcgtgcccccggcggctacccgctggaccggccactctccccagcccccttgcttctctccagccctgtccagcaagtgcagggtgcctgcacttcaccctgtgcagagaggtgggatggggccgtgcacacagggatgcccgctccacatcctgcctgcccctcagccctggcccaggccccttttggaggcagctgaggaaggatgctggggaaagccctcttctgcagctttgtggaaggctgatcagtggctgctgggtggcgggtacccttgctcagatgcctggcagggctgggtggcgattcataaagacctcgtgttgattccccgatgggagccagctctctgtctcgggtgggcaggtgggtgctggaggtgagaacagcttccccaggggtcctgcagctttgaagacttggctgcctgcgccatggattccagagctgtgcacgtgactgtgggtgtgtgtggggagtctgtgtatgtctctgtgctgcctccacacccaccgttacccggatccaaggagaccccttgccatgtggaaaatgagctccaatttttattagggagagaatgaggagggagggattagaaaggcggagacaggaaggtcccctggccccagcctggtccttccttttcaggcccctgggaccgctgtctcacctgggggcacctgctccctctttcctgccactcctcaggcctctgctgcagcccctcctacacccagctcagtgagctgacctgaggggcccccacagtcctggggcctgaagctctcctcatacagctggggatgtggagacccaggcaggggctgtggcttgtccagggccacacagtgtcccagcctcggggccacaggctctggccaattctccacgggtccccctcccagtggctcccaggaccagccccaggaaggcagctgagcttctcaaagcctctagaggcaagacacccaacagctcctcacgatgaagtgtccttggccagggaggagctggcggtggtgcaggactcatcttggggacccaggctgggtggggtgcgtccccgggcacagcagagcaagcttcgcagctctgaggacacgctgctgctgaaagatgcatagatccaggggttggtgcagctgttgaggctggccagcaacatgagtagcacaaagggcgcccctgtggaggtggaggatctaggttgggttcaggatggctggtggggcacaggggcatgcggccaagcccaagtggccccgtcagccctagccacggctacacccaccttccagaggtgcctccgggtcccacgcggcccacagctgcaccaggaagaagggtgcccagcacagcacatagacgaccacaatcactagcgtcatcctcacagtcttggccacagctgctgacacgtgggctccctcaccggggctgcctgtccggcgtcccctgcggcgccccccaggcctctctgatggccctggcaccagactggcatgaatctcccggaagatgagcacctggcaggcggcgatacccagggtaggtgccacgaacaccatcagggcaatccaggtgacataggtgcgacggccccagggctccgcaaagcaggcccagcagtcagtgaccccgctgccaccttccacgttgcgctgggcgaagatgaagagctggggcaggctgagaaggagcgagaaggcccaagccactagcaccggccggttccagtgagccccacttccatggcggtacgccagcatgggacggcagatggcacggtggcggtccagcgtcatggccaggatcatgtaggaggaggcatacatgcccaccatctgcagatacttcacggcccgacacagggcatctggcccacggaagcggtcggtggccttccaggccagctggggcagcacttggaacagagccacggccaggtcggccaggcacaagtggccaatgaagacgtgtatgggtgcccagtggccccgccggccccgccgagctagggccgccagcaccaggccattgctcagggccacagccacaaagactatggagagcagcgccagctccgcccgggctagcagcgggtcccgggtgtccagtggcctctcctggctgctgttgctgggcaggctgggcagagagggatgcccaggcacagctgggcaggagtcgggaagagggcctggttagagagggtgctgtgcagggggactcaggcctgcctcccgtgcccccatccggacacccacttcctggctcctagcagaggggactccaggaaagccatgttatgagggatacacaccccaggct

SEQ ID NO: 11977 - DNA, 11988 bp, Human
tgcaaccttcgcctcctgggttgaagtgagcatgtctggctaatttttgtattttttatagagatgggagtctccctaagttggccaggctggtcttgaactcctgggctcaagcaatccactcacctctgccttccaaagtgctgggattagacatgagccactgcgcctggcccacttcactgttttaagggcttcatgaattcacatgcacctaccccggctcaggtaacctgccctcactggaggcacttaggttttttccaatttcttgctgttccaaaccatgccacagtgaacttcgttgttcctgtgcagtgccagaatgtctgtggtgcaggctcctagaagcaggatggcaggctcctacctctagacatttcttttttttttgagacggagtctcactctgtcacccagtctggagtgcagtggcacaatctcggctcactgcaacctccgtctcctgggttcaagcaattctctgcctcagcctcccgaatagctgggattacaggtgccgccaccacgcccagctaattttttgtattcttagtagagacggggtttcaccatgttggccaggctggtcttgaactcctgacctcgtgatccacctgcctcggcctcccaaagtgctgggtttacaggcgtgagccatggcgcccggccagcatttcccattttgatcttagctgcatttcgaagcctctgggtaggcgatatgctcactttcttccttgtgtgtgtgtgatggagggtaaatggtgctgaccgaagggtcccactcaggcagcctatctgttcagccctcctctgaccacaagcccctttctgcaagatgggaagctccagcttcttccagacctctctctaggcaaacttcatggaggcatgaagacattgtgctttaccatttactagacctgagtttgaatctcacccatgctccttaaacactctggattccattatcatagctacgaaaagaatataaacctctcagggttgcagggaggatgaagctgaacacgtgaagtgcgttgcaaacagttacacaggagttagctattgtcctcagctggtgctgacagctctttcccaagcatgagagaggctcttccgtgctgcctatccacacttacctgcagcaataaggctgtctcctgagtttacaaaagggcttggtccttgacctatttcctcacttcttctggacttcttgagcgctaaagtaaagaatgaaactcttggacaaagccattcattcaacaacaaatatttattgagcacctactacatgccagccactgtgctaagcaccatctgggcctcagtttttccatctgcaaaagtaggaactgtgcttctgaacagggaaacgctgggcctctgggtgggggcagcctttggggcgggactgcaattccgtcattggaacccagggacgccccgcatgtttccgaacggcctccagggggcaccgccgccctgaactgagagccaccggagccgggtagggggaggcccaactttccgctctgtcagaggatgatgccgagggcccagatgagcaggatttggactgtgttgctgggaacgggggcctacactggccccaggatgagttcgtccgtacctgggggccctgggttctgactctcaggtcagacgcagccaagatgcaactcaggaacttcaaggtttccgctccggccaagagccccagtccggcaggggaaagggtgggggagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgctgtatcctaccggacgccggaaccgcgagggtggcggggtccagccgggcaggcggtgccgggcgccccctgtcgggagcggaacgcggcggccggcgcgtcccaactgcccctggcgtcaccacgcgggccccatcaatcgccccgtcgggccgggaggagccgcaccccaggactggggcaggggccagctccgagggccgcagaagcggtcctgcaggcgcagcggcggggctaggcggcccgagtgtcaggggtggtgggtcccggagataactcggacgccaccacccggcggcctggcccaagcgtggggccgctgccctcccggctctgatctcctcccccgggcccgagggttccaggccccggccccgccctcgagctccgaatcccgggggcgtgcggggtggcgggtggcgcgtgtgggctccgcggatcctttcgagcgtggatccaacagtccgtctctttggtgttacgcggcccgtggttgtccctgcggctgaggatgtgtgtgtgtgggcccgagtgtcccgtgcgccctgtgcgccttctgagtccagttaggcgcccgcacctgttcccccagctctgtgccaggctccgcgggggaatggctggggagataagacgcttacgtgcacatataacttaataatcacatcatgactgttttgttttttgagacagggtcttgctctgttgccctggctggagtgcagtggcacaatcaaggctcaccgcagcctccagcttctaggcttaagtgatcctcctgcctcagcctcccaaaactctgggaatataggcatgagccacggagtccggcccatgtctgttttattttgttttgtttgagacggagtttcgctcttgttgcccaggctggagtgcagtggcacaatctcagctcgctgcaacctccgccccccgagttcaagcaattctcctgcctcagcctcccaagtagctgggattacaggtgcccgccaccacgcccggctatttttttaaatattgttagtagagacggggtttcaccttgttggtcaggctgttctcgaattcctgacctcaagtgatccacccgccttggcctcccaaactgttgggattatgggcgtgagccactgcgccgggccgcatgtctgctttaaagagctctaagaaaagcatacagttcactcatttgataaatattgagtgcctaatatgtgctagacactgtcctagtgcccagggtaataaaactaaaaaatcttaccttcatggaaattctgtaatgcgtgtgtgtgtgtgtggcgggggggttgcccgcgggtagaaagatgataacacaggaagtaagtaaaatatgtaatagaggctgggtgcggtggcacacacctgtaaccctagcactttgggaggctgaggtgggaggttcgcttgagcccaggtgtttgagaccagcctgggcaacatagtgagactctgtctctatttatacatatatatattctccatacatactatatatatatgggccatgctttggaccatgcttctggggaacagggccttatactgctccaggatgaactcccactacgtatataggtatggagaataatgcaatttagggtggtcaaagaaggccactgtatgatggcagggcgcagtggctcatgcctgtaatcccagcactttgaaaggccggggcggatggatcgcctgatgtcaggagttttgagaccagtctggccaacatggtgaaatcccgtctctactgaaaatacaaaaattagctggatgtggtggtggacacctttaatcccagctacctgggaggctgaggcaagagaattgccagaacccgggaggcggagactgcagtgagctgagatcacgccattgcagtccagcctgggtgacaagagcgaaactctgttaaaaaaaaaaaaaaatgacaattgagtacatgagggaggcgagggttgaaccatatagcaattcgggggggggggaaactttaaagcaaagggaacagcaagtcagaggccctgggaggactaactggcgtgttcagaggactggtgaggagggcagtatggctggagtggggaggaggagcgttgactgggaaccccctcacctagggccttttggtttttggttttccctttcagtgagaagtgcagtggagagaaggaatcgcagaccagttaggccactgcagtgacgcaggcgagataggatggtggcttggaccaggatggaagtagtgaggtcatggaagtttctggcctgagcaattagaagggtgaggaaccatttgctgagatggagaggactgggggaggagcaggttcagggtggagatgagaaccctgtgtgtgcctgtgtgtgccatgtgagatgcctccgagacagcccagaagtgtcaggcaggcagctggatgtaggcactgaggtccagtgtgtgggaggtgcacatttgggtgttatcaggatagagatggtatttgaagctgtgatcctggatgaggtcacccagggatgagcgtggccagagaagagaacccggttgtaccaggatgaagtcaggtgaggagcagaaccaggtgagggtgtgtcccagtgccaagggcagcgcatgtgctggggaggagggtgagccactccatcaggtgctgagtggggaacagaagatgactgagcgctgtcccagcactagagggccacagggaggtctttggggactgaccttggtaaggacagttttggccacagcagcagcaaaagcctgatgggagtgtgttcttgaaagagcaagaaggcagaaatgggggtgagcacaaacaactattttgagatttcctgtaaaaggaaagatataaatgaataactagatggggcagagagatcaagggctttgtttgctctttttttttttttaatcagacggggtctcgctgagtcgcccaggctggagtacagtggtgtgatctcggctcattgcaacctctgcctgccgggttcaagcaattctcctgtctcagcctcccgagtagctgggactataggggcccgccaccacgcctggctgatttttgtagttttagtagagatggggtttcaccttgttggtcaggctggtttcgaactcctgacctcagatgatccacccaccttggcctcccaaagtgctgggattacaggtgtgagccaccgcgcccggcctatttgctctttttaaggtgggagaaagaacggcaagctcatcagccagtgggaatgatcaagaggggaaggaaacatggatgatggcttgggggcagggggtcatcagcggctaggttccaggggctaaggctgggcctcaggggaaatgccctcctcacccctctcctgggcctaggtcatttgccccagctccgatgagcagggaaaggtggtcgagtccaggacccgcccaccccaccatgcccaactgagctgcagtgttgggaagatagaggagggtggttccttccacaggtaagcacacccattaatttgcactgtgcagtagcaggtctggaatattccagaaacaaatgagggtggctgcctccagatatttgttcttaccttagttcttcaaaaagcttgctccttgtattttgggtctcagctccagacacctcagagaggccttccccggcacctgagctgaaagagcctcctccgatggccctcttggaaagcctctctgttgtgttgatggcgctagccgggatctggcagggccttcttttctcatttgtttgtactttattgactgtcttcccgctagagtgtaagcttcctaagggcagggctttgtcctctagcacccagaagagggtctggcacatagtaggtgttcaacaaattaaggagcctttggtcagtagagatgatatttataatttgatactttcatatttattgtgggccgattatggtcaggcatgtgctcaactcagtttgatacatggtgggaaataatgagtcccctaaggggctctgcaacaatgtcaccacctggcagagaacagggacttctccttaacctgctgcgccccagtggcctggacaatgctggaaagacaaccatcctgaagaagttcaatggggaggacatcgacaccatctccccaacgctgggcttcaacatcaagaccctggagcaccgagggtgagcaggggccccatgggagggccagcccagagcagggcagggaaggtgggagaggggcccagctgaccctcctgtcacccgctccttgcccagattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtgggcagctcctaccctttgtgtacatgtatggacgtgtggctgccttctcagcagatgcccagaggggcccgtggccccagagggaaaccagaggcaggatcccttccttctctgggcccccaccatgggaggcccatggtgccagaggcaggacacatgctgtggactgagattgagttaacgtccctgtggtgttactacgtcactaccctgagcatcagtttctatgccttgaaatggtgatgatgacacccacatcactgggctttagggaggataacccaaggccagtatgaagcttcgagaggccatggagcctggctcaagagtctgactctttgctgtgtgacctcagctgggggtggtggcacgcacctatagtcctagctactctggaggctcagacaggaggatcagttgagcccaggaggttgaggctgcagtgagctgtgatcgtgccactgcactccagcctcctgggcgacagagcaagaccctgtctcaaaaaaaaaaaaaaaggaaggggccaggtgcggtggctcacgcctgtaatcccagcactttgggaggctgaagcgggcggatcacgaggtcaggagatcgagaccgtcctggctaacatggtgaaaccccgtgtctactaaaaatacaaaaaattagccaggcatggtggcgggcgcctgtagtcccagctactcaggaggctgaggcaggaaaatggcgtgaacctgggaggcggagcttgcagtgagccgagattgtgccactgcactccagcctgggcaacagagtgagactccgtctcaaaaaaaaaaaagaaggacacttgcaaagatagtacagaggtcagaggtcccccatataccctttaccttgcttccccatcttacctaaccgtggcctgtccaaactaataaatcaacactggtgaattactattatcttaattacagattttatttgaatttcacgtttttccactaatatactttttgtgttccaatgtttgattcaggctacaaaattgcatttagttgaaaatgaggacacttgtgagagtgaaaggggggattctgcaggcagagtggggactgtcctgggcacaccgcacacatctcctatgtgggtggagcaggtcagatgagatcagggccgtcaaatgctggtcaaggcaggtcaaggcccaagggttagacccgtccacccacatctctcccaatcacagacacatatgtggaaacaactagaatcagaggtggacagtgaggcctgtcgggagtggaacggttaaagggctgtgtgaacccagaagagggagagttcacatcctctgtgcatgtctggtcatcagattggagcagtctagaaccacggagagctcagggatcatcttatgcaacacccctccctgttcatggaagaggaagctggagcatggggacagcggtgtcccctgggtggtggttggctggaaccagaaccctggcccagggctgctccattcatgtgggccagccttgatggctacgtccacaaactcactcctgggcctctcccaccaccacggggcctcaccttgatcttccaggtcgatccttcaccccagatgctctgggccattagaggaggggtcaggctgtcctctgagtccccaccccacccctctatcttttctcccccagcgcctggccggagcaaccctcctcatctttgctaataagcaggacctgcctggagcactgtcctctaacgccatccgcgaggtgagtccaggccccgggacaggctcgctgagggaaaggggcatacatttatttattttaaaagcatttattaaaaataaccaaaaaggctgggtgcagtggctcacgcctgtaataccagcactttgggaggccaaggcgagtggatcacctgaggtcaggagttcgagaccagcctgaccaacatgatgaaaccccgtctgtactaaaaatacaaaaattagctgggtgcagtggcgtgcgcctgtaagcccagctactcaggaggctgagacaggagaatcgcttgaacccaggacgtggaggttgcagtgagccaagattgcgccattgtactctagcctgtgggaaaagagtgagacttcgtctcaaaaaaaaaaaaaaaaagaaagaagtaaaataataataagaaaagcatttattagcctagccctgctaggtggcaggacctatgcagggcactggggatccagtgattaataaggcatggggtggcccacagcctggggaaggcagagctgcgcatgtgttgttcacaggctaacggtagccagcacaagtcagtgctttcagtatgctctgctccttgcatggattaactcatttcattctcacaaccacctcatgaggtgagaactattattttacagatggtgaagcaggctcacagaggttaggtaacttgtcccaggtcacacagccactaaatagacaggaagcctgtgtctgaccccagagcccacattttaaccatgattctagtgctcaagcaccacagtgagaaagagcagggttaaaatcttggctctgccacttatgagctatgttcccctaggcaggttgcttaacctctctgaactttggtttcctccttggtgaaatggtcgacacaatccctggctcatgagggcttgaggagaatgagtgagagagggtgtgtggggctcctagcacgatgcccggatcctggtggatgctcaggagcccatgctgcatttacatcactaaggggcagcactggcatggaactggacagagagcccaggtgcccctggggtctgacaaactctccctgggaccggcggggcttcctggatgggatgacatggagcagggccttgaggaaggcgtggagttcctctgggctggggagggaaggggctgacggcaggcagggtctgcagtcactggccaccaccatcagcacctttgtcctcccaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgattcctggctgagtcatttgttgattcaacagcgttagagaccacctgggaccctcaatctagcaggggacagaaaggaatggatcattggagtcgatggtgaactgtggctatgtcaaagggatgcagaaaaagttatagaagcatgggacacggtgcaactgattccatctgcaggcttcctaaaggaggtcacattaaagctgggagtaaagcgcgagtagttttctaggtagaggaaggggaagacagttcaccaggggaaatccaactctcataggtatgaattagaaaaacagacacagctgcagaccagggctccaactttttgcatggaacatgggctgaaattcagctcccaattctctgttgcagccaggaacccatgtgcagtggacaacctgaacagctgtacaaggccagcacagattcaggcagaggggatcacaggacaggcatgatgagcaagggctccggctgggcgcggtggctcacctgtaatcccagcactttgggaggccaagatgggcggatcatgaagtcaggagatcaagaccatcctggctaacacggtgaaaccccgtctctactaaaaatacaaaaaattatccgggcgtggtggcgggcgcctgtagtcccagctactcgggaggctgaggcaggagaatggcgtgaacccgggaagacggagctggcagtgagccgagattgcgccactgcactccagcctgggtgacagagcgagactctgtctcaaaaaaaaaaagcaatggctcttgggaaatggggaggtgcatagagtcatgtgtaggagagagtgcagccagagggtgggaggggggccacatcaggcaggggtaactgaggccttccctgaaggctacaggaactcagaagcagtgccaggttgggaaaggataggaaatgaggccaccccaggggtccaatccaagtggcaaaactggcagatgttttcatggcacagggtcctagcagctgcttactctgcagggttctgtgtgaaggggtggcctgtccctccacacctgtgggtatatctcgtcaggtgggacgagagactgagaaaagaaataggacacaaagtatagagaaagaaaagtgggcccaggggaccggcgctcagcataccaaggacccacactgggaccggtctcttagtttcttcagtttttattgattattattttcactatctcagcaagaagaatgtggtaggagagcagggtgataatagggagaaggtcagcaaaaaaacgtgagcaaaagaatctgtgtcataattaagttcaaggggaggtactatgcctggatgtgcacgtaggccagatttatgtttctctctgcccaaacatctcagtggaataaagaataacaaggcagcattgctgccaacatgtcttgcctcccaccatagggcggtttttctcctatctcagaattgaacaaatgtacaatctggttttataccgagacattcagttcccaggtgcaggcaggagatagtggccttcctctatctcaagtgcaagaggctttcctcttttactaacccacgtcagcacagaccctttatgggtatcgggctgggggacggtcaggtctttctcatcccacgaggccatatttcagactctcacatggggagaaaccttggacaatatccggctttccaggacagaggtccctgcagctttccacagtgcattgtgcccctggtttattgagactagagaatggcgatgacttttaccaagcatactgcctgtaaacattttgttaacaaggcacgtcctgcacagccctagaccttaaaccttgattccaaggccgggcgtggtggctcacgcctgtaatctcagcactttgggaggccgaggcaggcgaatcatgaggtcaggagattgagaccatcctggctaacacggtgaaaccccgtctctactaaaaatacaaaaaattagccaggtgtggtggtgggc

SEQ ID NO: 11978 - DNA, 29960 bp, Human
tcctgctggaaaactactcgataaggtaacttctgcctgaaggggaccagggtcatcatacccgcaagtgcagcatcttcctgcagctctcatactaccaagctggggtttttccaacataaacattacaggtgctaaacgagaggtggcttcctttctcaataagctgttctctctctcggatgcccttgacagagccctgcagcctcccccactggggcttggtggataggtggtcgcttctcccccgaatttcaggaatgtttaggtttgcacaggtcctgcaggcgagcttggagaaggattagaaaaatgctcattcttaatcagttcgggcttgtctttatgccagcgaggttgaccttggggacagaagggtggccaggataaggacaagcatcctggtattggggaattctctgatatggggctgggacgtcaagatgggccatgatggcccctggggatagggcttctctgcagtggaagcagaagcatcccggtgttttctgctgtgtcactgtcctcagagggatgtataaagctgcttgggggctcataggagagggatgaaaccaagagtttggctttccagcaacagcggacaaagagtgggaaggggtactctatgccccaggtctgcaacatcttgccctatgcgctaggttttcccaaaggtcctttggctccaagaattttacagcagaacaaagggatcgatacccccaagggggcataaaagcatgccaatgagaatacccgccgccgaccgggcaccaagaaagtcctcggtggctgggtcacgtgcagatattgttgcctggggtctagactggcctgagtctcaattggtttctacgggacaactcactgcgggctaccgccctgggtgggtttggcaattgtcctgctcgaggtggttcaggccgcccacaaggggcacagccgggcagtcaggaaccggggctgccggctgggctggcctgcaaagaagagggaagggccggaactgcaaccgcagtggcggggagtgcgagggggcggcaggtgcaggagcgggaggcggggcggagctgggcagagtcctcgccagtccggcgtcccggagtgaccttcccccaccccgccagcgcccaggaggggtggacccacagcccagggaggccgaaagcgcgggcgggcaggcagaggcgtggaggctgggccaggactgccgggctggggtcctcgaggctccgggcgacccaggtgcggatcccccagccacggaaggggcggttcacgcccagccgggagctgggagggggctgcgcggcgctgcctgcgcgtccctcaccgccgcccccgcctcctcctcgccccgcgcccaacgccccgcgcccagcgatccaagcggcccctctagccccggcggctcctttgtgccggccccgaacccgccctctcgggccgagtccctgcccctggcgccggcgattggccaccgggccgctagagggcggggcgcacggccgccggggcgcggtatatagtaaaggtagggcgggcgcagccaattcctcggctcctggcgggagtgccggtggcgccccgcagtccgcttgtccgtccttccctctctgactctcctaccccgggcctgtctctgcagaggtcaggggaggcgggggcccagcacacgtccccagtggcagcgggagcggcagctacgggttcgcggagcccccgaccccccaagggctagaggagcgctcggcggaccaaagaaagcccgcgagcggctgcgcgcccaccaataggtgcggggctcggagccgcgcagcctgcgccgtccctccctccgcccccgccccgccgccgccgccgccgccgccgcctccccctcctcctgctcctgccttggctcctccgccgcgcgtctcgcactccgagagccgcagcggcagcggcgcgtcctgcctgcagagagccaggccggagaagccgagcggcgcagaggacgccagggcgcgcgccgcagccacccaccctccggaccgcggcagctgctgacccgccatcgccatggcccgcgggaaagccaaggaggagggcagctggaagaaattcatctggaactcagagaagaaggagtttctgggcaggaccggtggcagttggtgtaagtacggggtccgcagctcccggccgccgcgtctgatctttcccgggcggcgcatcccctgcgcagggtccgcggccggttccgcacccaccgcgctggccggggtggcgggggcgagggtggtggacgctgctgggtcgcgccggcctgggcttgcagtcctgtgcggaatgcggtgtccccagagtggggcgcagggtcggggctggaacacgacaggcggaaggttatgcatatcgtagcgatcttggcttggtaatttgcagtctttcctaccgtgcatcggttgagccttttactcctgggaatagtcaggctctgcgagactacatttgtctctcccgtgtcctgagtccttaaaaaaaaaatgagatctggggtcttgagagaacctcgtgaggtgatgggatctaatgcagacgaggttgtgtgttacagcatctttcttctagtctaaatacgtatctcaaaagagaggaaagagaagggtggagaggaatccatccacactgtagtatttcacagcgatggctaaggatttccctccatgacctcccctggagtcatcaccacccagaaatggttcaataagctccatttcaggactccgattcttagctttggcccgaaacctggcaaagtctggttgttttcaaggtctacacagacagttgtggatcagtcagtaggttgggttgattatggtgaagggaatataaacgcagagcagctgatcttaaaatattttgtgcagcctgttgcttggttggatagacttttttccatcgaaaattagatttcttgttttcagcctctccggaaaggtgactttttttttttttaaaaaaaggtcattttgaagggcagagttgtaggcgaatctatgagtcgtgactgcgtgagggaaggagggagggaactccccctgctgcatcactgccccctcctcctccaacatcattcatcatcatcatcatcatcatgaccatcaccaccaacaccactggcaccaccactgcagtcattcagggagtcctgaacagaggccgattggtgttcctgcttgggaggatctgtgggaatcggcaggagaatgagtcagggaaatagtgcttagctgacattttgaaatggaagaagctggaatatatgaatttttgtaaagaaaaaaaaatgcagcctgtgagtctctcttgattgaaaattaaagggttaataatgcatcacacttcaaggttagtcaaggtgaagcgtctttccaaggtgttactgggaagcataggtatccctgagccatggaaaatgtagttctttaatggcttttagcttttgttttatattttattttggggagacttcttcattgagattattgtcatagtgtctcaggcataaaggtagtttcctgtgttttactgtggaaaggaaaacctgaagaactgtggggtgtgtgtagaatgaacagctccctggcaactccttgtaacttgagggaggcctggaaggtgcactgcggtatgggcacccttctccccaggttagctggggcttccttctctggtggtctgaccctgctgcgtcacaggggcaggggctgcattgactctaggcacattgtgaaatttgccttcttgtctttttccccttagtataatatgcatctttgctcattccagtttcatgcttctcagaataatacttgctttagagggtaaggcagtatggactgactcatttttaagccgacatttaatgggcagcacctccatgagagagagaaagagagaccgtgtgtgtcaatttttatgtcttgatatcctatccagcaagctatcagtatgctgatttgtgaatgtagacccaggactgctgtacttgcctcctcttcccttccatgttccacggtacaggtgctgggctaaaaatcccctttttgttttgtgctaatatgtctgcccctttctggcagtgtaaaaactgtcagagcctctcttaggtagaaaaggcggcagcaattaccgtctcctacggagaaaatgccccttttccagcactgggcccaacatggatgcccttggggcgagggcaggatgcccttggctcgattttgcttataggtagattttcaccaagatggacgcaggagactcgcctgtcacctgctggagaaatcacagcatgcaaatcactttgtgccttctgcctttttattaggttaatacagacattggtaggttttatatttacagctaggcctggatgcctgcctgtgaccttttgaagggtacacactgtttgtttgttcatttgtttgtttttccaaaaaaacctctgtattacttttttttaaaagaagaaaaattgcgtgaaagggagatgcctctgaagcctctcagctcccctcacagtgccaccccagatagttggtgtgacttatctagccttttttttggctagtggggagcccctggtggcctgtgtctgagtgagccactgcataggcccctctagtcctgagtgctccactctctcccagtgacctcacggcagtaactagggagattttatcaactaacatctcagagcaaaaagggaaaattcctcacttttcttaggatatcgtgtgggcagaatagaaaggctgtctgtttctgagcttaatcggcgtacttgcaaaatgacttgtttttccattgctcttatttgtattttaaactgtagcctcaattatgtaccctcttatgttgttagaattaggcatctggagtccagggaatgagtatagagatgtttcagttgttcgaaggggcacatgtaggtaaggtaagagcaccaagatgaggtgggggtggggggcagcaagaggaaacttgaatcagggctacgatagctgccttgctgactgttacaccaactcttgcacctcttaggagcattcactggaaaaattttccagatctcttgacgtcacagcgttgccatttgcctactgctgcttggatacagaatgcagcacttaacccttgtcctgcggggagggagtgattgagttgggtgctgtagttctggattacacaaccttttctttcttccttatctttacttctgtctttgcttttttccttgttatttgcttttgatagaggagaaaaaggattatgattaagcattttgctgtggttttgtgtgttttgcttgttttaacagctctgtagcctgatttcctttaactgtttagtgcctgataggaaagttgggcttttaaatgtatggacagggcaacaaggctaattcctgcagttgtgtacccactccctccctggccccctcctaccacatatacttcttttcaataatactgtttttcagtggcttttctccaagtaccctggcatttttaatgcatgagatctggacctttttagcagtaacctaaggctcctttgtgcagtcgtgcttctgactcgataaccttacagttcacttgttccctgttttgcattcacattgagtcgtttggctggcacaggactgccaggcaatgcctagtacagcctgttactatgcagctaatcagggagataatccttgtaaaccagtaactgatagccaccctcattcccatctatgtgttgagtctttttttttttttttttttgcttttgcagctatttcagcctccatcctgttgtcttgttaactatgggaaaaagaaaatgcagcccagcaagtcagtcattattcttgttccagttccagaagatggaattaaaatgtgctggtcattttcactatagaattttctttttttccccttgtcttgtcctccgaggggaaagagtgtgctttgttgataatacaaaccaaagggagagtgatagtaaaaaaaacaggaggatatcatcactgggtttctcaggattcattgctctgccatagcaaaataaccctcaggcatctgagcatttggagaaacagcagagcttggattgtagtatttaaatgtcaagggatatgcaagcaaagaaaacataggtctctaagggagtatactgtcatattttaaattcattgcataagcatccaaacatagctctagattttattggtgatcttcatgattttttttataattttgagaataaaaaatatggatactttttttaaaatttagggaataaaaaaatataaggatcctagttctagctgaacattcctcctacccttaaccacctcccatacacactgcaagtggagggctgcccagcctctcgattttcaccctgtgtcagtggggtgaggtgcactcttgacgttggacaaggaagaaatcatgggaccgggggaaccaggaaggaagcttgttcatccgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagttttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggctatgactcaggtaaattcttttaaaaaagtcacttgggctcctgttttaaaaggtgaacttatttttagagatgataagaagctgtggaatgggcagctactcacagggagaggagccatgactttaggggtctattgtcccacctgctgttaatttgcagtttgagcttgaacaaagtcactcttacttctcaatatttatacccattgatttaataagcatctcatttgccagctttctggtcccactttgtagtttaattaactgtctcctttagctcttaaaaacttgggtgaacaaaaagattatcataagaaatgcaaactgccacacgagtccctgctgtgacttgggtgccatcagtgtagagctatgtgtgtccacaccagtcgtgaaaggcccatggccatcatgcctgatgctgataggacaaggcagtggaatagccacaaacgtgaatttaccatctggctgttgtaaaaatcattgtctggaggacctagagagaaagtgttgcataacttccgggctctcacttacgaatgaccttgaagctgctgctgagggatggcaatgacttgtcccttctctgctttcccttggcaaaggtttagtaacagctgtatttaggtgacaatcttcagatgatctacgtggccctgagcagcctagatcaagggctactgcctgccacaggcttttcctgcgtacctccttgaatgtgggaaggattcacagaggaagatcttcaaaatacggaggtggcaagcattgttgtgtagccctaagtcaaatagttctccactgtaagaaaaactcaaaatatttccagataaatttagagctgagggattggggaagtggaaaaaaaaaatcacgtaagtaaataacataacttaaacctgcttaataatccagtttccagcaactgttttccacaagaggtgggtctgtggaaaggttgaagcaagaattctggagtatgcagagaagctgaaacatgttttacgttgggtatggtgatagggaagcattgtgtcttttcatgtcctcttctgctagaactttgtggtaccattagttgtaattttaattggtgcggatattttgtttttgttctttgttatgccatttaaaagttattcttccatcatgatgtgattttataattcttttttttttttgagacagagttttgctctgtcacctaggctggagtgcagtggcgcaatctcggctcactgcagtctccgcctctcaggttcaagcgattctcctgtctcagcctcccaaatagctgggattataggcatgcaccaccatgcctggctaatttttgtatttttagtagagacaaggtttcaccatgttggccaggctggtctcgaactcctggcctcaggtgatccacccacttcggcctcccaaagtgctgggaggtgtgagcatgagctaccatgcctggcctgctgctgttttataattcttatactcaaagccaaatacgactacaaagtcaaatattttcttcaggaaatttcctagattaaaaaaaaaaatggtccttgactatataaactttgaggagtcagcctttaatgaaactaaaaattctctttgtgccctttgcagaaaggaaaatttaactttggaaaagaaatagccaaagggcccaaccttgtaagtaaggacttggaaatgaccttgcctgtaaatcaactggctgaagtgctcagtcctttccaacaccctctcacggtgcctcccttcccttccttccatccccttcctaaaagacatgttcttagtacctatatttagtgtgctcacagcagttggactgacctgacaaaccctgacttctccaaaggaatgctggtggctcatcttggaaaaatgcattcctgtcctgtggtctgagtcacaggaaaagtcctcagtcctccatcttccttgttctttggcctggtaatttctgtctcttcttttcctcatcccttcccccatcacctttcaggagagtctaggccaggcccctcctcttcacctgccttaccctgtggggtttttcgggggcctttaccaagggacatgacattcatatgaaaatgacagtaaccttgatcaggccaggccagcagagtgccgaaccttgatcaggccaggccagcagagtgccggctgccacaaagtgcagctcttgggccaccccttatggccctgtgttgcctgaggaccctccttggcatttttcaatgccaaggaccctccttggcatttttcagagtacgtgttagaagtttgtattttgcataggaaataactccttaagtatgcagacaaacagtgtgtttaagaataccctgacaattttttggcttcacattagtatctttaaagcctccattttcatgtttagttaaagagggaaaattgtaaatttgagttagatacacctagtgggtgtgaaagtttgcatatgatttaaagatataaagacttactaataatattatcagctgaatttgaggcatgaatgcaaatccagcctgactgggtattgactgccctttgtacaccggaataccttgtagttggatctcttctcaataacgtgtgaatgtggccatatcaagcagtggcaattgtgcagtgagtgtatttgggcctgtatggcgataatattggataaactgagaggccaaacatgaaatctgagaggagagactaaactacagaatggaagtgaaatgtaagaaaaaatggtgaatgtgtacagcttcttggccctgaacaatggtggccgtttaatgcacatgatattccttacaaagtcgtgttgcagccggtgtggtagctcatgcctgtaatcccagcactttgagagactgaggcaggaggatcctttgaaggcaggggttcaagaccagcctgggcaacatagcaagaccccatatccacacacacacaaaaaatttttttaagtctcctgttaaaaaaaaaggggtggggccaggagtggtgactcacgtctgtaatcccagcacttccgaggcaggcggatcatgaggtcaggagatcgagaccattctggctaacacagtgaaactccgtctctactaaaaaatacaaaaaattagcctgtcgtagtggcgggcacctgtagtcccagctactcggaaggctgaggcaggagaatggcgtgaacccgggaggcggagcttgcagtgagccgaaattgtgccattgcactccagcctgggtgacagagcgaagactccatctcaaaaaaaaaaaaagaaaaaaaaagggggtggggaatcatatgttctgtgagaactaaatgagatgataaacatatataaagcaaatagtactttatggtggcaaaaccaatggtattaagtgtagggtaactgttgagagcaacttctgtttttttctttttttcttttttttttttttcaagagggagtcttcttctgtcgcccaggctggagtgcagtggcatgatcttggctcactgcaacctctgccccctgggttcaagcgattctcctgcctcagcctcccgagtagctggggctacaggtgcgcgccaccatgcccagctaatttttgtatttttagtagagatggggtttcaccatattggtcaggttggtgtcaaactcctgacctctggtgatccacccgcctcagcctcccaaagtgctgggattacaggcgtgagccaccgcacctggtccagggtttttatagccctatctttctactagaagcagcagtttcttctttttggacactaaatttccagatatgacagggatgctttgcacacttagattttcatggagtcaataaaaccttagctttccatggaaatgtttaagagacatttgggaaacatgtttttaaaaattttaaagtgaatttaaatggcattgtatttgttgtgcagtctctccctttaacaaacccatgcttgttgggttagcgcctgccaagcttttctccagaggagacccccttaggcagtcctgcagtgctgctctgcagcatcgcttctcatctgttgatgcagttggatctggggagagacgcagcaattagctatgctggagagggctgagcaggcacaggcacgcacacccacgtgcatgcccacggacatgcaagcgtgcacacacacgcatgctcatggatatacacacacactcaggctaccaagccctggccctgatttgaccctgcttgccttgctgcctgcccagtggtgtaatggaaaagtctcttcttcacatccgccattgcccttcccccacctcaggctcacttagcaacagtggagtgaaatgaaggtcactgtgtgtcaatcggtgggtccgggagattcccagctggcttgcttcctggtaggcaggtatgaatgtatgctgctgttctctcttttaaggttgtgggtggctgtttgtttagctctgaagtatagacggctcagtgctagcagacacattttcaaagggtcatattcttggcttgttggtaatcagaatcgggcaggagaagtggggtggatgcagaccagctgaccacactggcaccaccagcagtttcagtttcatcttgattgtaaagaggaaatatctaatcttaaaactcattaggggcctggcgcagtggctcatacctgtattcccagcactttgggaggccgaggcaggcagatcacccgaggtcaggattttgagaccagcctggccaacatggtgaaaccccatctctactaaaaatacaaaacttagctaggcgtgatggcaggcacctctaatcccagttacttgggaggctgaggcaggagaatcacttgaacccggaaggcagacgttgcagtgagccaagatcgtgccactgcactccagcctgggcaactagagcaagactccatctaaaaaaaaaaaaaccaaaaacaaaacaaacaaaaaacccattagggttcgagtcattatcattctatctcagcttgattaagtaaaattcctgagaagtcattatgtcagtctcagaatacctaatttttccaccccccgcaaactacctcatacttgtattactatctgtcactcacacttcaaaggagaaataaggggaaattagaaacatttggcttccttatactttggaggggttgttagtgcaaagtgccagtaaggtgtttccagttagaatacactgctttgtaatctctcagctgacgcgatgtatctgtatacacccagctgtctctcactttccctctcctcctcccttcccaccctcaaatggatcctgtctacctggtcccagaatttgtggatgagttagcattggtggcaattagatttccaaaagctactgcacagccttatgacttggtaaagggtttgtggggggaactctgtttggcttcaacaactcaactacccaggtggtgatttctttatttctaaagacaagggtacaactagtaagtcatctcttgggtacacaggaaacctaatgatttactttaaaatgttcttggagccacagaaaaacagatcttacattgtatgcccattgtatgatgaataagcagaacagagacctgataagtaggaaggaccaggtaacaaatctgtgggagtgatggtgggggaaaaaaaaaagctggatttgtgaagcttcatttaaggattttttgctgcattcacccaagggtcatagaaagtggggtggaaagagcagtagcctgacaggtccacttctaccataaaatctgatggggttattggactggttgctcttaactgttggtcagtgctctcatgctagtaatctgatgaccagctggtctgtcggatgcagtcaagactagtgagaagctggggagatgaagggaacagggatgtatcatccagctttttcccacatacatgcatgagtagatcttatcaaatgtcatgtagaatgcagtgtcttgtttcaggatattacttaacaaatgttatgttttatatctagataagtcaaatatactatatgtacttgctcttcagtttggccttgagcataattaatgtaaaatactaggatttatctatttgtttatgttattcttttataaaagtggcacctttcctttattgtattgagaataagcacaattatgagctatacaaaataccaaggatttgcccctatggaatatgcatttttaaagataggtcaactgaactaaataactccctgcttgcctgaaagtgaatatacagccacaggaagaagaggacggatcagagaagagcctaaatcagagttcacggcatttagcttagacaggaggaatgatttctttaccctgagtgttggtaaacatccagattggctgtagagacagtccggggattcagttttctaagactttgtaaagggagcagattctgagtgtcggagggtgtgaatgtgaccctgcctgcaggcagggagatttattccttgctaatctcagagcctgagtctgggagctggaggcagaaggtgagtcaaaggtggctagtttccagaaagtgcaaaggcgccttttttctgtgcctctccccttactttgctaggtaagttgataccaactcacagatgtaaaacaaaaataaacaaacaaaatccagaaatatcttaggtcctacagagtggcacttaaaggagaaatttctatctcatatatgtgcgtatgcatacatatgtgtgtgtttatgtgtacatatacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatgtgtctttgaaaagcaagtgggaagccagaagttttttctaaatctaaatcttatgtaaagttgaaatactcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagtttagaagactggagagggaaaaggttagatttgtttcctggaatataacttgaaattgcgtgccagcgattgggtgttctgctgtctttggccctctgggagttaccagtgcaaacagagctcatccttgtccagagtcataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttgggtgtggcctcaaaatgcagatgctcttcgatttaggatggggttatgttctagtaacccattgtaagtcgaaaatactgtgagtcaaaaatgcatttactaaccctgctaaacccactgtgaagctgaaaaatcataaggcaaacattgtaagttgggaactgtctgtaataattaccaaatccaatcccattgctttctatctcttcttaacagtctgataatcctaaagtaaatgatttaaaggatttggacatcctttcaaaggtctttcatctttctcttgtgagtatctagttgctttagagaaataacttgagaagaggaatttttctaatctttggagaagacctcatcaaaaactgtcctaattaagactatccagaacagaacagacccgggggctgatctgtggtaatttccaggagaagttctcaggccatcaggcttcggataaagaaaagagaggaggcagagatagtgggtgatggagtgagagaccttgtggaaatgtgaggaaagagagcagaagagctactaaggaggcagcggccacttgactgtggcgtggcctcctggacatttgtttatgtagtaagcatgtgtgagctgattgcatgacctaaacccagaccatctgtttttttactggaaatgacgtttggatcaaaagctctgtatcttaaatgaatggtcattaaggcttatgttagttaccaccgtctaagacccctcagactccagagggaaacatgagctcacaaaacagtaagacatgactgagctttctggggtttatctgtcattcctcggctccttctaccaaggttctctgttacttaaaatggaaaggacagggcagaggctttggcctagggtctaatccagctgggcaagtcacagggttctaagactccgtgcttagctgtcttatgtttcaccccttgctttcttggtttcactagtttctgatgcttctgtaagagcaaagtcaagattcttcaagcagcctgcatctatgtttccctcacaaagtaattataaacttgactggcttagatcatgagctatgcttactgaaaaatttgggctttcaggttgaaagggatgtgattccattacttggttttcattatttcttatttgccccgtctagagagacatgaggccaattgtgtatataactctcttctgggccagtagtaccacttcatgtaacagtaatacctattattttcacaaatgtgatcttagatattttttttctttctctttttcttttcttttcttttttttttttttttgagacagagtctcgctctgttgcccaggctggagtgcagtggtgctgtctcagctcactgcaacctctgcctcttgggctcaagcgattctcgtgcctcagcctcccaagtagctgggattacaggcatgtgctactatgcctggctaattttgtgtttttagtagagatggggtttcaccatgttggccaggctggtctcgaactcctggcctcaagtgatccacccaactcatcctcccaaagttctgggattacaggcattagccaccattcccggccatattcctagatgattaacaacagaggcacttacaagaaagatttgtcatagtctatcagtaaacatgaacttagttttggtcatagcccctaggctcctggggaatgcactagccttatcattttgttagtaaagagcccagaggactgagtgagagttgctgatgttttgagtctgacacatgtcccctggtcacttttaatagtggaaaccgtggacttgacatcgtgaaggaatgaaaagcgctcagcataatacctcctcctgttcttactctccttttttttgtgtgggagaatctgagaaatggcatcactattcctcatactcatatcaaagtaatggaaccttgagcagccactggaagagagaatgcaagcagccagaaagtgagaggcaaaccactggagaggctcactgaagccaggccagggagaacaaggatgtttgtgacacttgcttcgcaatccaggttttaccatgtttactctcaacatgaccttctagggtcactcctcctttcagcttgttaggtgagactctccaaatctcagtatcaggcttgtttatattttggcttttgctgcatcccgccctctgctgatggaccacagcttgcataattgttgtttatcacaccaatgtccctatggtcccctggctgtgggtcttcccctgaccttccctgaaggtcagatgagatccctccttggtttctgacatttgctctccttcacttgtctagccatccaccaccctcctgccttgtctttcccaagcctggaaacactgtttaaccttgtgtacataagtccatttctgttcctgactcccaaacatcacacagaatacttggaggaggttcctgcagacctcctgcctgagcgatgcacaggcatttgtctctctctctggctgcctatgcactggctcttcgggtggcccctcagcatgaccgtccctcaaggctccattctctcctgactccaggattctcccattctgaattttgttgagcctctggctttgggtctgctggtgtacttcccccaggtccaggcaagtcaccttgacttaagtgtcttatttacaacttaaaccaggagtgaccctccctacccgacttccccatttcactgggtaactctgtttaccattgctgtctcaagcattaactatctgtggaagcttctgctcacctttatttttgcaggtatctcttctctttacaatactgctgttttgcaccataaatgatcacaatgccaattttaacatagaaaaagattgttcagggtatatttaaattgctttagaaatactaaaaaattatggcttgtaggcatttttacaaaattttaaactgtaatctgtgtttattttaaactgaagatttttatgagcaaattctgctacttcccctttgattcatttctatcactgttgaaatttttgtcccccataattcttcaggttctacatcatccttttcaggatgattttttttttttttttttttttttaaattgcgatagagtcttgctaggttgcctgggctggtcttgaactcctgggctcaagcgatccttccatcttggcctcccaaagtgctgtgattacaggcatgagccactgcacctggcctgaagatgattgttaatgtccttaagtcctttgccctgggcacccctgtgccttgctccagtgattacttgtcttcctctctatcccttccattcctctagggaactacatgtgtgaaaaagcatatctatacaaccccctgagcccacctcattatgtaaccacttttaaagcatcctcaatcactagaaagaatagcatttagtcgagccttactgatgcctgcttctcaagccctacaaatggtgctgcactctagttatcacttccacattcgttaacgtcgttgtcttcatatctgagtcactgttgccactctcagattataattccctagagaagcagttctaagccaagggtgtttaaagatcttttcgtacttattaaacagattctcaaatctctttcttagagattacgattttgcaggtctggaggggagtctctgagactgcatgtttgacaagcccctaaatgatagtgacataggtgctttcctgacctgctgggaggtgggggtgggaagccagggtagagtcacttatcaaggatagtgatgatgtgcctccttatgggccccacacagagaggggagatctgggagtgaggagtagaatcaagttgccagatttaataaataaaaatacagggtgcccacttaagtttgaatttcagttaaactatatctctctctctatatatatatatatttatatatatctctatctatctatctatatatataggtttttttttttgagatagagtctctgtcacccagactggagtgcagtggcacgatcttggctcactgcaacctccgcctcccgggttcaagtgattctcctgcctcagcctcctgagtagctggaattacaggtgtgtgtcaccatgcctggctaatttttgtatttttagtagagacggagtttcaccatgttggccaggctggtctcaaactctggatctcagatgatccacccatcttggcctcccaaagtgttgggattataggcgtgagccaccatgcccggcctcagataaacaataatttttaaatgtaagtgtgtcccacatagcatttgggacatacttatatttttttaaaaaaatgttctttgcttatctaaaattcaaatgtaaccaggcatcttttatttggcagtcctacaataaaatgcagttgtgatggacttttccaaccattgctcctgagtagtgctgtgtagtgtggttcacatacccatctaggaagtctcatgaaggcagcggcttttggatattaaagaatgtaacagagttttagagagtgcaaacccaaggcatacggactttgaattttatctgaccggcactgacatgctgagactttcagattggaaagcatttgtggttactgcatgtatgtcccaaattcttcccgtttaggttaaaagatccaaagaaatatcttggttaggtaggcttgagtctagagaatttggaatggttatacatttactgacaataaggattataaaagaagacctctgtgtccaaggcttacacgtaattagggagggtaaagccacctgcacacaatgctagctagcagggtattttaaaaaactgtgcacgttggggtactagaaacataatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtctacttttgaattgtcttcgtttctgccttcctactaatgtttttctctctgcctggtctaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctggccatatttagacactttttttaaaaaaagcaggaagacacaatgaaaaacagtacagcctcaagtatgactgttttctgcattggaaaggtgtcttactttaaaacactcctaggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgtatggtcagggtatacttttattgatcctggttgggatagataatgaaatatgtgttaggcagctgatcgttttggataaggaaatgacttatgaagggtaaagagaggctcttagtttcattaagtcattgacatgaatacatgtcctcactcttactacctggactgtgaattttccagtccatgttctcattctttccacaaaaaaatactctcgctgggtgcagtggctcatgcctgtaatccttgcactttgggaggctgaggagggaggattgcttgagcctaggagttcgagaccaacctgggcaacacagtgagaccccatctctacaaaaaataagacaagttagctgggtgtggtgttgtgtgcccgtggtcccagctacttgggaggctgaagtgggaggatcacttgagcctgggaggtcgaggctgcaataagccatgatcacgccacagcactccagcctgggcaccagtgtgagaccctgtctcaaaaacgttaaaacaaacaaacaaacataaaacatctctctgagttttactaggtaatatcatcccttctgattcaattcaagcatttaccaactccagttctttataaggcaggctgtggcttggtcagagtatggggcgaattgccattttaagttattttggaaatatttagtaacttaaaagaacattttcagtgtgaatttttctcattagaatttaaatgaggttttcatcttactttgcagtaattaaaaggcctgagggataatcagggtgaatcacttcaaggagatagtctaaattcagactcttcgctatttgaagggaaaatagttcatttgtgaatttaaaaactatacataaattatggtttgcattattttcctccagcatgctatacattaactttgaattctatattcacttggtctttttctggcttttatatgaggattgaattaaaaatgccagaataaaatttctcagtccagcaaatgcttaatgcatagctttaaaaggcagaaactcaaatcaaaaaagcctgggcaacacagcaagaccccagtctctgcaaaattaaaaaaaactagccacagggtggcacacgcctgtagtcccagctactcaggatgctgaggtgggaggatctttagagcccaggaggttgaggctgcagtgggccatgatcatgctgccgcactccaacctaggccacggagtgagaccctgtctcaaaaaaacccttaagtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcacgcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaagggaattgctggtacaatataaaagttgtgtttttatttttagatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaagtaatattttaaatgatagaatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtccagttttggtcctctggaagccacaggaacatttcaaaaaaattgataatctgaaaaaatattttttctgaattttattgcggaagtagaagtttaacatcatctaggctgaattttgctagccatgctgttggctttttgtattactgcaacttataatggataaacattactctggatcactgaaaaatgagcaaattgccattgctcaccatttggtgagattatattctccataagaatggaaaatttatcgttgttgtctgcttttgtaaagctggtcatttcatcctctcctccagatcatgaattaatgctgtcctttccccttaagcctggcttcttctggcaggtttccccctaatcacccgtatatgagcgttggcattatgagtgttgtttctaattttgatagaaattgactgcagtatattgagttatgtgaacaaactcatttcatttctgaaatctggcacttttgttcattaattttctattgaatgctattaatttatttctacaatgcttgttacccatgaataatattttcaaaagaaaatcaacacagagataaaaagttttgttaactgaaggatgcatcaaagttcctttattgccatcagaggcaaaaatgagtaggtggggatggatggttgcctggctggctagtttgatggactgctggcagaaattaatgtacctctcaaaaggattttaagcttctttccacatagacaggatataatggaagaaaaacggtgagaaccattatgccaaaatgtatttgatattcatattgctggggaatacttcactgagatcaatcagctatttagcagcaaaagaaattgttgtggcatggccaagagaagactcatcccatactttctgagtaccttgcttttgacattactcatcgtagacactgaatgacatttggaccccacagaggcagtctagtctattgtgattgatttcttcccacatctttagagttacttggttcagtgataaattcagctactctttcttttcagtcctttttttcttttttctttggtctctacttggttatccattgccactgcctaattcatcacctccacccaaatctccaactattttggagttatttttgtcagagatcagagtatcccagcatctcactatcctcaccattggaggatagattctggcaacttcttagtgagcattttctctacatatttttaaagacaaatacattgctggcagaaacgtcccaaagagtcaaatctagacgatcattttcttgcatccaaaacagagtagtagcaaaatagtagttccttcctgatgtggaactaatattttatctgactttgattagactatgtatgtgttacatctcacatcaagactcacttgctgtgctgatctgagtaagcaagtgactgtcttccagcgaagtatgttcatcacacttctgagatagatttgagccatgggtgtagaagaggaggctctggatatttcatgacagcagtaattttcagactgtcctctgggtcccttcagtggattcaccccttcaagaccacccttcctcttagggcagtgacacctctgccttttttacatattggactttcctaagaaaattgcaaagaaacgctccttaaatggcagtctccccgactggagattaaaacaacaaaaaaggaaagcctacttgaagtcatgcttgagggaaaaggatgacattatttattcatgactcaggaggaaagcccacgctttataaaaacagaaatgtcaatcatctttctcatgtaatctaatcttagcaaataacgagcattatattttgggttgacttagttttcagtgtctttaagcaaagcttataatgggctactattaaaagttccatttagtactggtttgcatcacagcttaattgtagtcgttataaacttgggcacttattttcatttcaacaaaatcacaaacatgaccttaaattggttaggggagtcattcattctgctgtcctgatgtcttttgttattttggttgacttactgtgaccagtgtgtacttgtttggactacggagtagttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagacaaatttagggttactggggtggtggaagggtaggcagaggaagaggggagaatgaagaagactgtttaagtgacaggtagaattttaatagaagaaataagaaacattgctttcaagtataagtctcagtgagatgaattgtagctatactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtacttctttctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaattgaaagactaaggtaacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagatcatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgtttttgagtacacatagtgatgcatgatgtgagccattaaaatttcatttcattctggatttcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttcagggattggcctaagtccttatttagctgtatttaaaaattagccttagtgtgaaagaagataaaaatcagctttccaaaaaacattttccagctataattattaaagatttagtatcacttaactaacatgggaaatgcccacactaaaatcagggcattgtatttctgaaacggaaacctttcgcaaagcctgtgcaggcagaggagctcacacacatccttgacgtggcactgtgtcttcaggggtgctgccctcttacagagagacagacctggaggccatggccgttttggtgagaaatgccagaaacagcttcagtttccacctactgcttcatatttataatcacagtaatctatttctcgttttgctatttctagagcaacaaattgtgtgatgcgaaattagtaccagaggaacaatgactccacttaacaaaaaaatagcaagggaactatgaaaaatggcacaactgcttaactttaatagttgaagtctttaggagacttcagtagttgaaatgacacagaaaaatcctcaaactaacatacctacatgaaactgagtttctcaaagtaacccacatttatggaaatagaagtttgtcttgcagaaacatcagctcattttgtaaggtgtatgtgatatttaaatttgtgatgcttgtgaataagggaatggggctttaggtctgaggaaaggggagcattcattcaaactggagggtattttgcatttttaaggctgctataaggtcacgaccttggtgagacttgacctgttttcgtatgtattgtgtactttctgttctaagccattgtgtgtgtctgtaactttctccaagattctctccaaatcttgcttctcttaatttctccagattgtgccaacctatttcccactcctgatctttagtgttatatcaccactaggagactggggaatgtggtttgtgttcttagactcaacagatacctaccatatgccaagcattcttctaacagctagtgagagatctatcagtgaacaaaacagacaaaactccatcttttttcctctgctgctcatattctagtgttaaccatttgcatatttctcagactcttcaatacatttattatttctttttaatcagtttattctgaccctcagtagatgacatatttcatgggtgtagggacagtgccatctatctcccttggggtgttcttacattcaagaaatgggttttcacacaagtcctgtcaaatacttaattccttacacaatataaagggattgagtttttcaaagataggctgactacttggaatgaaaagcatttaaatactgaagagagaaaaaggattctcttttcaacccttcatattctcggaaggaaaactgaaataccgagttagtatgtcctcaaccctggttaatttcccttgcaaacaaagagggacaggccttggtgtcagaagctttgccataagatgttacctagctaggatttttaaactggttttcattgtattttattaccttcaattaagaata

SEQ ID NO: 11979 - DNA, 7901 bp, Human
  misc_feature (1)...(7901): n = A,T,C or G
attgcttgaacctgggaggtggaggttgcagtgaactgagatcgtgccactgcactcagcctgggtgacagagtgagactctgcctttagaatttcatgaaaaggctgcagtcggtctcttataggctnnnnnnnnnnnnnnnnnnnnaggttcgattggatcggcggaaagatgggggttacggggtggaatttgtggggtggtggaccggaggggcaatgataacacgggcgatgacggggagggaggactgggacggggattgggggggcgataagcgggaaatgggggagaggtggggagtagcggatggggagtggtgaatttcggcacggggcgaacggcggttgatttcgggccagggggggggggttgaatagggcgatacgagagggtaggatgtggcaacggggaagagggaacggtgatttgtggattaggggatgtgggagggggatttgggattgggggggcaagggggataagggggatgacgggggcatgtagggaggcataccgcccgccccacggggcaggggggctggagtgtacccggagtgaaacggcgcccacggacggatgtatatatactagtgtgtatgtatatatgtatatatatatatatatatatatatatttatatatatatatatatatatatatttatatatatatatatatatttatatatatatatatattcctaaggaaatgtatgacagtgataaattcaagatagtgtttacctctgagggagagtttctgttaggaaaggggtttaaacatatctttttgttcagctggatggaggggtcacagggctgtttttttaataagatactttgtatgtttgaactgtttaattttttttctttatttttgtaaggaggtttttttgtttccatttttgtatttttgagacagtgtttctgttgcccaggctggagtgcagtggcaatgatctcagctcactgtggtctctatctcctgggctcaagcaattctcatgcctcagcctccctagtagctgggactacaggcatgcactaccatgcccagctaatttttttttcttgtagagacagtgtttcaccatattgcccaggctggtcttgaactcctgggctcaagtgatctgcctgcctcagcctccctaagtgctgggattacaggtgtgagccactgtgctcagccgataatttttttcttttctttttcttttttttttggggggcactgtctctctgtcacctagggtggagtgcagtggtgcgatctcagctcactgcaacctttgtctcctgggttcaagggattctcctgcctcagcctcctgagtatctgggattacaggtgtccaccaccacgcctggcaaatttttgtactaatatttttttaaaggatcaaatggcacctagcatgtactcagtaagtatttgaataattggttggttctttgtctctgggttgaggtattattatttgtttcttcctctctaagtgtttataaagaaaaagtataaggcccggcacggtggctcacacctgtaatcccagcacttttggaggctgaggcgggtggatcacctgaggtcagaagtttgagaccagcctggccaacatcatggtgaaaccctgtctctattaaaaaaaaaaacaaaaacaaaattagccaggcatggtggtgcatgctctgtctcaaaataataaaaaaaaaaaagtatgaatctatatggcttttggtggctaaatttgacattaaagtctgagctcacccttgaacattgagacagagtctgtgctccatatatacaccccatctgccacaacactgctagaggcacgcgcctcagactccttttccctccgagtgactcagccattcccccgtctctgtataggtccctgtccttcgaatggtggaaggtgataccatctatgattactgctggtattctctgatgtcctcagcccagccagacacctcctagtaagtaatgtttgcctccctgctcgccgccccaccacccagtttcaagcagggcctcttgggagagtcaagggctgccaggggtctttggaggaggaaggcttggcatgcttatcagaggggctggtcagttggcttcctccccttcctttttttttttttagattgagtctccctctgtcacccaggctggagggcggtgatgcagtctcagctcactgcaacctccgcctcccaggttgaagtgattctcctgcctcagcctcctgagtagctgggattacaggtgtgcaccaccacacccagctaattgtgtatttttcatagagatggggtttcaccacgttggccaggctggtctcgaactgacctcaggtgatccacctgccttggcctcctgaagtgcttggattacaggcatgagccaccacacccagcctcatttttgtatttttagtagagacagggtttcaccatgttggccaggctggtctcgaactcctgacctcaagtgatccacctgccttggcctcccaaagtgctgggattacaggcatgagccactgtgcccggccattcctccccttcctttgacagcaccggggtttcagtgtccatgtctctctcagcgtggccagcagcagccgggagaacccgattcatatctgggacgcattcactggagagctccgggcttcctttcgcgcctacaaccacctggtagggaccgccatactcagccccagcactcgtactggcccggctctccttccttgagggcagctgaggctttgcaagacctgttttcagccctttccttcccccaggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctgggagggcaccaagggggcatcacccacctctgctttcatcccgatggcaaccgcttcttctcaggagcccgcaaggtaggggtcacaccctgagagcccaaagcagctgggcagcggggcaggagcagggatgtagtctgcagtgtaggggaatgggtggggatggggaaaaaatcccaagctgaaggagtgcctggagaccccgagggaggcagggacatccagggctttgggggtgactccaggtcctgttccttgtctccaggatgctgagctcctgtgctgggatctccggcagtctggttacccactgtggtccctgggtcgagaggtgaccaccaatcagcgcatctacttcgatctggacccgtgagtggctgtgactccttcctacacagggccctgataagcctaggaatgccagagcccagctgtagggtcccagtccctgggtgtgaggggttcctgccccaggggtgaggcctctgccagcaaatctctcctctctctcgcaggaccgggcagttcctagtgagtggcagcacgagcggggctgtctctgtgtgggacacggacgggcctggcaatgatgggaagccggagcccgtgttgagttttctgccccagaaggactgcaccaatggcgtgaggtcctcagttcaattccagagatgttggggcttgggttggggagggaggtgaatcccagagggagcaagtgtcctcactgaaggcactgatagaccctccccatctctccctcagcctgcaccctagcctgcctctcctggccactgcctccggtcagcgtgtgtttcctgagcccacagagagtggggacgaaggagaggagctgggccttcccttgctctccacgcgccacgtccaccttgaatgtcggcttcagctctggtggtgtgggggggggccagactccagcatccctgatgatcaccagggcgagaaagggcagggaggaacggagggaggtgtgggtgagctgatataaaaaggtttttatgatactagagtcttcgtgtctgttttgggggggcatatgagtgaggtgggggaccaggcagggggactggcgggctccctggtccagcagcagtgggtatggcatattggtcctgaaaccaggcgttgagaggtgggaccaggcaggagccaatggggcggctgagcttggtgtgaagtcaagtgggtgggggtggggcttcgtgccattgactggttggttgctaggcaacttggtaaactgaagggggaaacctgtttgaaatctcactcccaaggtgggggcggcaggggtcagggtgagcggggctgagcaggagctgggtcagactgttgggtgtgaccgtgtgagactgtgcagacagtgacagggcgcctgtcgcccacactccacactgtttgccattctccagcagcatggggaccattactcagctctgaggggagcaggagcactctcctccgctccccggggctccccaggaggcagacaacccagttgccagagtcaaggacacacataaaagagtaaaggtgttgaaaaatacagtcgtcacctttgatattgctgttccatgcggggcgcggcgagggtcttattcattcagcggctgtcgctgggcttgtttctccatttgtctgctctgtctttgggggtgggggacgagtgtgtcatttgaagcagtgactcctccctcctccccccaacaccttcccaaacactgagaatggggggactttgaagaaatactgccagcaggggatgtgattttggacctcacaatcaaagggaagggacgaaaggcctggggaggcttgagagggagaggaatgtcacccctgcccagaggtgctgaaagccagggctcttacacccgaaaaggcaactcctcccttcccccaggataattggaaacagcccttcctgcgcagcgccggtttggggttgtaggtacgccccttcttctcccagccccgcttctccccccagccatctaggaaagacccaagtgtatcccctaaactcttgtttttcactaacccccaggtaacaacagcacttggtccatggagcagtgacaaaagagaccccaagagtgggaggtgcgcagcctgggtttggtttctagctttatcccagacttcctgtgtgaccttgggcaagtcacggggcctccctgagcctcagtttcctcatctctgcaatgggatcgttagctctgcccctcccacttcacacaggtagtcgtgacgatcagctccgccgcactttgtaaagcgccaagccttcaaggttattattattctctccaaacctgccgggagcagcggtgttgttttgggatggaggaggaggctgcgggagcgaaaggggtgggttcctcggggtggagagggcgagagcctttctggattcgagagaggaagattccagcagcttgggcgatcggagggcaggaggggagccgggcagaactcagccggagccagaggctcggagagacaaagggggcgtgacagcccgcgccgggggctgaggcggggcggcgggcgggaggtgcgcgaggtgagggaggtgtggggggcgtgggccgcgggatgctgccgcccgctccgcctcgagctccagctccggtttttccctccaccatcctctgcccctccccgcctctcctttaactcccccctcctgggctcgggactggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggtgagtggcctgcggctggggagatcccagaccctagggcagtgggtagggaagctctgggggcttggaggcgggcttctgtgggcagggaggaggcgggagggaaggtgctggtgctctgatgtgtgatgggttactagacaggtgatcttgggagccagactccgggtcccacgcagagctggatgcgggtggtgctatggatgtcaggagtttggagaccccaaaggggcaaggagaagaaagttcatgggtagccgggagggcagtgaggtgggtatttggatctgtgggaggcctgcgtcgggggctgggcttggagggagcctggttactgtcagctctcaggagagagctgcagattaggtgctgcgagtcgctgaggggaaggcagggcagggtgcctccctcccccagagggactgcgcatccgagatgggaggcaagggggttccgtttgggggctctggggacaacttccccaaggctccttgactctcttcacagtctgtctcccaactcttccccacagccagagggtcagtgaactgttggctgaacgatttcccagccagaacatattcctgccttcctggcttgccggcatcttgctggaagaagcctggagccccctgaaccctccttccttcccttttgcatctggaggactccattgccccctcccccaatctttgctgcaaactcttccatcagaccctctgttccatggcatgccagctttgctctgaaaagaggccaggggtcagatgaaacttcaagccacgctgggtaggacagaaccttcgggaggtcacctgggtcccttgcctacatgcggatcccacttcccgctcataaaagagttctgtgttttgaaaaattcctacttccctggggagactgtgtgaggccatgggaagggggtgggctttggagctcatcaaatctttggtcttaatcctagctctgccgctttcagctgtgtggccttgggcatgtcacttaacctttctgagtt

SEQ ID NO: 11980 - DNA, 125188 bp, Human
  misc_feature (1)...(125188): n = A,T,C or G
gctaccactctccaaacttccacccatagcagacattactaatcagtcacagctcagagcctggatacagccgcagaagccttctcagcacagcactccaacaatcactaatactcagaatgggtttattagatgaaacctatttcccatccctgatttgactgttaatggatgcttgttgggctagaggagatgttagaaagtgtgtaggtggataagtgaatattctgggcctgtgctactgccatggagaaaacgggcaggctggcaccaaagggagtttgagccagatatgtcctaggtaaggtgaggcagaaggtaggggagagattggagtgcccctcctcactctgccctaaaaggcacacatccccttgacgatgtgacttggttgcggtcttctaaacctagccaagagagactggttccttccaaaatatttcccctaaaccataactgagactacagaagaacgaattgttgggagacctgcactccaagttcaggcgaggtcaagagaaacactttgtaaagtacatgcccacttgagcgagggttgcagggccccaacctcagccctccaggccttgtgctgtgtaccttagctccagtgttgagctgtacatgggccttctatgggcaccatcttggttcctacaccctgggagctctaggcattctgtccctgatggcaaaccttccctggtaatcgcacctttaagggaatgttccagccctctagtcacctgagagcctgctgactcccctgcccttcctcttgccaggtgacctcctccctgccgacggcctcttcatccagggcaatgacctcaagattgatgaaagctccctaactggagagtctgaccaggtgcgcaagtccgtggacaaggaccccatgctgctgtcaggtgagcttcagcctgatgttgggcccattcccgtcgccatgcacaggggatgcctgtgtgtccccttcatgaggctgaagggactcagagactttgatccttggctctggtatctccagccagctcagccccaagtgagaactcccttccttttctctcacaaacacacattgagcctactgtgcactcagcaaccccagccctggggagactgcggcgaataaaatagacaaagcatccctgccctcatggcattggccttctagtgacttggtttactaaaaagctgaacaccgaagcccactctcatcagagatgagaaagaatcagtcaggtgataagcattctggccaccagctgtgtgccaggtactgggcccggcactaaggctgcagcagtgagtgaggcagggaaggcccagccctgaggagcttgtggcggagtgaggagcagggaggcgatgtgaaaattcctgagcagagaagtgtgtgaagaaaacaaacagggcaaaggtgtgctgagtgtgggtgatgaggaggagctggccttgtgactatctgaggaagaacacaccaggcagaggaaacagcaggggcaaaagcccagaagcaggactggctggaggctgcagtgaaatagagagagtggagaggccacaggtcaggcctcatgggccatggtcagcatttggaaattactcccagtgtgatgaggattctctgaaacggttttaagcagtgagctgatcatgtttacatttttacaagctcactcagctacaggggcagagaagaggtggggaaaccctgcaggggtgagacactagccaggtgaggccccttttcacagggacgcccaaaaggccttattgtccagcagtgctcagcaaacaccctctgcaaagctactctgggtgctcaggccaagtgctgggactatctccacccccaacccaccagtgattcaggcccagcccctgcccatgggagcccctagcctgaatgtccttggggattcaggcctaccaacagctaatcccacagtagacgtgtgaggaaggtgttgtgagaaagccaaggaaggagcagagctccctggaggaggtggcgttgagctgggttttgaaggatgaataggagctttccaagtccaattgtagagaacgggccctcctagcagagggaaccatgtacaaaggcacagaggtctgaaggagtgtgcaatgtcctggaaatacaaacaggtctgcaggacaggatggtaggagtgagaatagaggtgggggcatttatttatccagcatttattcaaccaacaattgttaagcacatactgtgtgccactggttaaggaaacaaacaaggtccctgctgtcctggagcttagaatttagtaaaggagagaaccaataaagtaataagcaagcaaatatgcaaggtaacttcagataatggtaagtcagatgaagatgttccaccattgtagtgaggtatagagacctgcaggaaaggcacaggaatctgagttcatcagggaagccctgtctgaaaaggttgcatttgacctaaaatcagaacagtgagaagaaaaaagtattccaggcagagagatagcaagtgcaaagcccccggggtctcactgagagaccgtggaatgccccaaatgacctcttagaacatagggccacatgagatttcaataaattgttacagccctgtggccctggtcctgccctccgggatgaagtggttgacagacagagcatccttgggggcagtggccaggtatgtcctctggatatgtggaagcccggggcaggcatgggcctaagaagatggaaacttcagacagtttggggaagagggaaaaggggaggatgctggcaggaagctggagagagaatgttcagaatcactggcctgacagcatcacaaaccagccaaggaggagggcacaggtgcagagagaccctggaaaagatacgacgggcagagatggatgggaagccaaccagccagcctggagtgagtcatagggtggccgggtctcggagcaggggcaggagggcccagagggaacagaggtgccaaaaataagacgatgctgaaggcagaggatgggagcaggagatttcaggacaagaagcataaggggagagtgaggaggtgctttggggagcttggggagctctctggctgtgtgtgccaactctctgtcaagaagcctcaaaacttggagaggccggtgtgtctccagggaggccagaagtcccaggagaccaagagatcctccaggagagctgaggcctgcaggcccttggagactcagaagggagctcaccccttagtggggaaggacaaggggactggggacagacagaaggcattccatgtctcagcagggatcccagtgagtcccgtgaagcctgggctgctggggtcagcattggttttggcaggattcccagtcatcttggaatggtggcctgtgagcactgagatgagaaaggggtgactgcaaaaagccactacaggccctctgagcccaagctgaaccagcggccttggtctccatctggctggaagcctgggttgatggaagacgcctggggcgtctagatgtcaggagacatcagccaaggtctccaggatgtccttgtgggcaggaaggagaggggcatgcgggaacctggagatctcagtgggttcgtgctggttcttgggtcgctggtaatctggtggatggtttctagtggccttccctggagctctatcctgttgcaatgtgcaaagtgttcccatcagtctctcagagcccacaagcacaagggagtggcaaaaagaaagcaagtgtcaggatccagaaagatgatcacaggacacaggatgaaccagatggaagaaagtgaagctccttggcaagcctgaagccctggcatcagaaatgcaattgcgtgggagtcagcagggcaaaggagtgtggctcagctcaaactcatagggagaaagtgataaaggggcatagctggctccatagaaagcagtataattggaaagagaattctgtaacagttgggaccattatcagacaaaagaggctgcctgtaagagagtgagttccccgtcaccgactgtctatgagcaggatgtagacaggctgcaggtggggatgttggagggtgacctactgaatgggcaccgcattcagcgcccctcccagccctgagagtacattcaccatgccctgtctgccactctgcccccaccatctactgatccaccttgtcttgctcccttcaatctgcctctgctgaggctgtcctctcttcccagtctcatttcttcctctttgcccacttaacttttttccatctgctcaagccccacctcctccatgaaggcttccctgaccaccactgccctgtggcagtcaccccctgaccacctgggacccacttttagcctgtgacactccactttgtgcttgacccaaacagacacagcctcgtcatggtgtttgagttttgcactgcacaaaccatctcaaataaaatgaagaacaaaatttgtcgaccatcccaccacccaaccggatctcactggtctcacttttataggccctgctgtccttggccacatgcagatagacgacactactatgtagtgtcatttctgcaacaatcctcttgcccacgcaggtctgagcagccgggagctctgaactggaagctctcaggaggttgtgcccagctcacccctgggccctgcagaccttaggctctgtcctccagaggcagtggggagaagctgagcagagtgtcaggctgagctgaacaggacctgagctctcaagcgaacttgctgtgtggcctcaggcacatggcttcacttctctgagcccatttccctgggaggacaataggagtgtcattcatgatatgatgtaagtggatcccctagcacagtgctgcacagggaggctcaacatgagttggttcccttccccattccttgggtgaggcctggacttgggggtgaaacagactgggttccaatcccaactctactccttagccagggacccccaacaagcttccccccctttctgattatagccccagctcatgaggttgtgttgaaatctggaacctccagaaatgtccatttcgccctctcatccttcatctcaaatgtctcccctttcccacctctctgggctacccccttcctcttcatcatccaactcctccctaccttcagcctgcagcagcctgcctcccccagggggtgttccttgattagtttcttccccagtgttctgaactccctgcataacagccatttggatgctcatttttatgcacaaccagacaccatgggccctttacatcagcggggaggccttgctgggccttccagtctgatgatccttgaggaacaacacagagagaccaggctgggggcatttgtggtgtcgttatggtggttgagaaagccctagtgtcatctcatgcactgtttcagcttagaagagggcaggaaacactccgctctggtcagttggtccaaccatgcttggcctgtgaccctggacaggtcccttcacctctctgagcctctgtgtctgtgtcagtgcaatggggaagctggtgaggcctccactgcctgccccacagggctgttgtggggaccacaggcatgcacacgtgtgactgtcctttgcaaacaaaccctgcggttgtgaggtgctgtatggtgtggaaggaatgtggcatctggaggcagaatgcccaggttccagccctccaacagctcccactgtggcctctgcccctcagaacctcagtttccccatctgacaagtgagggcagaccagccttcagaaagactcaaatgacctcaacactcagggcaccaaggaaatcatcaaaaccaggcaggtttcccctaccttcctaccctccagggacggacaggcagacacgagcccatgtctggtgtatcttcaaacgggacagagtaaaaatattcagaaattgcaaactcatatgtctgcagggccaggtagggagagcacaggtgccaaacccaaaccacagctgcttcctgttgctgcctgcagaagcgccagcccaatctgacctcagtgctcactttgcaagaggagccagaaatccagatttccctgtaccagctctcaatgtttaagtattggcaagaaattcccacattttaaggtccctatgggtcaagccacatatgggtgggacctagagtgcaaactctgacctaggcctattttttagctttgtattttaagataatttcaaactttcagaaaagttgcaaggatggcacaaagaatacgggcatgcccttcactctgattcggctgttgctaaccttttgccgtctttgctctctgacaaatctcactctcctcctcatcatgcagatgtgatggccttctcccgctagacactgcaggtgtgtctcccaagagcaagggtattctcatgcataaccacaacacagccatcaattcaggaaacttgacattgattcggtactgttacctgctgtgccatccatattcacattctgccaattgtgcctgcagcgttctccaggccaggatccatgtggggtcctgcatgccacttggatgtcctgcctctttggtctcctgcatggagcagcgcctcatcttttcattgtcttcatggaaagccagtgttttttaaaccctcctaggtcatgaacttccgtgagagttccactaaagcagtgacccctcttataaggaacagatgcccagactcctcatcttgcaacatttcaggggattcaatgatccctagaggaccctggtcctatcccaatttgcagctggggaaactgagacccagagcagaagtgtaaggccccacagagggcaggggcagggcggaagccagaccccagctctgggctcttcctgtagcccccatgcaggagcctgcctccttgtagtaacttccactgggaaatgcaggactagactagatgccatcaatgtggcagtggaaggggctggagccagggggccaggatggcggggctgtcttcaaaaaacagcaaggcctggctccagcaggcccgatggctcaacccccgcgagaccccgacacaccctcctcccttccccctgccagccagagcactaacagcatgaggtcatgcaggacatcggtaaaccctcttgggactctgcccacatcccaggacctgctgcccaccccaccaagcagaaggccaggcatgggagagccggacctgccaccactgccaccgtctccagggagcctaggacgacaccgtgactgcagaaggcccagtctgctactcggcccgcactctctccattacactaccctgcctcttctccatgagaggcagcggggtgtagtggatagagcacgggttcaagtcccggctccaccactcacagctgtgtgaccctgggccatcactcaagctctctgagccagaaagtggtgggtggaggggctggggattgaacttgcgccaaaacctacctcagggggctgttgtgagggggacactttgcctactgcctcgtgctctgtgagcgtgtgttattaactgcattaataacaataataatggaaggactgtgtctgggctgggaatcgttttggctttgtttagtgcttgtgcctggaggcagataatagcccccagaaatagcctccatcccttcttcacagcctctccccactgaaggaacccttttagaagagatgaactctcccctctccctatccagggagaggcctaaaaggtcacacgcaagagatcaaggaaccctaggtccagcccctactgtcctacaccctctgcaacttcagtcattcgccttatctgggctcagaaaccccattttgtaaaaggaggcttcccagttctgctacctatggctcagcataccccacaagccacagcagaaggctttgactccgagactgccaccatctagaccagctcagggcaagggaaagccacctcctgctgttcaggacaggcccaaggccaggatgggctttgagcctgcagctgggaaggtcctggccactctctgctgccacgtcagagaccaaggaacatcccctccacaggaccaggacagggacagaagcttgggcaggacaggacagacagtaccatccacggaaaccacagtgttccctgagcctgggctcccatttcctcccactcatgggatagctggcagctccccaccatgctctggcccccctttctctccttggggctgccccagacagctctcccaccaactttgtccacaaggtggaaaaagcacaagattggagccacagaccagctcccatcccagctctgccttcctgggctgaatgcagaggtgaccccctgagctgctgccctatctgtgaaatggggtgaggctgaccacctcacagactgtgacagctgagcgaaaagtggctcagatggaacttggcacatcatgaatgctcaaaagatattctcttccttcctccccctccacccaaaaatactctcagcggcttcctattgaacaccaagcaaagactccactctgtcaccctccactcaggcaccttctcccttcgtgggcgctgagctttggcccggcccgcccgctaccatcacactggaccacctcccacctttgcctggctgtgtcccttccggcccgccatgtccttggcttggttttgtcttgcattgctctggatctgtgtgcctatctgctctccttgaccccagctagactgtgagctcctggagggcagggaccacagggggacctctctcagacccgagagcctggcatggagttgacaccccaccatgtctgtccgtcaagtgaaggactgtggagctggggaaggggggcgccatctggtcattctgtccacacgggcctctgccggcctctccacaccctcttcttcccgagatgtagctgtccaccctacccaggacatgccctaggctggtctcccttagacagtgtcaagacactattgctgagatatggggcctaagccagctccctccccactctacagatgacaaaactgaggtccagagaggagaggggctggccccaaggtcacatagcaatcagaattagacaccatgtcccaggtgccctcttctgggtccagggctctctctctacccctccccgtgcttgtattctgaagggctctgtgggcagttagaggaggtgggggctacagagtgctgcccaagggactgtggacagtgaggtcccacaaggccctatcagggcctccatccccaagaggttcccacctctgcccctgtggtcgtcctttgagaggtttagcccactgcgctttgacttggatgtctgttgctctgccattaattgcttctgccatggtgttaagcattgccctctgcaggggactcgtggagctgaaggggaacggtctagggaatgccccagtcctttggagtcttcccctggcaggagggcctgggagaggacagggcacagcccagtgaggtgtggcaggagggggcacagctgggatgaatgtgaccctctgcaaaacataaagatgatttattagggacattggtattcccaattataaatgtaatacatacccaccctggaaagttcaaaatagtacaaaaaattgtgctggagttgcagctccaaaccaggctgtgcgggggaggcccagaggacactcccactcagacactgccttcaaggggctcatggtcaggttgaggagccaggcctggaagcacccccagaggagacttcaggtgattcagaggagacagatgaagtcccctagtgggagtcaggagggctacccaaggagaagggcattcatcctgtggaggaggttgtgagcaagaggtgagggaaaggcattcaggtgatcactgtgagcaaaggccagggaggtagacaccaaggcccagtgaactgtgcacactccaaaggcagaggccacgagacaggactcagtgtccagggccaagaaggcagaggtctcatccaggggacactgactgagtggtttggacctcagggagccctccaaaccctcgaagaagggattggaactggagggagacaggtaagagcagaggcttggggataccggaggacagagggagggaggactggggattgtagatgccccgtctcccctgccctggctattgctcagctctggaggacaccctggggcatctccagggctgggcggggagcgcactatgcctaagcccctccctgacgtcctcctgccacctccctgcctccggatgtgggtgtagagctgccagctccctgctgcgatgggagtgattagattagaaggtgatttgggagtctgattatcgtgggtggaaattggccccctgcatctttttccatcctgtcttgggttgggaggtggggagcagcctcttggttgccacctaagccagagaaccaatgccttcatttccagcgaacctttctactcagagcagaatgtgtctcagaccagaatgtgagggccttgcccctggaggctaagtggaaggtaacaaagacaacaggctcagggacagcagagagttcaagtccaggctctgcccctcacctgcagagtgactcggcagtccacccctccactctgagcctcagtttcctccagtttgaggactagatgagatcattgagcgtggagggcagcatgtgccctgcacacagtaggtgttctacagaggtcagcttgggtggctgttactgctttctgtgccctatgaatgcagcgtagtgttccttcctctcctttgaagagtctccagtgatacccgccatgagaccccagtttcttatctgtctaatgctgatatgtaacagcccctcctcctagcaccctaacaagccgagctggtgcccacggaggcatcttgtcagcaagttattataatgaacaaggccctgttactggccctcagcagggtgacagagcagggtggggtgctccagggtctgcctgtgatgagaagccaccaggcctgggctgctcagcctagagccaatgtctgagctcattctgtggtccccactgtgccctgccaagggggaaaaaaagcactgtccttctgtcctgggaatggccaaagagcttgccatctgagaatctgggttccgcacaccccctctgtgagccttcatgacttggtttctgcatctgtgcagggagaggctggcatttacgtgcctgaaaggaatcactggagagtgtctgtctctctgtaaagcactttgagatcctgagaccccagagaccaagaggctagattgttgcaagcgcacacacacacacacacacaaaagcatgcacgcacacacacaggcacacacacacacaacatcgggatatcactcagatcctacaaggaaagggacaaggtgggtgataccacttaaaaagtgaaaacagataccttgcttaaggcaagctctttaggtctgacccagaacccctcaacccttattttagatacaattctaatgagtttcctgacatagacttcaaatctgaggcaaaccaaaacacagtgagagataagttatgctgaaaacaggaagaagtggcacctagtctcgaggggacagaaaagagaactctgaaaagcagaagtgagttccagaagcaaggcatggcatgtcggagagtcactgtcatggctgtcaaggcctctgtgacactgtccagccaggccagggtggaattcttactcccccatctgagaaggtagtgtgtcctgcatcatatacagctttctacccagagtagcaaaaaaataaaaacaggaaaaaaaaatgtgtgcctggagagccaaccttccagcatccagattcttccagcaccaatcaaaggacaaaggaccagcagtgccgcattccctcgctgctagaactgggtgggcatagctgctgtctacttcccagactgggtcccagctgtcctcctggggtcacctttgcttccccagtgaggccatggcttcagggggcttttttttccaatttttaaaattatattaatagtaaaatacacataacatagaatttaccattttaaccacttgtaagtgtacagttcaatggcattaagcaccttcacgtttttgtgcaaccatcaccaccatccatccacagaactcttttcatattcccaaactgaagctctgcacccattaaacactaactttcatttcccttccccagcccctggcacccaccattctactttctatctctgaagctgatgactcaggggacctcatgcaggtggaatcatacagtatttatggtccttttgtggctggctggctcacttacttactgcagtatcctcaaggttcatccatgttgtagcctgtgttcaagtttctttctctttaaggctgaataatattccattgagtgtatagaccatatttctcccctctcttcagcttatcctccctctgaagcccttgcttgctgttggacaagttgctctctgagcctgcatggtggagaggctgcctgcaagcagcaacaaggctctctcatgaaacaatagctgacactgaagccccaaagataaaacaaataaaagtagagccatcctgaccaaaggcctccttcacccaccatagccacacttccagcccctggaaagaatgtcagggtcctttggaacccagtttgagaaatctaaagttctaggaaagtggttcttaacctttcttgcagcatagacccctggagtagtctggtatcatcatgtgccacacctattccaaataaagccttgaaatgcataaaatgaaatgcatgaggtcccacaagatcccactgaggtcacaaaggaaaccaattatattggcataaagtagaaaaaaaatatgtggtatagtaatgagtgtactttattagaacactgaataacaagatctagcaagcagttgcataaccactttatttataaaatagagatgagcaccaacaatgctgcaatagctgtaaagtgatatgaaaaaatctgtgatttttgtaatgtgtgtagtggcatcatggacactgataacactcctggagtttgatgtctacatctgtaagggtggtagaggagtggggagaaggagacagaaggaggaagtgaccctccagggcaggtagtaggtggtgggcctggagatgtttggggtacctgagaactgataggtagcagtgtttccaccccagcactgtcctgaggtgaaagcatcttgaaagagcccaccacacacacagtgtgaatcttaaccataggtgatgccccatgacctctgcaggcaaagagccaggagctgactgagaccacattttttcactcctttggggagacggcttcaaccatgcaatggtaacttggcttttgtcccctttcccaggaacccacgtgatggagggctcaggacggatgttggtgactgctgtgggtgtgaactctcagactggcatcatctttaccctcctgggggctggtggtgaagaggaagagaagaaagacaaaaaaggtaagcctaatccccttgcagaccaggagaggagctcttaaggccacattttttttttgtttatttgttcactcaacaaaatagttattgagtgccttctacgtccgcaccctgtgctgacagccacctcctgcatccttaaggcctgcatgggccaggtaggctctgtctgttccatctccaggtcttgtcccagtctctgtcttgtccaatcatgtcatggaggcccctccttcccctccgggccaggccaaggatgctgaccatgttgttgagtctccagcctcaagtggtggaaacagccagcatcaattggtcccatcatcactccagtattgagtagaaatccccacccattggaagcatattccttccaatattgtcaactccactgagcagaaatgaaaatccacccagcatagattcatccaagacatgggcagaggagattctgggaaaggtagccagatgcatggctccaaatcaaccattatgagtttactctccagtgctcccagacctaccatcttgtctgagttctgattcttcctcctccttgaaaataagattccttattcactgggctctcctcaatgcagcgagctgaccacccaggctaaaactgtctctcagaacagagggaaagatgctcaaacaaaaagctcaagtctcttcaggccaggcccaaatccaaaggcccaggcttctggtcccagcacagctgactccttacctgtccccacacttgatctcaaagatagcccccctttcacattttcagtcttttgtctccttcctcaagcacaaagggaggatctgtgacattcagaacttctagaaccccagaagggaaatgagaggacagatgcctcccccactgagttttaggggcagccctgctccctccagctctcagaggctaatcaggcacagagcttaggtcgagactgaagattacttgttcctgaaggcaaaatccattttctagggggtcccctaagattatggtggcccctccagcaggacaatggggctgagctgtgttctgggaaattagaaggctggagagagtaaaggggtgctgaggctgaaactgaggaaagagtcgtgactaagagtcccagaggacataaggagagtgtgcacatgctgggtttgaatctgtggtaggatggctgagccctattccacaatgatagcagttaggcagatctaagcaggtaggcaggatgcagcagcctgtactcattgtcttcacctcactgaggcttgagtgaggggaagacgcccccagactcttctatgggccagatctgtggtttttaaaatgctagcagggccagatctgtggtttttaaatgccagtaggaagacaagtgtcaactgccccagaagcacagttcagggtccttcgctgagcatgcacctgcactcctgtgagatggagatgtcagaaaaatagcctcatgtagaaggaagatggggaatgtggaagggatgtggcagaggaagcctgggggagcagtccagcatctcaggccaccatgagcagcatggcctcagctgggccccctctgccctcccatcccatcacctccactaggaacattgcttagagcccgccacatgtccccatttcaggatgaccctaggtgtatggccatgtgtgtatgcacatgtgtgtttgtgtgtgtgcgcgtgcgcatgggcagatgaggctgtgtgcttctccttcattaacatgtctcaaaaatcatcacacaggtgtgaagaagggggatggccttcagctaccaggtacagtaagacaccctcagggtagatgggcttttagaaatagcagcaggctttggtcattgggccctgcccctagaccaccagcacacagctggaggaggccacatgcctgtgggtggctccaccccccagaccctcctttgtgccctcctgtgatgccagccctgtgggacaagccaacaccccactccaccctcttgcccttacagtgcctcaccctaccagccaatgccaagtggtaccacccccatctctacaccacccttagccctgcgtaccagcatgcaaagcttgctcaccatcataggaccctcccctcaggccctgctctccccaccagcacccctggggagcccatgccctcacgcaacagtgtgcttcacccagtggggcctcttcctgcccatagaacactattccctacccacaagaaagagcaaaaggtgtgaatttagccatctcatatcacttttaatttctaaattaagaaaaattcactagtgccttttccatcccatatacaaaatgcaacatgcttgatgtcaccttttaaatttggggggcatctcacatgggagttcccaaagcagtctctggaatgccagttaaggaaggaggcaatggcctgaatcaagggcatgaatccagttaagtcaaagtcatcaccattagcaaatgttcttccagaacaccctgatgcacagagatggtggtcatggagaatactcattctgagtggtccgtgcccacgctgcactgcctagtgaatatttttccactcctggcccccaatgggcagccagatctcctcatttcatggagccctctcttccaggggactctcttgactggttggaccagcagggtccagacctcagcacagaccagcaccatcccagctaaccaccctggtcatccaccatgctttatttgaaagaccctccatgtctgagtttctcccctcaacctctgcggcatctctatggaacatttcacccccaccccaaatttgagtttcttggtttccaaaggataatttttttttttaagaatagagtcatgttatctccccacaagttggttcatgtctttgtcgttgttgcttttctccattgtgacactgcattttccatccctcccacccccctgcagcagcagacggtgcggcagcttcaaatgctgcagatagtgcgaatgccagcctagtcaatggtatgtctcccacggcgagctcctggtcatggttggatgggcgtctctcacccccaccccaactttgggctttctttccttgttctggactgcacagatctcggatgtgcatgggccgctgggacagtcaccttctcacatggggcaggcgcttaagacaggagccacagccgggggagtcagctctgcaacctgtcagcctcacagctgccaaaaaggtgctggctcctgtcgagcccttgactccccatggagcccagataagagacgagactttggcttcagattggctcccaagaaggagcgtcccacctggcatggccctctcctaagtgtattcctggccctggctttgggaagaaggcctgggatcagggcttgggctgaagctggcatctgggtccccagcaaaggctctagtcctcgactctaaaatttcctcgaggcaaggggacccaggccgggattcagctccttggccctgtcctgtagcatggctgagccagcagtaaacagtttttcctcttctctttcacggagccaacgggcagggggttcgcttgggctcgggcctggttctgtccttcggatgtggactggtgtttcttgctgttgcctgtgctggagcgtttgtcctgggtcacaggggtggagggtcggggagaggggctggcactgtgtactggtgtctgcatcttaatctccttacacgcaagcaagaaggagttccattcacttgcccccaaagcctttagaagatttcggatttctatccccttctggcttcagagcaacagacagggcttttgtttactcagataccacccctatccccaaataaagtgacataatagtcccccaggctactcctgaactgttgagagccattagggctccatcatgaaaacattgccccagaggagctgagggcaggggaaaatctttttcccaccgtctctgcataccaggcactgggctgtgggtttctcatccattatatcatatcattcacttctcaccactcctgcaaaatatggagacttgttccccgcagcctcccatcccctgccctagacctctccccaagccacctgcattcaaagtgcccaaagatggaagcacctagtaggtgtcggggctgagtaaggcacttctgcgagcagtgccttgccaagaaggactaattctggtatggctctatttcaggcacaggaggaggaaggatgacagcttggggagtgggaggtgtcatgcctcagggaggggtggctgagggtgacaaggagaacccatgtgggcaaacccatggctgagagagaaggaacctagagggggcacccacttcaccccggcagtgagcctgctgagctttgtgaacatacagaccccatccaggctggccagtctcagaaaaaagggcagctttacttccagactgcagcagaaaaccccaaatatcccaagagaaactgtaggaaacgttcatttcttgaccacctactgtataccaggcactgctgaaagcatttcatattcaccatctcatttaatcctcatgacacccccatgatacaggttttattgtccccactttaaagatgaggagactgaggctcaaggagaccaagacactagcctaaggtcacagagctagaaagtagcagagctgggatttgaacccagaacccagacctggctggctctaaagtgtgtgcttctcctcctgatccaggatttcccagtggagtgtgtcttgtaagtttcacaaggatgttaagagggctttaccccaagaaaaggattctgtggtcaaaggtgtttgagaaccactggattgaattgatctcttcctggttacagaattagtcctggttacaggactgctcagagccttgaatatgctggtgtgtagcggagagttacagagtcacatagagtttcctaggctgatttgactgcaagacctttcctggctgaatcctgtggaattggtctgccccataatatactctgggaaataatgctctaagccattgctattcaaaatgtgatcacaggacccaaagcctgcacatcacctgggagctccttagaaatgcagaatctcagttttttattttattattattatactttaagttttagggtgcacacgtaccctaaaacttaaagtataataataataaaataaaaattaaaattaaaaaattaaaaaaaaagaaatgcagaatctcagaccccaccccagaccaactgaaggagaatctgcattttaacaggctttccagactccaggtgagagcacattacaggtggagaggcacaaggtggaaccttgccgattgagagagaattaagtgttctttcccctccttcctctgagccagatcacaatgacttggatatggaaaaaaaaaattagggtgataatttttccctttgaccctgctcccccaagcccccaactgaaaaatgggtgtggtccattcatcttggaagcattatgattgccattattatttagttatttttcttttacattactagtgtgtcactatgtaatacatgacctgtaatcatggttataatcacagttaattatacatcatgaggccgggcgcaatgactcatgcctgaaatcccagcactttgggaggccaaggcaggtggattgcttgaggtcaggagttggagaccagcctgggcaacatggtgaaactctgtctctactaaaaatacaaaaaaaaaaaaaaattagccggtcatggtagtgggcacctgtaatcccagctacttaggaggatgaggcaggagaattgcttgaacccaggaagtggaggttgcagtgagctgagatcatgccactgcactccagcctaggagacagagtgagactctgtctcaaaaaagaaaaaaaaaattatacatcatgggctgggtacagtgcttcatgcctataatcccaacactttgggaggccgaagcaggagaatcacttgaggtcaagagtttgagaccagcctagacatcatagtgagaccacatctctacaaaaaaaaaaaaaaaaatttaattagctgggtatagtggcacacatctatattcccagcaactcaggaagctgaagtaggaggattgcttgagcccaggagttcaacgttgcagtgaaccaagatcacgccactgcactccagcctgggcaacaataataataacacattactactaactcccaacgtttacacagtgattttccagtgcctttcataaacatcaccttagttgatatcagcccatttcacagaggagaaaatggaggcacagggaagagaagtggtatttcccaagtctcccaggtagtggtctctctccccagagcttgtgtatcaggtcagcttaccaggaatcctcccaatccatgcacttcacacccatgccctttgtgatgcacagagagaatagacccatttggaaaaggtgcatctgactccagatacagagaagggcctctgagaccccacctgagggctcagtcttggaccccattcctagctctcctgaaatacagcccatctccagatcccacatggggccaaagctggctgttccaccatagttcagggccaggcgagcaccagtttggccaggagagccccaaataagtccctcgcttctgagaaaccaggccatctgtgcctcagcactcccagaacatccttcccttcctccagcatatgcattggtgattatttttctgatcacgtgttcactctggaaataaaagaggaaagtgctagctgggcttaatgagtgcacacaccggctattgcatctgataatatgcaatgcaaataaaggcccctttgagccttctaaaaccaactattgaagtggagtcccctggtgcccctgagcccagtcagtaaaattattttagaaaataaaaataattgttgttattcattcctgcttactctaaaaagcttttttctcttgtgttttttaatccagtagaaagaattttacagtagagacacagggggtctttcactttaaagcccaggatgggcaactgatcctttgccatgggaggccatggggacagctctgcacttacccttgaacagacagtgctgggcgaggttcggggaagccacttctcccctctgagtcacccagaaagtgggcacagtgacagtgatgaactaatcctgcagccatggggctattccgaggatgctcctaaattcaggctgcctctgaacttcccttggcctcagtttccccatctataaaatgagagtgatgaaaatccctcctgccccaccttgcagggatactgggaagactgacaagagatgacacttgcaaaagccctttgaaactgcaaaaggctgaaccgtgcaagtgattatgatgaaggtaactgggacactctgggaggtgaatgtctcatcctgttttatgaaagtggaagcttgatgagattgggagatagaaagccagcagctagttggtggtgaaatgaagacttcaggaaccctgtcgcagcagtgccacctcaacttccctcccctgggctcagaggggctgaggggtgtccatggtctccctgacggcagcttctggagaagcaatggcaggacggaagtaggcacgcactttggggccagctctccatttacccattgagacccaagcagctcatctccctctctgagcctcagtttctcatccataaatgggtataatacaagcacacccttcataggtgaggctgtggcgaggattagatggaatctcagagcttatgtgtgtgcccagcacatggtggtggactgtcctggaatgtgagctgtgagaatcaccattgcagccatcatccaagggtggccaaccttctcagacccctcccaagggggcgaggcctgttggcagagcaggcagagctctgggtgagcgtgcaggcccagtagatgggagggtgctggcgaaggcaggtgtgctaggcaagagacagaggcctccattgcccacattgcacacccagcccacaagctcctggccaaggctggagtgggggcctcccaggcagctctgatgagtcggtggggggcagccagatgcagcaccaggccctggtatggaaggggatgcccacggacactacttagcctgctgctgtagcctgagccatacccctaccaaggggtcagcacccccattggggaccagagcacttcatcaagaacccggccacacttgaggtccctcgtataccaccatggggacccctgatcactctttgttctggtcactctcaggggcattgggcaaggggtcatccttgggtggcttcacactcttcagagtgtgaaggagaaagatcatccctcttgaaggccaaaactaaggaacacattgacctcagtgccttgtccaaactcctctccattctagaaacactctctcctctctctctgtctctctttctctctctctccccctctcccctctctctactgcatgttttcttttgtgggaaaatgaaaaggacgtaactgaacaagcttccctttgccttctctcaacccagaaaacaccaaatcggtcacaaaaagcttggtgtgggggcctgagtgcttctctgctgcctcctccagcagactctaatcccctgcaccctctgatacttccctttgatctgtaacacgctcaaggccaaaagtattccagcagaaacctccctcctgagtcccctggagaatcaagagttgcccggctggcaggccccacagctaaggtgcggccaggcctgctcctgcttcagggccctccccaacccgtatccccacacagagggatgcagtcagcacggcccgcccttcatctgtgacattaatgtctgtggcctgttgcgtcttcgtgatgaccgaccatgtgttgtctgttctctgttgtctgttaaaattctttgtcgtgtaggtaaaatgcaggatggcaatgtggacgccagccagagcaaaggtaacccttttgttttaaccggcgtttgtcgtccctgaggcccctccccaccggctctgacagtcacaccagagacagagactggcaagggccagaggcagacacatccactcctacaggtgtctgacgaccttgggggtgtagctgtgatttgcatggtgccaggccaaataaagaggtgtccaccggtgaggagggggatacccatgggccagcatctccctagcctttgaactctgcgccccattcagctgaagactttgagatccttagaggttgaggggtagggagtttggctcagtctctgtccaaaagggtcacgggccctccagtccatcctgcatgaagaggccacgccaactgggatagtgacttggctcccatggctgccctcttttacgttctaagcctccttttttgtccctcctgtcgagtggctacttaatatcccacaacaggtcccaaggaccagctgggtagagcccaagcctgtctgtcttgtctgaatgtgggaaaggacaagggaccacctagggtaggactcacaggcttgttcaggccgagagggggatccagggtaacagcatcagtccctgctgtgtcccagattccaggtctgaggcagcgagtaccactgggatccatagctccggctggaagaggcaggcccccatcacaggacttctgcaccagccatgcggggctcagtccaggcagtcagcacctaccctgggcaggcaggggtgggtgccagcgtctccaccctgtgggctgacctgcatgtgtgtctatgtgtctgtgtgtatgcacgtgcgtgatctgccccctgcagccaaacaacaggacggggcagccgccatggagatgcagcccctcaagagtgccgagggcggcgacgctgacgacaggaagaaggccagcatgcacaagaaggagaagtccgtgctgcagggcaagctcaccaagctggctgtgcagatcgggaaggcgggtgagtgcagcaggtgggaggcaggggacagggctcacagggggaccccaggcagagccctgccccatgctcggcctcagttacctcatctgcaaagtggggggcttgaatgagtgcctgaagcccacctttctctaccacagcacccagtctgagtcctgtgtacagaaggcactccattagcactcagtgatacagaagagtgaagctcgagcaaatccaaggctctggtagcagacggcctgccttcttgtccggcaatggctgtgagaacttgggaaagtaacttctagctctgagcctctgtatcctcatctgtaaaatgaggataatagttgtccccacttcacagactgctgtgggagttaaaggagactctgcatacaaagcattagcacttggcaggtgcagcagctggagagggtgcagggcctgaagttccaagcaacacagactttatcctgaggacagtgggagccatggaagagacttgagcagaggaagacaagaatgggtttgggctttatcatgaccaccctggccacagtgcagaggaaaaactgaagaggttgaaggacattgccaagagcccagggagaaacccatggtctgagcccccgcacaacaaactgggcatcccaactaaagtggtaactgcaggtgatggctggtgacagccccgctggcccagctgcaaagtgagcccccgaccctctggcacggcctaggcttcccctcccgggtaaggaggtagcaaatgccaaggccttcccacctggctgctcgatcctttgtggctgtctccccagctctaattatagacaccacagcatggggaagggaagcagattacaggcttggctgtctaaatttaaacttgggggcctggtgacagctcccggctagctgggagcttggcttccagcccctccgactgtcagacagggatggagccggctctgaggctccgcagctggaggtgggggtggagagctatgggcccagggatttcctctatcctctataccgccatcgccaccgccacaggcagaagactctatggaaacatggcactgacagggccgggaacgaagcgatgagaacaaccccatggccttcaaagtcctcactcctctccctcctgcacctcggccctgccaagaatggagttcacagtcaagcactcctgggttcacagcccatctctgcctctctctttggctgaattccctgagatgggtaggcaggggatctattgacagggtgctctcaggtgagacctgcaaggggcacaggtccacgctagggaagaagccgggggcagctgagatttccagagaactcccagcctctcccgatcccatgggagctctggagcaacccaaatccatccctgccctcctctgctcaaacctcctccgtgactcccactgtcttcaggataaagtccatggctgcccagaactctagggtctgtcctacctcaaagcagatggctgggctttgggactaacacgtcagccactggatgttggccatcaggttaagatgggagtgcattcccaggcacttcccaacaaggggacccagtcacctgagcaggctcctcctctgtcagagtctgcgggtgtgagcagtctccgcagcacctgcagtagcacctgtagcagatgggggatgggcatgctaaactgaagaggaagccccaggggatcaggatgggtccccagctgcgttcctaccgttacagcatttctcttgcctgtggctgcaagcaagtcacttcccctatctgagcctcagtttcctcatccaaaaaaaagccacctgctgtttcctctacatggaatgttcttccctaggtcaccatgcgactggtgtctgctcaaataccacctcctccaagaagccttccctggccaccctagctaaagtaaccactccctacccctgtcccccatgtcactttctatcacatcatcctggcctttttcttcacaatgtgtcaccatatctgaaactgtcttgttcatgtattcgtttttttgtttcttgtcttcctcctcctctagaatgtctgctcctcaagggcaggaactcttgtcttctttactgctgtgtcctagttcccaaactaggaactaagatgtgcctggcgtgtcataggtgctcaaaaggtatttgtcgaataaatgaataaataaatgataccaacttcacgtcattattgtgtgaaagctcaatgcaaaccattcctcctttattcacacagtcactcggcacacatctcttgagcacctactatgtgtcgagcacatactattgccgagcactatgctgggcactttgcatgcgttattaccacatttgagccttacaaaatcttggggaggaagtatgcatccccattgtacagagcaggagactgaggctcggtgaggatcaaggtctcaagaacttgccacaggtcataaagcaaggagtggcagagctgggaggtgagctggggtcagcctgacccggagctctttcagccaaagatttggtccacaccacccccagcctccacttcctggaaccccccaagcatgtgtccctcacattgcaggcttggtgatgtcagccatcacggtgatcatcctggtgctctacttcactgtggacaccttcgtggtcaacaagaagccgtggctgcctgagtgcacgcccgtctacgtgcagtactttgtcaagttcttcatcattggcgtgacggtgctggtggtcgccgtgcccgaggggctccctctggccgtcaccatctcgttggcctattcggtgaaggtgagaggggaggagagcaggaccagccggctgatgcagctgcagctgagggcctgggggaatcactggggctggtgctggggttgggagatgaacgaagaagccccatagaccccctaggagcttggaagaagaatgtatgcaggaccccaaaactctgacgctttcatagagtccaggggcctgtagcaaaccagagagccataccctggctgaagaggcagctgttattcagcccagccacacgccgccttgcaggggtgcaggcccagcattgccacattgtcacctttttccaagagaagccagaaatctggacttaatgtagactctcgtgatttttagacattgataatcaactcaaaaattttaaaaaaataataaagacatcaccgtgcaagccagaattcatccttaccccaccaaatttacgtagaagtctggcggtctcagtcgtaggccccgcgggcaactgtagcgcttgtaaaactcatcacagaggtggctccctgaagtgtgaggggtaagccaaaaacaaaaaggaagtctgatttcatagaagcctcctccccttgggaaagaggctaaaaatataagaaattttaaagcagttaaatgaagagctggggtcatgaatgttttccggggaagcttggtctgggacctttctaagcgctaccctgatggcagagctgcacctccacctgcacccaggccatgactgtctgcagtgcccagtcactgcgagtctgaccctactgggtcacccccaggttctcacacccgggtctcattttcttccctttgccccatgttttctccacctcgaagggccgggcgtagggcttctgtttcccagtgccccatgccagaatgtccctgcaagggtggaggcgtggccatgtttataaacgaggcattcactctgagaaattggcagagcctccagagggcatggtgagcatcagtttccaagctggaatttgggctgggctctccgatgtaatttcatacagaaaagagatctctagacagacgccagaaagtggcagttctgtgtaacaaatacggcccttatcgtcttcctgttttaaggttcttgaggaaactccatccccacaaaccaaagcccaaacaggccacaacaagaggctactttgggacccagggccagcagagggtgactgttatagagccacgagtagggggcctccacagccacttcactgagcccggggatgtccttgaaagttgcacagagctggtttgggagaatcatatacagatgcttttaggcctctgcgccttctgcagttcgtatctctggcacccgctaccttcgctcatcttaggtagtgttaaagttaggtacttttacagtcacttgataaacttaggagagcaccccaacacaggagaggcagactgtgccctctctgagcctggacctgggagccaccatcaagagcacagagatgactgaccacttagatcagcactgcccaaaaagagacagaatgtgagccacgtgtgcaattttaagtttcctagtagcagccagacgtggtgactcatgcctgtaatccccagcactttcagaggccgaggcaagaggatcgcttgagcccggaagttcaagatcagcttgggcaaatagtgagaccccatctctacaaaataaaataattttttaaaaaagaagaaaaaattcctagtagctacattattttaaaaaaggaaaaagaaaccagtgaagttaattttaataatatacttaacccagtatgtcaaatccaacactattatccaacttattatcaatccaatgtgtgatcactataaaaattataaatgaactactacttttacattttttcaaaatatcctctaaatctgatgtatattttgcactcacagcacatttcacttcagaatagccacatttcaagtgctcagtaccctataggtgtagtcacaatacatgtgactaccgtattggatagtaaggacttaaagattcttgagcccaacagacaaaccctcttcaaagagtacaggtgggctgaggcccaatagaaaggtccaggctgtgaggttaaacggaggtaggttcaaatcccagctttaaacccctccgggtgtgtgatcctggtcaggtcactttgcctagatttcttcagttgccaaaatggattaccagaatcctttcctgtgccacagaattcttaaaacatcggacaagaagtaattcacaacaaggctttgcaaactgtaacatgttgcaaattcaagttgctgttgatcattcaacgtgcgtttattattactattatcacaagttatagtaggagaaactgccagagaatataatcctactaatactcatttttagtaacataaagctctattaaaattattattcttttttaccctggttataaagagttataatgaggagcaaaaataaaggaaatcaaattcctaggcacagcctagaactccatctgattcagctactatgtcaggagggcctgcatgaagaacagtatttccttgagaattacttcatttgcattacttgtttgagagcctagaagaaggtatgagtgtggagttgggccagagagaaaagaaggcagatagaagaaaatattgtgtataggaatattccatttttgttataaatttcaaaaaaaaaggatgttgatatacaagatgtacctagttctggatggtagctaatagttgatatgttttctttttcccttttgtgtatttttttaaagaaatgtgtggtttttattatgcaagtgatatatgttagtcatagaaaagacaaaaatctgtaattctatcacttagcaataatgacattaatactttgatatttttccagatattttcctgtatcctaatttatttacttttggtaaaattaaaatgagaatgaaagccaggcgccagtgaaagataataggtttgagaaaattcatgaccaaataaggaatagttacttatgttagtctataagagaaaaatacttaaagtactcagagagggaaccaaccttatttatctttcccccttcttcccgtaaagaatgtagattacttctgtaatccaaattaataaattcaattaactgagtcctttaaatggttcagatactaacagagaaaggaaagggccacgcgcagacaaaagaagcccaggtataggaggcagcagcaaccaagatcctttacaagtgccggaagcaaaggggcaggctgtggtggctctgccttatttactgcatgtttacccagtgcctccaggcaccccatgctccccagcccctctcctcactgttgccctctcacctgccccttctcccagaaaatgatgaaggacaacaacctggtacgccacctggatgcctgtgagaccatgggcaatgccacagccatctgctcagacaagacaggcacgctgaccaccaatcgcatgacagtggtacaggcctatgtcggcgacgtccactataaagagatccccgaccccagctccatcaacaccaagaccatggagctgctgatcaatgccatcgccatcaacagcgcctacaccaccaagattctggtaagtgtggaccaggcacatccaccacctggagcaacatccatgggatggtacagaggtactgggcaggttgagcaatgtgattcatagtctcaaatcctgctaatatattttggtatggtcagatagtaagcaacatgtttctgtttgagttaatatactattaatattgctacaatgtttgtgtgacaaagaaacctttattgttaattatgctttttaaatcctgtcgttgaacccccactccccctgcccacacacagacaaacattcattagtgtgcttttgctgcatagcaaactactccaaaacttagtggcttgaaacaaacctgtgtatttcactcaaagtcctgtgagtcagcaattcaagctgggttcagctggatggttcttctggtctcagctaggcttcctcctgcatctgtgggggttcatgtggacatctcctctgatcttggcagaactgtaggctgacttggcatggcctcagctgggctggctcatccctgccctgtgtggtctcacctcctccagcaggctagcctgggcttgttcacatggcgacaacaggcctttgagagaggacagaagtgtgcaagtctcttgaggcctgaaccgccacgttatcactttttgctgcattctcttggccagtgtaagtcaggaggccagcccagattcacacagtggtaaaataaacttcacctcttgatgagaggtgctgtaaggacatggattcagaaaggagaataattgtggccattttcacagtctaccactgatgatgttgttgttgctaatagtagtaatattattcattttgataagaaaaactctcaacctactgtctcagctaagctgtctagactcaccatgctgtaaaccctatctggtttagaagcacaggttgcctcagcactagatgaagagaaacccaaacttcatccatccagatgtccatcagctcccagatgtagaacgtttctgccttgagagcatctgggtgatcagctaagcttttttgtttaccctcccaatgtgctgagccctgacctcctcctccttctgcccctgagccagctgcaaccttctcgatcaggctgggtttgtaggagctgctagcagctttatcgaaatggggaagagagcgtgagtcagcagcaaagagccaagggctggtaggggaaggaggaggaggcggctcctgcaccctccacagcagctgagcagccacccgcatcatcctggagcagcaggctaagggaggcagaactgacaacggggaaagtaggtcagaggacccatgcagacagtgatagagaaccctggcggtgatgccaaacatgacgacgtttttgtcttcttcccccaccccacccaatttgggaatcaagggagatcagcgatgctttattctgctccccaggacttcctaaaataactgggatgctgataatgatctcctcctgcagacctggcagagaggggaacagggcgattcccagaacgggcttcagccatgtgggcacagccctgtggggtgggcttggattgagatgtgtgtaatgcaattatagtcaaaaagaattcttgggatctgccaggaaggctgaggaaacctctccacagtgatgagtctcaattaagcagtgctttttagcaccggaggcaaagctgaaatgtcatttccagatgttggtggattgagtcttttcaggtggcataaaggacaggggtcagtcggtccatctgaggaggtcagggacctgggaactggggtccttggtttgtaacccaggccagatcccttacctctcagacaccagagtcccctctgtgcctggaaccctggcatcatagatacctgcgcctgtctttctgggtctttcttgtaagttccctggccacattattctctttgctgggagctgacagccgtcgatgtgggaaggacagcagagcctctgtgtgactgggtagtggttaaaacttggactctggagccagactgccttcgttcaaatccctcaccagctgtatgaatataaacaaattatttaacctcttggtgcctcagtttcctaggggagggggagaatcttggattgttgtgaggataaagtgagttagttaatggaaagtgctcggcacacagcactcagtatgactagtattgttgttattcagcaataaaatcacccaccgaaagaggattccatttgtagcaatgcagaggttaacaaataaagagagcagagacatcagggctagagagggaaaggctattgcccaaaaccattcagccaattagcagcaaaactgacccatggatgccctaaagctagctgctgagtctgatgtccagactaggtttttggtcatagataccaaccctgcagcacctctagcctacggtctgcttgggaagaaaggtctggggtccagaaggtgagattcacagccagggcctgccagccatgtggggcaaaaagcctctcaggggctcccctttctaggttcagatgaagactgagaagaggcccaagctgctctgctcagggcagacatccggccaccctccaaaccaggacaggaaatctagattgcaggacattctgaacccatacaagaggagacagggcaggaagggcatgcaatgtccaccagcttcactacccatcagctttaattgggaaatgagcctagactgggaaaataagaccctgggcagggctgggctcccatatgctgtatttccccctccacaaggaggccagttcctctgtgtcttcttgctgtctgatgccaggctgtgggctttttaagagcaggagacagctgagtcttctctcatcccccttggatagacttttgggaagtgctgggtggatgggtgatgtaagtgaatggactgatggataaatgtgttgatgagcaatcaatgagatgagggataggtagggagaaggggggatggatggatgagtggtgggtaggtagatggatgggtggatggatgaatgagtggatggatggattgatggatgaatgcatggatgggtgtatggatgagtgggtggatgaatagatgggtggatgggtggatggacagatggatggcggttaggtggatggatgggtggatggatgaatagatggatggatgggtggatgtgatggttggtaaatggatggatggatgtgttcattggcggatggatgagtggatgcatggatatattggctggtaggtggatgggtggatggatgggatgggatgggtagatgtgttgattgcttgatggaatggaatggtggatgaatagatggatggatgaatggacgaatggatggatgaatatgtgaatgggtggatgggtgactatgaatttataggagtcttaaggcaggactgatgtctctaccttctaattttttgttcttgtatggcagcaagaggcaggaagttggccttggatccagtcccatggcccataccagtgctctctcactacctccagcttgttgagctggtctcttccacaactaccctcagccatccaggcagcattgatccatagacctcccaattagccgatgtcttttactgaaaaaaaaaaagagtatttgcaaggatagattgcaaggtctacaagactcacaaaccgtagagaccacctagttcagccccctcagtttactctgagaaatgggaagggatttgtcccaagtcaccccatgggttagtgacgttagaatccaggtgttccaatacctagctcaggaagcaatggttaagaggtttggctctaaagtccgacagaccaggttcatatcccagccccaacactcatcacctgtgtgatcctgagccagttacttaacctctctgagcctctgtttttcagtctataaagtgagcatatcattattgctaacatttacttagctaggctcaatgctgagtgctttccctaccttgctttgtatgacaacccacagagtgggtgacaccacaccccaatgcgtagataaggaccctgcagttggagcagttaagccacatgccgagagtacccgagcagatctgaggccaagccaggattggaacccagatctgtacaatcccaagcccaggcccaggtccctgccactcagggcagagccacacctctgccatgaggctgtttgtccgagggctgttgtgaagcttagacgaactgaggtgtgtacagcaccctgcacagtacttgacacagagcaggcaggtgctcatccatggcagtcattactctgtttccctctgctgctctttctgagctttcccctctgtagtttgctatgccagccactgtctttcttgaccctcaacatccccttcagatcagctggccaaataggaccattcccatctcgcagctaggaaaaccgcgctgcagaaacagaagggaacctaccagggtcgctgctcaccaccaagtggcagagctgggcccagagaattctggaggaattcaccaagcaggcagggggcaagagtattccaggcagggggcacaaccctgcaaaggcccagagatcttaagatgtgtagctcacttaggaaacatggtgatttgtggcctgggcatttctgcagggccagaatgacaagaggtgaggctgggagaaatggggggagccagtggtagcaaataagcccctaatgggctttctcctcccagcgctcagaagaaccaccccaggcacgggtggaggagggtggtgtgagggctgaggctgcaggctgggaggcctctcaggggcccagccccaccctgtgccccatcctttctgagaatggcagagccttttttctttccattcttatttctaatcatcagtaactaaacttgccctctgagggaagctgtgtgaatcatcttttagtcagaaattgcttccctgcctcagaaaccctggcacaccctcagattccctttgtggtctgcggtgctttgtacgtcaagacttccactagcagctctggctgtcctgctgctcctccgagccacagctgagctttcagatggaaatagctctttcctcgacctctggaggcaccacgcttccttgggaaaacatccccctgttctgcccatgtctgttctgtgtactggaaccacccgagcggacttacattttctacttcactagacctcttttagaggaggttgatactgcagttgacatttgaactattaaactgaggatgggcacttgcggagctgaactgttgggagtttatggcgtatttctgaaacataagctattgagagaaaaacaaatctccctggagcccccgaagtggttctgaaggaaggattccccctgcaggatggttttcctgaatagataagccaagcttcgcctggtgaagccccaggtccccagtacaccccattctacatggaggtggccacgaggccaataaccccagaagggaggagggttggctgtgctgtatttcccataaatcttaaaacctagcagatagtagggagggccgaggagaaaggggaaggggggaagcagagacagcccttgaattcagatctcctgagaccaaacccagggctcgatctaatattcgagtgagcctcaaagtccccctaagccaggccataccctgagactgggctcctgccaagccaagagggtcagaaggtgtggaagatactggaagggacttagcagggcactgaggtccggaggtgggccctggggtatgtgaaacagcaggggcctgggtgtcgaattcaacaagggttttgcttttggtttattagcataaagttgttttctaatggcctcttagaaaaatcatcacattgcagttactgccgtttaccatgctatggggttcgtttgggagcttttttatttttttatttttattattattattttttttccccaagatggagtcttgctctgacgcccaggctggagtgcagtggcacaattttggctcactgcaacctccgcctcccgggtttgtgtgattctcctgcctcagcttctcgagtaactgggattacaggggcctgccaccactcctggctaatttttgtatttttagtagagacggggttttgacatcttggccagactggtctcaaactcccaaccnnnnnnnnnnnnnnnnnnnnacctaccatgcacataacaacacacactacatacacaaaatacatacaccactcatcacacacaacacacatataccacattaccacacaaaaaaacaccacacacaacactccacacacagcatacacacaccactcaccacacacaatacacgtcacaaacacaccacacataccactcaccacacatacaacacacagaccacacatgtcatgcacatacaacacacaccacacacaccactcatcacacacaaacacaacactcaccacacacatacaacatacaccatacacaccactcatcacacacactgcacaacacatatacaccgcatatcacacacatcaaacacacaacacgtgtacaccacctactgtgcacatacaacacacacacagcacatacaacacatacactatacacagtacgtaccatacacatacagcgcacaacacacctgccacacaaacgcacaccatgcaccacacacacaccaaacataccacagacacacagaccaaacacatcatatacacacacacacaccacacacataccaagtacactacacatatacacacaccacagacacacaccccatgcatcacacacacacacacacactctgcactggtgagctggggaaggctcctggggtctactctcccggagtgcagcgcctctgcattccagggggcttctgtcgtcccggacacccgcacccacctcctgccctcccccactctggggaagaccccagggctcactggccctgcacagccacctcactctcctcaaaagccaggcctttagaggatgattctgggaaccaagttctgccaaaatttcgtggcacctggggtcctgttggcagcaccccacacacaaacacaaaattattcattgattcactggacagatgttcactggaggccctatggcattggtggggtggggatgtgggcatgaatgaggccaactgccctgccctggtgactctgagccagtggtctctgccagggagagaggcaggcttctgggagaggtgctctgcgggctcagggcccagaccccctgcttcggctcctagccaagtagacctttccttgccatgcagccttgcctctcccggcctcagttgtgcatgactctaaaatgagagaaagagcagcccctgccttgtaggcagctgtgagcctatgataaggtgatgcacgtgaagaactcagcagagtggtgagcgcagagaaggcatttggggaaacgggcatggctacagctgttgaggttgggcctccaggcatcaggggagacgtcattgctgatgcctgtccttaaaggatactggctaggtcaccagagacagccaattagcataaagttgttttctaatggcctcttagaaaaatcatcacattgcagttactgccgtttaccatgctatggggttcgtttgggagcttttttatttttttatttttattattattattttttttccccaagatggagtcttgctctgacgcccaggctggagtgcagtggcacaattttggctcactgcaacctccgcctcccgggtttgtgtgattctcctgcctcagcttctcgagtaactgggattacaggggcctgccaccactcctggctaatttttgtatttttagtagagacggggttttgacatcttggccagactggtctcaaactcccaacctcaagtgatcctcccacctcagcttcccaaagtgctgggattacagatgtgagccaccacacctggcctgtttaggagctttttaagttattttttattttaaaaatttgcataaaatatatataccataaaatttacaaacttgaccattttcaagtatatagtagtattaagtacattcacattgttgtacaactcatctccagaactcttttcaggttgcaaaactaaaactctgtacccattaaatggtaagtttccattcccctctcctcccatgtctggcacccaccattctcctttctgtctgtaaatctgactgctccagtaactcataaaagttgagtcatacagtttctgtccttttgtgactggtttatttcacttagcataatgtcctcaagattccttcatgtggtagcatgtatcagaatttccctcctttttaaggttgagtaatagtccattgtatggataaatgacattttgtttatccattcatctgttgatggacacgttggttgtgtccaactcttagactttgtgattaatgctgctttgaacatgagtatacaaatatttctttgagtacctgttttcaattatttggggcatattccccagaatcagactttctggatcatatagtaatttcatgtttaattttttgaggaactaccatactgttttccatagtggctgtaccattttagattcccaccaatagtgcacaggagttcctgtttctccacatcctcaccaacattattttttgtttcttttttttttaacagtagccatcttaatgggtgatatatgctatggtttttcttaatcccatttttgcaaatgttatccgtaacgtgtagctcttcaagtcatcattcattgatcttagctccattcacttcccagcatcccaaaacaagagcacgaattgtcctctcaaaggtacgaccatggctgcacccagcattccctaaaggcccaacaccatgccaagaaatgtgctggaccaagctggaactggaatcaggggctctggggcagtcccaggcctgaccctctgcaggtccctgactaggagcaagtgccttttctccccagggcctgttctccgtccctcaaaacaggaacaataccaatgccttaactcccttacagagttggagccctggagataaaaaggctcgtggaaattttacagcaggagcaaaacttctgggtttgtcaggatctcaaaaagccagaagagaaaaggggagggtccctgattcttagtaatgcacgtaggcaatttcagagctcaagttcatggaaacaaactgaattacggaggaggcagctctgccatttgcaaccacggattgtttgaaatccttttagaggaaaattaaaatatttcacagagggtaataaaatcctgagtgttttgcaggcaggactgctcagctctcttgggcaaataagtaattaggcatttttatttaagtcctctgtgtcgtcattttctttcattagtagagggagaaaaaactgttatggaaaatacataaaactctggaaatcaacagaaagttaattataaaattgcaaatatatatgtgtgtgtgagatatatatatatatgtatatgtatatatatgtatagcacacaataacagcatactgcagagagaaagggaagatcttagaacttattttcccaaacttcagacatgggaagctgtgtcaaatattcctctgcttcttagtaaaacctatcaaagagcttgggagtggggcatttttcaaggcacaggatgccttaggtcagtatggccatgggagccggggaggtgctctgagccttgctccctatccacggcccccgtaccatccaccaagggacctgcagttcttcctcactctaccctccctcaccacatccactttaaggagagggttgatatttctctgagctagaaagcatgtgctccagcctctccatcttacagatggggaaactgaggacctggtttaggttcaaaggctcttttttttcctatgcatccccaggtctcaggaccactgcgtgtcaatgcctgtattccccccatgtgaatcgggtctgctctttgggcccgagccctagctgcagaagagggaagaataggccagggatacatccagttgctgacagagggtcctccctgtccctgcacagccagtccatgctgacatcttcctgagtccaccttcttcctgtctgggctgctcttttgggtaatatgagggagactgaggacgaggatgcagagggctccttgtgagaggttcatctggtacttcagggggacacaggcgtgttcatagctatttcgtcttcagaatctctctagagtttgggtttatctctgttgtctttcagcacccctgaagccagctccacctgagtcacctgtctcaatgttattaagtggcatgagtgggtgtgtgcattggggttggggggtgcacatgggagccacctgcaaatctgcactttcacagcctcctgtgaatccaacatcagtgcccatatggaggcatctcgtccttaccattaaccagtctcccccaccactctggtctgcattaagccatctagcaaacagttaataagcacctgctgtgtgctgggctttgcactgaccctgagaacccagagaggaatagaattcagcttgtttacacaggggaagaaagacccacatggcagttttcaaaaacaaggagatatttgagctggtccttaaaggacaagaggaagtttgcctggcagggaagggagagggacccacctgggaggagcagcagaggtgaaggcacagaggcatgaaacagcccgtgttcgggcagccatgtgaggaagtgacaggtgctggggagatgcagctggtgttctgggagtctccaggacaggagctaatggtgttcacacggccctgcggcgggcacagggccagcatgaagcaggtgccaaagactgtgtgtctaatgtgtgaaggggagaaggaaataagggaggcactcagggaagggataagtctttgcagcatattcatatcatggcatctatagagcagttaaaaaggaacacactagagccataaacatgaatgaatctcagaaacagtgttacaaccgggcgcagttacagccgggcatggtggcttacacctgtaatcccagcactgtgggaggccaaggcaggtggattacttgaggtcaggagtctcattaggttaaactgcatgaacttgcccatatttgaccatttttgacattcaaaaatagcagtttccattggttcaacctaattgaactcatgagggacagtctgtctgtcccatgaaataccactcagcaatcaaaaggaacagattatcagcacgtacagcagcttgcttggatctcagggggattctgctgagcaaagaagccaagctccgaaagttacagactgtatgattccatttatataacaggctggaaatgatgaaagcttggaaacggggaacagattagtggttgccatggccagggagtcgggggaagagagaggtgaccatagctttaaaaaaagggtagtacaaggacccttgtgatgaactgtcctgaatcttgacagtggtggtggccacattaactcacatgtggtgccattgcatagaaaatacacacgcacacccacacacaagctcatgtaaagccggtgaactctccacaagttcggcttccttgcgtcagcatctccatctcagttgtggtacttgtgttaatactatggtgatgacattgggggaaactggatgaagggtatacggcatctctgtattgtttcttattgcatgtgaattacaattatctcggaattaacagttaaatacacacatggtaatgattaatgctaaatttaagacagaagttgtttctgggacaaggagtgaattatgcagatggggagaggtttgcggaggggattcaactttatctgtaatgttttacttcttaaaatagaaaaatctgaggcaagtacggcataatgttaagatgctacaaagctggatgataggcacgtaactttgttacatcattctctttttcatgtttgaaataattcataatttttttaaaagctaatcttgcttcactcctttcacccggagtcaggactggacctgggatgcagagccctgagggtgcaggggatgggccaagggctccctgagggctcagcccccagcccagagaccacctaagtggcagtcccagagcctcagtggcagccagggcagaggctcccgacacaggccccaccaggtgccagccgctccttcctctctctgcagcccccagagaaggagggcgccctgcctcggcaggtgggcaacaagacggagtgcggcctgctgggcttcgtgctggacctgaagcaggactacgagcccgtgcgcagccagatgccagaggagaagttgtacaaagtgtacaccttcaactccgtgcgcaagtccatgagcactgtcatcaagctgcccgacgagagcttccgcatgtacagcaagggggcttctgagatcgtgctcaagaagtaagcgctgggcagggcaccggggctgagggctgtgccctggtgcagggagctggggatgtcagggtcatatagcactggccgccatccaggccaggctcagcagcctgcccggctggagtggccgtctagcacccagagccacagagggccctgcccaaggtcacccagcaagactcatcttcacttgcatgccccttggccactgtgttttccactatatcctcttaaacatttctatagccagagtcctcccccttctcctccctaagccgctggttcatcaggaagttctactcattgtcacacttagatctctcttatttcatttcctttagcgtagagttggttgatggtagctattttcattattagccacactcctctgactccagaggagtgctggaaataagcctggtgaactaagcaaatcccttcccctctctggcctcagtttccccacttgtacattgaggcaattagtctagcccccagtggttctcagccctgggtacacattggaatcactctgaggagtgtttaaaaaaacattgattcctggattcaccccagacaaattgaactggaacctctggggcaaggctcgcacgtgggtatttattaaaggctcctccaagcaattctaatgtgcaggcagggtcaagaactactagcctgagttttatgtgctttgtaaaccatttcagctgtgggagtgttatttcagatgaatcttgtgagtatataatacatcaaagtggggctccgcttgctgagtggcctgggcaaaaattgcaggacgaatgcttgatttcaccctgcctgggggatgaactagatgggcactggatgaccagccacagctagctgggcatcacgagggtggggaggtggtctctaagcctttcagaaggagcattccttgggctccccatctcccttccatcctcccctaggtgctgcaaaatcctcaatggggcgggagagcctcgtgtcttccggccccgcgaccgggacgagatggtaaagaaggtgattgagcccatggcttgcgatgggctccgcactatctgcgtggcctaccgcgacttccccagcagcccggagccggactgggacaatgagaatgacatcctcaacgaactcacctgcatctgcgtggtgggcatcgaggacccggtgcggccagaggtaggccccagggccagcgagctcagggaaaggggatgaggctgggaggccagccaccagggtgacctggagtaagtcacttcacctctttgagtctcagtttccacataatgcccatggggatttccttccttgatcctcataagaggattgcccatgagaaacagtgtagaccacatgtggcatgggtcggcccagaaggacacagaacccacaggttgccagcaggtattgctctgccatgggggcagtcctcgagctgtccagccagccaccatgagctcttccctctggtcccccaagggacaggtgtaggggctgccctgccttagaaacctcttgccctgcaggagccaggatctcctgtaacaaatccacaaacatggattccagggtccctacaaaggacacacccaatagcaagggcattgcactcaggagaacccgaagtgtggtgtccctgtcagtatttatagttctcccagtgcagatgcagtttaccagccagtttaccccagcaagctggcctaggaacacagctgagagtctacttttatcagattcccaggggaacagagctagaaagttaaggtcacattctccagcagaagggaagggggctgacagcacccacttcacaaggatcaagggaggcgatgcctatcagtacacctagtggggtgctcagcacacagtaggtcttcattctcctttagctgaatctgcacctgaagggggaagaccaagaactcagtgctggagctgccggggtcaggggaggatgggatgtgtgtggtctgtggtgcttcccaggctgaagaaaggctgtggggaacagaggaagctgtcctgaatctccaaaacggtgcatggcaggcggagtgagtcagctcacactgtgaggccccaggggagcaccatgggcatgaggcagcgtgcaggaggggctggcttccacttcctcccaggactcactcagctgctaggtccagaccggatgccctggccaggccctggctgggtccagattggccttggctgtaagatttggtgctgatgctttgagggcccacctcctccactccttaatggacctaccctgacactgttctctgggggtctctggccatttgctactcctctctgagcctcagtttccctctctttaaggtaaaagggatagacaagatgacctccaagttcctggccctgatgttataagattctgcattccaaagaaaaatgaaactaggaggtcacaggcatttcacattttaggcagcagggagagggttcaaagtgtgagctcagacatcagacagatctgtgatcctgagtgccggcacagctggctgtgtgacgttgaaccagttacataacctctctgagcctcatctgcatactggggatgataatagtatcacacacaccccctctgggatatcatgaaggctcagatcatgcatctacgagcaacaagcagagtatctggtacaagataggcggcctacatacgtgggtccccttccttcatgccctcttcagtagatttcattaccctagatccagggacacgtaacagccctagacatacagcctagcctgccaaaggtgttcaatgagtgtttgcggaatgaatgaataagaatgaatgggactggaaccccaatcttccacaccatgcctagtgctcctctctctctctctctctctctctctctctctcatacacacacaccctccttgggggtgtcattgtggcttcctcactcctatcaagatcctaaaacagcaaagacaattaatgcccctggagcttggcagtggagcccacacgtgctttcctgcaaacctctctctccatggacagacaggccgtttatcagcctccctgtgggacacctgctcattaccagccactaatgggttcaggcctcactgtgatgtgttatctcgttactgaaaactcttcatccttgcacagcacttgaggctggcctgcctacaccctgtggctcccctgtccttcccaaccccacagcctcccccttcccgggccctcccagagctcctggctcaccaccctgccttggaaacatcccttaggtgaatggaagacacaggcaggcccaaactgttatttgaccatgacgcacaataagaaatgtattttatgtcatgactcagtaaacacacacatttcaccaaagcaagaatttcacaaaataatgggatgcacttacctattttctgttcttctatttctttgtttcttttttaaaatgttggtcaccacccactaaacaaatttcacgtcactaacagggcatgacttgaggtttgagtgactgatctagtccaaacaccttcccgcacaaaccccaatttccagaagaaaacaccgaagcccaaagggggacagtgatgtgcccaaagtggctgagtgaacccagattagaacaggttttctgcctccctgcctcagggcctttgcctggttgccacacacacacacacacacacacacacacacacacgcacacacgaaaggacaagtagttctaagtcaagaggatgagcagacgaggacaaggatgagagctccccatgcccagggcctgagggggcagagctgggttcctggcattttctgttgacagcatggtcatccagagaagttagctgcaggcacagactctgggaaaggggggcctggagccaacccccaaccccgactttgccgctaacgagccacttccctctctgagcctcagtgttctcagctatgaaatgggaggtcagcccaggtgccccttgggtccctcccaagctctgacgtccccagagagagcgatagttgactggaagacttaccctcccatcttccctcacttccttcagtcagggcatccacatgggccacgctctctcctgttggctcacccctgggatgtctatataggagtcataaactgtctcacagcagcaacttactcaagtgacacagcagactcaagggacatgggttctaattctgcccctgccactccctcacagatggcctcagtttccccacttgaaaactgagagaatcagactgtccagcattcacagtgagggacacagcagggttacaggtgacaccacgtgcaagcataagagctcagacgtgttgattcagcacctccgagtggggcgggatggatgcaggacccaaggagacgggtgggtatggctttgtttatttgtttgttttttaggtaggtcattcctgccccctctagccccctggttcccacctcagaggtaaccactatccccagattttaggggcgaccttcagggaacgtgtgtgcttatggtggccgtgtttttgtcaagcaccccagagctctgtcctcctggactcgtccctttatgcagaattatttgtcaccctctgtaaatctcacaggtgaactcccttcctggtgcctccagcctaggaggctcagccagagggaaaacctcagcccgggccatctctagggtcctgcagacacattaagattcattttgcaactgcaagaaaacaatctttacctccctcggtttccctggctgtcaaggggttgaatctccacattgccttcctcccacgagaagcccaaagggtagaacagatcaagacacccttgccagagcaccccactgccagcccttacagtgggtacattttccaaggctgattgaagtcagtgctgataaagccatcaggagagcagcggtctgggatttgccgggttatccgggggtgtttgaagccctcggagtcacagacaacggctgtcaccagaaacaacagatgtttaaaagcctttatttaatgaaaacaggaagcacccatttcctggctgctttccctcagtgagaaatatctaggataattttagcgagagaagtcattttttcccaaacttatttatttatttttaatttcacagtaattttatcgatgtgggaagcatatttcaactggatcgatgcctctggggtttgagtcgtaatcatctccggatcctcagtgtccagagcagttagatgcgccagagctgtttgtccaataagtaaatgagtgagcaacaaaattaagtcctgagagcagcttaagaaaacatcctgttggggtgcaggaatcaggaatggcttcaggaatagagagcatttcatttataagatgggaaagacttgacacacagaggctaagggaggaagggcattccaggcagaggggacagaatgagcagggcaagaaggcaggaagggatgcagagtggctggggcctcgtgaatgccctgttgcatttatgagagaaaagggaattggaaaaggtgtgcacgtgcccatcctgtgcgtgggctctgtgtgccctgtcatagagttcctcccagccttgctgaagggtggatactattgtacccattttacagatgaggaaaccagggctcatgtgagaccctagagcagagcccagcccagcccgttggtccccaagccctctctccactgcacagaagaaagtatagggtccgtaaaaattagcttcatttttctcatgaagccagcttgcttggagaggcccagaagatggctgattttggctctgggagacagtcttgaaagtgagagtatttctaaaacgcagcaccaatcacctcattcctggctcagaacttcccacagttcccagtgcctgaaggagcatatccctggtccagaaccttctgcccctctccaaattcatggtctccagtccctaccccacatcttccctcagcccctccagatcacctgcagcgtggccctcaggcccgttcatacctcaggccttctctgccagtgcagagtggacagttccctgcggccaggactaatctgtgttcatctgtgtagcctcagccctggcacaatgccaggaaccagagcctcagttggcagctcaaacatcccctcccccaggaagtcctccttgatttctcctccccacccactttcttctaaagcaacagtgccctctgtgctccttcagtagcacaaagggcactgaagcagcacaaaacccccttatactcagcagcacaaaacccccttctgtgttcccagagtcttttgtatagacctgtgccaaagaccctgcctccaaacagagtacaggtctgacacagggtgatgctctgctatctgaaaaaagaaaggttgtgttaaaaaatcagctagacttgttccacagtggagcagtgggcattagagggagggagcaccctgtcatcgggtgtgcaagcagaggctgaccagcccatctgttgaggacacctgggaacggatctagggaatgggcagagggtcaaagtcaatgacccaaaaccctttccaactccaagtcctccagcgtctttgaaaccaagaacctaaattcctccttttggaggcaggagccagataaggtgtgcgttcccaggaaacagcagctctttgctgttctcaggggcaggagacagcagggggccacagcccagtttacagccatcatgaggatgttagtaagttatataaacaagatcttggacattccacattcccactccctccagccctgtaagaatgaggtcacgtttgcttatgtgattagccgctgtggcacgaggcaggggccttgctcacgtggcccccaaaccccgagtgggcactggaaggcttctccccaggccctggaagtaagccccagaggaggctggtggtcagctggccctgctctaacccttcaacaacggggagatcactacctgccaccacagagccggtctcttagacaactccagtagctagagaggcctccttactgggaccctgcccctctagagcatccgttcctcacgccacaagacagccacgctcagaactgcgggtttcctcttgaaggcatcagggtggaacccctgaaagagagcagccccacaggctgacactcaggcaggtcactggtggccagggtaaggaaagaggggccaggcagtgccctctgcacagggtacacagggagggtagtgccctccccatggcccctgccctcctgcccagaggcaggctgggcaatgacccagcttgagacgatggtggtgggggctgaaggagtggcaggtgctgtgaatggggtggatacaggcgagatagtcaaggccgattccttgtttttaccattgctgaaggcagaaaggagaccccaggcaggagctgtcccagtcaggcttggccccaccttctaactctttgtactagttttctagggctgccgtatcaaagtcacacaaactgagtggctcaagagcagtttgctgtctcacagtcctgaaggctgtacatctgtttgagaccaaggtgtcagcagggctggctctttccagtgacgatagggaggagctgtctctgcctctctctcagcttccagtggcttgctggccacctttggcctccttggagtgtagaagcagcaccccgatttctgcatggcatctcctttgcatatctttgtgtcgaaatttcctctttataaggacaccattcctgttggattagggcttaccgtgatgcgctcattttagctggatttaccactataatgaccctatctctaagcaaggtcacatacacaggtactggggcttagggctccagtctgtcttttggggggaatacaactcaatccatagtcttccaactccctcagcagtggcttggcaggtggatgctggagtgcgctcctggtcactgtggggtgtgcagggagggaacgtcagactgagcccttccaggctggagattctaacaggctgtggtcctcccaaacaactggatttcctgcccttgacatgttctctcccactgaaagacgttctgcagcaaatattattttattatttgtcactgccctcgggtaagaatcactcgttccattgatttctgttgtgtataaaggggtgccccagctccaggctggtttcctcggggaaaccctcagctctgctcagggccagctgctggggtagggtggggcggggctgggaagccttgtgccttctgattggctggctctgatccggcctgattgtcccagatatccgtctgtcattacagtcagagaggacagaacctatccttattattgcagagaaatggcgtattttacctgaagcataatcctttatacatattctaaatccgtgtcacattctgtaagtaaaatgcccccaaatgcaaatgtccccccaagaaactgaaaatacacaaatagatctgtcaagtttgcaggaactatgtatgtggatgaggcaaagagaagttcacctggccaagcttacctggggccagatctgaggaggcgttcatggaagtctttccaaagtcttcgcccaggtcgagacagccaatggttctgtctcaggatggaccgtcatggtcaataggtggtagcgacctgggactctgtgatgagaaccacatcagggtttaatcaaaggatgtgtgattgattaacaatgcctgccgttggcacaggaagggaggctgtggcccatatgccatgtgcgtcatcagcatctcatagtcatctagtcccctttcagtagagctgcctgtgagaagggctcctctggaatccatgaaggcagggggagtctgcctgaggtggtgccctcccccatggcccctgccctcctgcccaggtcccagaagccatccgcaagtgccagcgggcaggcatcacggtccgcatggtcactggcgacaatatcaacacggctcgggccatcgccatcaagtgtggcatcatccatcctggggaggactttctgtgcctcgagggcaaggagttcaacaggaggatccgcaacgagaagggggaggtgcgtgtcccaacgtaaagcatcctcaggggaacgcgctcagatgggagctgggaggtagggtgctgcatgattgtacagaagccagccagtgtgctgctaagagcccagtgactctgggcatgtcccctcccttctccaggcctcagtttctctccccgaccccaccgacccgcccccttccccatccctctccagattgagcaggagcgaattgacaagatctggccaaagctgcgggtgctggctcgctcctccccaacggacaagcataccctggttaaaggtaagacttgggcgggcacgggcaatcctgaagcccagcaccaggccagaagctgggccctcctctcctggcacttgcagcttcttcccagaagggaagggcccctcgcccctgactctccacacctgggcacagccttatgtcacccccttttcagccccaggagcctgcaaggggccagaaggagatggggctaagtcttctctgtgggcctccaactcccctaggaagcaatggacctgggcctgtgtggggtcccaaactcctggctcagcgctgaatggggcccacagacgtgttctatgtggccggtacagcgcctttttaaatgatggatttgaaagactacgcagaccctgctctctcacctttgacatagtccttactgctgcttgttgtctgatactcagcctacttcactcgttctcagtctggtctcagagctttaagtctcttggtctgtctggtccctgaggcccccaaccaacgtttgtgaccaggacctcagggatgcgctctcctgggaatagccacctgagggatgagaccaaaagccaaagtcttgctcctccctccagagggagggcacaccacttgctgagcctaggtggccaggtcctgggcactttttatttttatttttattttattttatttgagacagggtctccctctgtcacccaagctagagtgcagtggtgtgatcatagctcactgcaacctcaaacacctaggctcaagccatcctcctgcctcagcctcccaagtagctaggactacaggcatgtgtcaacgtgcctggataattttttttaattctttatagagacagggtctcactatattgcccaggctggttgcaaactcctggcctcaagcagtcctcctgccttggcatcccaaagtgctgggattacaggtaggagccactgtgcccagccaactgggtatttttagagtcacgtggtcctggctttgccactgacctgctctgtggccttgggcaaatcccactctgggactcagtttcctcatttgtaaaatggctatgggagcagggctccactggagatcagccctagaacatcttggattcctctttcaaaggtgctgcccaaggacattaatggaagcagatctggcctggggagagaaacccagaaccccagaaccacaagggagcagaaggcgcccagcccatccttattcttattcattcactcattctctccataactgtttactgaggtcctgccaggtgccagccctgctcaggacaggcctggtcctgcccacgtggaattcatgggccaggctgcacgcagcaggcattgaataagtggtccctgcatagagcaaaaggctgcactgctggcatggggtgctctggacccaacactgcctctaacttggactagggaggctttaggtcacaggccatggaaggtgggatgggctccagggttggtagggcctgtgcttgaggcaaggcagggaactgctctgcaaagggctagaggcagaagatccccagatgccttcaaggatctgggccaggacctcggggtgggagagggaagctacaggagactggagcaggtgggagggcagcagatcctgcagggccgccaatgcccaccacgagcaccccgtcatggcctgcaccgtgtcaccaggcacaggaacatgggagggtttagagggtagaagcatcattttagaaaacttaccctgcagtgcagagcacggcctggcagtggagggacctgtaggattgtcctgcttaagagttgtcacctgcccacagtggtgacacctcaagtggagctgccaggtgcgggtctgagaaagtttgggtagtggaggggtctgggctgggtggtggtttgcatgtcatggagggatgaggagcaggagggtctgggatcccatcagtctatacctgttggagaagagcattggacatcgagcgaggagggagagcaggcctgagacagagtcctgggtggcacatgtgggtggggagagaggagctgcagaagccaagagctgcccgagtgatggtgcaggctgagaacctacagaggaggccaaggggaggaggctagaggggcaggaggatggtcagtggggagtggtgccgggaagacaaggaaggaggcctgtggaggaggaaggtgtggtccatggtggaaatagttgctgagaggtctgcggggacagaacagaaatgtgaccataggaagcagccacagggaggcccctggtgactgcacacagtcaggccaccccaggactggaggcagggaggcgtctagggagaggtttcctcccagctttccgcacagcttgagctacgcaacggtccgcaccacctgggagccacagggcagaaatttgacccgtccctgccttggaggagcccccaggctgactgagggaactatggaaactcaggcctaatgtcccaaggggacaagcttggggaggctgagtccaggacggtggaactgaggggtcaccgacagctgggtgggagcagcccagaacgattcccagaacacacggcactgcagctgggcctgaaagagggtagagctgcaagggagcaggttgggggcacagtgccccaggttatggaactcagcgcctcattccacaggctgctgccgtctgctaggcacagagcagagagatgcgcaaggatggagcagcacatagagttacatggatctgattaagggcaggcagggatcctcagagggtcagaaaggcttcctgggaaaagcagcctctgagccaaaaatacagtacaggtgggtgacaggagtacctccagccaagggaacagcctgcccagacacagggccagtgagagctagctctgtgggaccgtaagcacagattgggggtggccaggggatgagagaagagaagaggtcaggatgtgagtgaggcctggtcacagaggacttcataagtggagctaagaacatggatgttatcctgagaccaaggggggaagcaggaaaacgacattccggggatggctgggggacggaactggttcagacatgggtgttagagagatcctgaggttgctgtggggaagcaagttggagggggagtccagagtcagtgagaggaaacaaagtgatgctggtggcagagggtggagacagagaaaaggaagggtttcagtgggattttggagccagaattggcaggccttggtgatacattcaatgtgcagaatgagagacccatggatgctgatacccaaattcctgtcgtgcccatggacatccctgctcgcaagccccatgaatgaggagtcccacaaactccacaggtccccaccgatgacatccttcacccacccttttccactggccccagctcagtgactggggccacatgtcatttgttcattctgttattcgttgaatgttttattgaagatgaatgtctggagggaggtcagggccagaatggtggggcagaggtcactggcaaatgacaaagccaaggcctcctcagcaagcctggactccccagggagaaagtgctggctagtggtgtcgggaggaacagatggtgaggtcctgctgaaaccctgggagccctgctgaggcagagggggccctgagcacagttagaggatacagtgtttctggttaggatggatgccaatgtggccacaggttgcagacagcaaagagggggctggagaggtgagcagggcccgggccacagggggccccaagtcggcaccagcccagtaaggagcccactgtaacctgctggcagctataggccagcctggagctgggaagagcctggatggagggggcggctggacagggaccagagaggaagccatgcccagccaggcccctcccgaggaccagggctggcccaggctgcctcccacctgagtggcccagggcctgagcacactcctgccccaacaggcatcatcgacagcacacacactgagcagcggcaggtggtggccgtgacgggggacgggaccaacgacgggcctgcactcaagaaggccgacgtgggcttcgccatggtaggaacggcccacagagggcctggggtggtgggggctggggagattggactacacaaccttgggctggctactcaggagccccagttcacacttggcccacccgccatctgccgtgggtgcccacccttctcgagactcagcctgaccccgaggtcttcctggaaaggcataggatgcttcttgctctgggggagctgtgtgaaggggggcacttgcaggctgaggaggaagataacagagggggagagggggccagggtgaggcttcctgagggtgaagggagctgggtctgtgaggagcgtgaagagtggggtgtccctgtgtggtctggctgtgctgggcccactgggagttgtgtaggactgaggaagtggagggagtgaggatggtgatgctagaagtggtcacctcccccggccaccccacccagcctcctgtccctgtccccacagggcatcgcaggcactgacgtggccaaggaggcctcagacatcatcctgacagacgacaatttcagcagcatcgtcaaggcagtgatgtggggccgcaacgtctatgacagcatctccaaattcttgcagttccagctcaccgtcaacgtggtggccgtgattgtggccttcacaggcgcctgcatcacgcaggtgggtccgcaggagaccacaccaaagcctgggggagggcggagaccccccacagaggctcgggggccttagggtactccaggttgtccctgtcagaacagccggggatgaggcacccatcgatggagcacctgctgggggccaggaactgcatcacagagctcaggtgcaggcactggccccaggggagtcgaggacatgaggctcagagaggtggcgtgacttgttcaaggtcacccagcaaatgggagctgtcaggctcacagcctggccctcactgcaggaggcaggagagggaatcctcaagagaaggcagggcccttggccaccacgagggcagagggaggcagggaggggcaggccagggcccaagggggatcaggcatccaggtgaggacaaagagccagtgggggccctggggccctggctctggactggagtgtggagtgccttaggaggtgctaggtggggataactggagggagtcggggatcttgctcactgggaaggtcacagaggagtctggccagataccacgactgggtctggagcagccctatgcactgagcctggcaggcaggccccagatgtctgcagactgactgcttcttcatgcagctccatgaggtgggaactgtgatgatcctcattttacagaggcagaaactgaggctcagaggatggactggccagggacctgccattgttcttgcagtctcctgatactccccacaggggctgaccagcctggccagggaggcaagaatgggtctcccttagccccaggggatccccaaggcccaacactcccagtagccacctgggcagacaagcccatgcccacaggagcccccagaggcccagagtgcagcactgccccaagagctgtgtggcgctggaacactgctcccctctgttgcttcctgcgctgggggaatataggtggcagctccggctaccccagccctgagaatcggagccttgggagggtggctgggggcttccttttgctcagaagggccctctttcctggcctgtggatgagacactccctctagtggcagcttgaggaacactcctgcggccccagcaacttggaaaccagaaggtcttgatgccagatagggaaactgagattctgagaccactatcagtttgcctgaggtctttgattgagttggtggcgaggccatgcagcattgataagaagacgggcacacttgaccctgaggtatatggaattagagaaagcccggggtggggaggacgggggcaaggggagcgaggctgaggcaaggaggaggtgagagagaaagccaggagcaggggctgtgatgaaacctgggaggtgatgagtggaagggatgcaggtatatggggctttgggagagaacagaggtgggaagagcatcgggtttgggctgttgagcttacagggtctgggggcttcctggaggaggtgttccacaggccactagacggatgtaactaaagccacaggacgaggaggagaatggggctgaggcaggaacacagatttaaaaggaagggaggacgacgaccaggagagtggggtcaggattacaagtgggagtgcaggggcgaggtcagtgacatctggccgagaagaggtcctgcaactcgtggcacagaaggtgctggtgacgtgggcggagggcattctgggaacgtggaggggccaaagtctggctgctgtggacaagatacgtgggggtgtgaggaaggatggggacagaagaaccagctcctctcagccaaagagacaggtctgaaagggtccctcccagaacctggacagtggtgacctaaaagtggtgaggtccttgacaagttttagttgcttttgctattcctcatttgccaatatttcctaccttgaaatgtattaatttttgagtcatagatacgcacaataattttttaaggtaaggcgggataagaggggaggagacattgggggggtgggggacgggcactgtttgtaggatagaaagcccgagggggaggaggcagtggggggaggaggtaggagcccatgccggaggcggtgggaatggtcttggcctcagccaggagagaccccctcctcgggggctggaggggagaggggaagatggtgagatgcagctgaatttaccagaaggcagggagctggtggccattgggcctggggggactcacttatctcctggcagggaagatgtggctgaggtgggcaggtctgcactgttctccagagaaggcatcagagaacaactccatgcctgctggggagccaaggggcaggtcggactccagcctccagcaggagcctgcggacactacaccatgagcccgcccagcacttcacagcagcaggtgggcgcacaggtgacagccctctcctgcccgtccccaggactcccctctgaaggccgtgcagatgctctgggtgaacctcatcatggacacgtttgcctcgctggcactggccactgagccgcccacggagaccctgctgctgaggaagccgtacggccgcaacaagccgctcatctccaggaccatgatgaagaacatcctgggccatgctgtctaccagcttgccctcatcttcaccctgctctttgttggtgagcgcctcgcccacccacgcctctcccaggcggggtcatcaccttctgggtgcaccatggctctcacccagcattctcgagtcacaaccccctcctgttttgctaatggggaaattgaggcccagggaggtcaagtaagttgcccaaggtcacaccagcaagtcttgaacagggcctggccctgtcccagctctggctaaccctaaagccatcagtggctttctccactggtgacagctcctggcaacaagtacagaccgtgcaaggccctgaccgggtgctgaagcactgcatggcagccccagaggcacctgaggctgggaggggagtgactcaccccttctctgacccattccagcaccttatcctggccccgtggaagggaccctcagcaaggcttcctggggcagggcatacacgctcacaccaccaccgactctcacaatgcttccacttgggctgcctggttgggtcttccactcagtgaggcaagcacatttgcctccaccccacattacaaacgagggcaccaaggctcagagaggtgaggtgacttgcccaagggcacacagccagtctgaggaagagtctgggcacagaaccaggtctggctggggccaagactggcctggtttccacagatgcttcggaggcaatcccaacaaagcctatccccaggtcacagatggggaaacagaggcccagagaggggaagggtctggcccgcagtcccacatggaatcagggccagttctctccttacaggagcctcccggagctggcctttcacttgtcctcaaagcccagagtgtgatggaggtgggcatggatccattcctcaaaggcagttagttgccttttataaattttgaaagtagtgtgttgtcaggacacattttactgttgtaaaacttatcatgaaaaagcttagaggaagccacttatatgcagaactagaagagactcagaggaggtggaggggttggagaggagaggagagcgggggtcctggtcggcttgctggcttgaccacttgagcagcacctaccctgggtagtcttgggacatctcacacccagaaaactccacaagcctcctggcaccactttactcagctgtgcaaaaggacacaggacttggccaggtgcagtggctcatgcctgtaatcccagcactttgggaggccgaggcgggtggatcacttgaggtcaggaattcgagaccagcatggccaacatggagaaaccccatctctactaaaaatacaaaaattagccgggcgtgatggtgcgcacctgtaatcccagctacttgagaggctaaagcaggagaatcacttgaacccaggaggcgggtgttgcagtgagctgagatcacgccactgtcctccagcctgggcaacaacgagactccatctcaaaaacaaaacaaaacaaaacaaaaaggatacaggactgcatcagacaccctatcagcagcgtctacacagcagtgccctgccatgtgacagctcaggtgttagaatgaagccacatgggagggtccagagccagcctagcccagaagtcctgggctccatataggaattggcatctctagtaacagccccatgagcttgtagaggtctcagcaagggacatgctcaggaacaagaagcagcactctcggggcagcgcaaaacctcccgcaggtatcctgtcctcgcagtccagaatgagttttccagtctgaggtcactttttagaagccatgtcgcccacctttaacacagccggccgtccacctttatcgggtttccacagaaaaagtggaagacagttgcccaaggcctttcttccccagaggagaaagggctttgctgacccttcagtcctagtctctgaccagctgacagcacagccctggccccccactgtccaagcatgccttgatgtcttggggattcacgtcactgctcagaagaggcccccacgaaaggccaggcatctcccctctgattcccccaccactgccttcagcccagccccactctctcacttggcaggcgagaagatgttccagatcgacagcgggaggaacgcgcccctgcattcgccaccctcagaacattacaccatcatcttcaacaccttcgtcatgatgcagctcttcaacgagatcaacgcccgcaagatccacggcgagcgcaatgtctttgacggcatcttccggaaccccatcttctgcaccatcgtgctgggcacctttgccatccaggtagtgaggcccccaccctaaccaggcctggggtgggcagcaagcggctggagcccctgggcagggccctgagagcccagccctctgtgctggtccctgatggcctctctctctctctttctctgctcccctgtgacctccagatagtgatcgtgcagtttggagggaagccattcagctgctctccactgcagctggaccagtggatgtggtgcatattcattgggttaggagagctcgtttggggccaggtaagttcctggtaggtcgcaggaggtgcctgttagcagggcaagggagacagcactggatggagaatccaggacccccaggaatgggctgccagaccccaggcaagctcctccctatctctggacatctgagcaagggggcttgtcccaggtcctatactggtcgtctgggtactactgctctgatttttgccttatatctatctaccactgctcctgttgtttatgtaatattttctctcaatcacgtcagcttttttaacttaaatttgtttttaaaggcaacgtcctgttactaagacaactgaaaaatcagtatcacttgtcataaatggaagctaacaaaaacattaatgtaatgagaatgacattattaaactccagctagaagccatggcctgccagggattcaaggctggagcagcttgttaggaagggagatgaatcagtggtctgcgggcgctggtggccggctggcgtcaatcaggatcctttagagcactcagagggaacgcaagcaggacacactctgccacattgcggtgttactcagtgctgtgcctgtggccatctgtggcctcagtgctgtgcctgccccagctctggggctccttgggctggatgctctttaggggcccttccagctttgtcccagaatattctcccaccaattcgtttttctacgtttgcccaagttccagaccctgtcacagctctgagagcatgcagcccaaaggctcctgacccaggacacagggcttgggaggagggcccagaaccaactcagggcctaaggggcctgattcccaaggtgctcacacatccaggcagtgggaccccatgggtgggaggcatttttcttgccttcaagctgtctgcaggctagagtgagaagctacgggggcaaaaattaactaaaagataaataagaaagtttagtttcatccaaaaggacttcctgtaacctttggggctgctttggagagtgataaacccctgggcaccctgggggccaggccatctttatcccactggggcccaccccctacaggaggctcttgggggctgggcccagtaactgagggaaggattcagaggacaaaggttaatgccagcgggcagtgctgactttacactcccagggagccccctgaggctgcattcatgccagcgcctgactgctcctacaggaaatggaaggggcctctgatatctgccaccgcagctttcctgtagggcctgcgtctgggtcctcagccccatggacaagccttttggggaagattaggaatgaaggcatagctctttcccattctgccttcccagtccaggattggctgccttcagggtccagtgacctcaggaggaataagggacagaggaataagtaaccccaggagaaccgagggccagccacgggccaggctcatgcaggacgagttagaccctccaccgtgcccagttctcaccatgcccagagcggcccccactttacagctaggaaaaccaaagctcggtgaggttaaatgacttgcccgaggccacaggaccagggttgtctggggtattcaaagccacatctgtccaactcctagaggccaagattgtccactatgtaccctgactctgaatgaatgaattaaaaagcaaattgcactccagcctgggcaacaagagtgaaactccatctcaaaaaaaaaaaaaaaaaaaaaaaaggcattgtcaaagactgggctgaggaacaggtgaggtgggtgaaggagtagattgatcacatgcctgggtgagcgggtaggaggagggaggtagaggagcgggtgtcagggagagaaggccactgggaaggacagccccaccgtcctgacagacagggtcccttgcaggtcatcgccaccatcccgaccagcagactcaagttcctcaaggaggcaggcaggctcacacagaaggaggagatcccggaggaggagctcaacgaggacgtggaggagatcgaccacgcggagcgggagctgcggcggggccagatcctgtggttccgaggcctgaatcggatccagacacaggtacaggaggctcttgggggctgggcccaggcctggccggggcgggccaggggatggaggtgagtgtgcttgtgctgccccccagggcccagctctggtgctgagggagggtggctacagaggggtcccggccagctctcaccagccacttgcacacccactcctgtggctgctaaggaacagcacggcctcctcagagaggtcccattgtgccctctcagggcagcacggggaagtggtaggggtcacacccaccatggtctccagggggatttccctgagagggtggggaagggtggctctgagggcagaggtgagtgaggggactgtcgctcagggctgggggcacccacccacaggggccgtgtgaggctggacagaagctgcaggccaggtcgcccagggtcccccagggcgtggtggtcagggggtccgccgcctccacgggggcttcagttgctctccccagcttcccctagggggtggagaggctgtggggagcaaaggtcagtcatcctcaagcacacacagacacacatgcacacaccaagcacaccaggggagcacaggtgcagggcgtagccagccagaagcaggtttcttccccagagcagagagagcatggctgccacgtggcacacgacacacctgcgcgcctccccccgaccccccacacacataccacatgctctcacatggtccccttatgcctggagcaggtgttgtagctcacaagtgctgtcacagccctgcgaggggagggtcagaagggactctgtgggtctcttgcccagaccatctggggagctggagtgggagctcctccatgccccagcatgcttgggcgaagtgcagtgtagaagcagccacctggccaccatcctgccagctgtggcccagcacctcatttccatccgatgtagcagagagctcacctgggtcacctcccacccctctgtaccctgtcccaaacctcacctcatgtgaccttcacagccctgggaggtagatgtgactcccccagttttagaggttaccaaggtccaggagatggccccttctactgagctggcacagctggggtggggactggaagccggtttcagacccggaggtgcctgacacgggcctgggctcaccctccctggttagggccccgcagccacccctcccagcctgcccccacctcctgggaggtccaggacaactcagtgaatatgtccctggtgctgtcactgccctggcggcaaagccacgcaggggtctccagattacgggaggaagcaaggactgcgatttcttgagtgggcaggggcgcctgtcttgcctgcctcttgcggaatgctaacacgggtcaggtgctttgccacttacagataaccctgccaggcaggtggcattgacccttcttaagaacaagaaactcgactcagagaggtggcttgcccaaggtcagctagctagtaagtgacagagctggaatttaggccaagctctgtccacctcaggacccccaccacaccctctacctccacgcctgtacctgagggaggctgaacactgctctcttccctccagataccatgtttaatcactgcctcccccactggccagcccactggcccctgagccactagcacaggacaaaggccggaccccctgtgtcctcccggggaccctggggcctgcaggtgggcccagagctgagcagacgtttttcagagccttggagtgtgtctggtatttttgttttgatttaagtgacattgtcgttgttgccgtggctgcggctgttcttgtgacgttgccctgtcagtcatgtagccgttgtgctcgttcttctcgcaacttgtctcgttctctcctccgttgcagattgaagtagtcaatactttcaagagcggggcctcctttcagggggccctgcggagacagtcctcggtcaccagccagagccaggatgtagccaatctctctagccctagtcgcgtgtcgttgtccaatgctctttcctctccgaccagccttcctcctgctgcagccgggcgtgagtgtgactccttactgcctccggctggcactgcccacgccagctcccaggcgggcaggggctggggcaccagaggacatggggggcagccggtcacaatcaggcccagggggatgaagggtcccagccaccgaagagggtcccgttggtcaggagagcgtagccagtcatgcggtggcagtcactcagtggaccagggtcagtcagagggtcattagggtcccaagtggccaaaaagtctggttcagtcaaggggtcacccttggtcaagaggacatcagtgaccaaatggtcccaatccaccacagggtcccggcagccagagggggacagacatggaggggacacagagtgtcccactggcctagggtcatatgtggtcaggaaaagcccggaccaccaaggcaagggttggagttggacaagaggtcccagtcttgcagtcaaagtcagcagaagggtcactgtgggtcaaggggagcaagccccttagggtcacagtcagtcacattgggatccacccaggagagggtcacgtcaaccagactttcccagttggtcagggggcacccacagtaatgagggtcatggtcaagggggacagttgagccaagaggtcactgcaggtcagaggtcatagtcagccagggatcccaggccacctaggagctcacagcctagacgctgcaccccagcagttcagagtctctgcccgcttcctgtcactcctccccttgcacttttgactgcatcagctgccctgcagacacctttccctgtggctgagcttggaacttgctgaagttctaagcccttcctggaaaggacaaggtccctggcccattcagcttgacccctggtagaaaatggtgggtcgagcctcacatcttgcctgggtgccagcaggcccagagggacctgatatgcccttcagcatcctgccctcctttatctgagagatagcctgggactgtggcccctccttcatctccctcctgccaagctcatctcctcatgccaccacttctgatctagatcactcattgctggctttgtctagctctttcccggacccatggcttcgggccccatggggaacaagtctgtctttcctcccatcgccctgctatgtttccagtcaggcgcttctgatctgcaggggagcccctggttctggtcttctccaattggcatagtgtcagtcttagcctccagcttctttgatgagaagtagactccagctcaccccttgaaactttataaagggcctctacccccatccaaaaccagaacacccacaacacaaccccctgcagccaagcaggtaacccggtgtgctggtgggagcgcctccctcagtgcctccagtaggaggcgcgggccacagggagcctgttgatggcaaatgtccacgacccatagcggcaggacagaagcagaaagcagggaaggagcctctcagtgctcattcgtcagcacagaaacgcagtgctggggaggaccggggagccaagatgaaatggagatgcatttcagcagatggtggctgagtcacatttccatgagataccgtcactaggcagtcactgccaggatttctcggggaaggcaacaccggtcccatcctcctcccctttagaccagagagctctcaccttagcagcagcctagccagctgacctcccagctcctttctgcaccaactcagctctggccttgctcagcacccccacctatcctgaggtgcggtaaccaagtgtcccggcagggagagctacatggggaagaatccacttctgttctgccacccctcccgatgactcctgcggccctccggctggggctgcctgctagcagtctggcttctgggtgaaggcccagttctttgtccatcccagttgagcctctttcttgaagggcagcacttcaccctggccacgacggagcacacctgacatcgctgggcagccccactgcctttggaagtcgtcctcgagtcagcccctcatcttagctttcacagcctggaagctagagctgtccgctcaaacctcagccacttctttctcagcttttcttctgcctcatttgcaaagccattcaatagggcccgtccgggaacaacacttctttgcagaaatgcccttttcttcatttctgcagaaatgcttagacaggaatgtgtctacactgacctccttcgaggccagatcagtcccctgtagcccgtggttaccccaactttggaacagtcttggaaaagaagcccaggcagaggctcagccaaagccaacttgacagtccttgccctgacccctcattctctcaggggacccggcagggttggccagggcctccccaccctgctcaccatcttgcctctccctcttcatgcctcctggagaatctcgcattccccctctgtgacagaatccagcctgtaattctgggtccctcctgagacccttcctgagcctatagtcttaaaaagagcctgaccaaacccctgcctgagggcactggttcccagacaggatcacagcctctgtggtttcagtacacacatttggacaacacagcctcgtgcctcctttgcttgagtagtgtctacaacagtgctgcctcctctggtctccaaggactctgaggaccctctaaacaccagccaaggtccctgcagaagccagtgtgctttcctcccacagggaggtttaaacaggtggccaggaagtgacagaagggccccaatttgatgggatgaggaagtgggccgccccactaccccacaactccttcacccccaccgcaccccaccagccttctgagggggatctgcttcctggggactccccagcagaggaggctgcccatgtgcctgctgaggcaaaaacacctgcagccagtgtgccctggaaggagtcaatccactgtcccctgggttatgaagagttgaccacaaaggcctgggacagggcctgacttctgacctgggacactggagtgaggaaaacccctgaacacatcgcaggccctcccctccccacggcaccaccgcaagatgaaggcctcagcagacagacgcacatggtaagcctgaccgcagtcacaaggcacatggcacgaggatgctcgggagggaatgaattggtgcactcttctgactaactcaaaaacgaggttgtttttgccccggaaacttaatggcacgtccctattgccttatacctgagccccactcaacatttccagagcagttccccactccctttacttcacagatgcctcaccactgaattgtgggaggggaggacctgccaacacatccatttcgcagagaaagacactgatgaggccagggtgaccacagcaagggcgtggcaagaggtcagactccggagtccctcattcttcccactagtcacaccgcttcccaggaggcccacagacctggagccacagaggctgaacttccattccggaaccagtgcccacgcccacagcctcatatcgtgaaaaggagtcagtcctccagggaaggccagggaagctgtttctcagcttgaacttctaccagcgtggccaagactggggagaagggcaccttcccactggtgatcaaggacaagattagcatcccacacttcgatccaaggcaaagccgcacagcctctctttctcattgcctcaaattcctaactcatctcaaaccatctttgtgcttagcaagtctgtagcaggctccgtgtttatcagtggaagtcctgctctttcaaaccacccaagccaagagccagccccataagccaggtccaagccacattctggacgccgtaccttgctagacagataaggcacctcctgctcccacttcccctgcagattcctggttctgacgactcctagggcaaggagtttgcactgttagggggagaaatgaagacaacaaaaagggaagaaagctggacttctcattagcgttttggtaactaatttagtgcaaccttgggttggcgagaaaatggcttgctttgtggggggaaccctagacctctccactgtctgaatattccatgtgtttgtttccctagagggctagagaaccctggacacagagttcagcaagagagagtgaaattaaaagaggttgtgagtctttaaccttgagcctgaaatgaatgtgaatcaatcccagactcttggcttccttgaagccgggtaaacattcgagtatgtagaacccatctcagaccagggcctgtgcgttttctcagagccctctgacaacgggcatgggtctccctgttccctttgtgctgacgaaaccaaaacatctgaaaccccgctcaccaggtcccttcctctccttcccctcacccccacgcccaaatgcagcttatgccaaaaaaaaaaaaaattcctacctttagggtaggcagggaggggagatggaagagcctttttttttttcccatagttttttccatttcagcctcggagagaaccgaagtggagacttgagatggccgtggcggggtgtcccaaaaagtctcgtccccacagtcttgtccagagcagttcattttttctgttgtctccatgccacggggagggcggaggggcctcatctcattgtgtgtcatcccctctgcgttgtcagtcacatgacagggtcctgccaccatccccctgccccacacatacactaggtgttccagtcagcatctgaattgcacttcaacctcagaacacactgagcaccaggctaggcagctacagccttgatgctattcccattctacaaacaagaaagctgaggcctgcagcgccttctttgttttcagttaatcaaggtgtaacggctcacttttcaggagatcagaatatgaaccatctctgcagagccacaaagagggactccagggggaaagagctcagagcagccacagtggccatgatggagcaccagcataaaggccgtgtctggctggctcttatttggcacttgttgcctcttatttaaagcacaattccagcaagtggggtaccctggagtcccagctcacagtatgcaaggtgaaaggacagaggtgcttttcagaaaacagaaaagtcagcactaactagtaagcgatgactgacagcaagggagaaaaaacaagacaatccatggggtcttacctaagaccaagaaggataattgacaaagcttatgttaaattcttctctgtgcactctaaattagaagtcagaggagcgtatgacatgctttagaaagaattccctctgcaacagtaaaacaaaccttcagcgatgacacttaaaatcatcaaccacagtcacctagaaactccacttccataaaagagggctttccccaccagggtttcacaaaggagctacccctgggttccgctgagagctcaagtcctgggacttcaggggcctccccacgaccgtctcgtccagtcccctgcctccccgcaggcctgtggtgcagggcagccactgctctgcaggtgggtgccacttggcctgcacacagcagccgactaaggctctgtcctggaggcgccaacgccaccttgttttctccacctctgactccactccgagttggggctgggacgagaggaggaggcacctttgtcccaagtcccatcagactcttgagatgacaggcactgctgcccctcccaggagtccagagaagggacacctctcttccaagtgagggtcccgtccctctgcaccctgtgaggcaggacagaggacaaccagagagctagtgtggcttgtccacagtcaaggcaccagatgtggcagagccaggatgcaagttgggtctttctgcctccaagtccagtgctctttccactagccttgaagactcaatgaccagcctcctcccattcttcagcggaggaaactgaggccccaggacgtgtggttcacaactgagacagaaaatgaaagaacttgctgttttgtgactcagttccacacaccccagaatcccactggggctgggtttggccatctgattccagcctcgttttttggttttgtgttttcaaagcacaaataaagaaataaacaaaatcccccaggaaataagagaccccaaagcaagctccaataactggccggccagggctttgagtctatactcgagtgtttacctcccaaatgcatgaaggaaagaaacgctgggtacaaacgacctccgttcacattgtccaggcttccaagtgtagccgtgtgtctgtctgtgtgtgccatgtggctcccggcctccccgtggcatgcagcccgcccccgaatgtcatctgtccgccagctcccatgtgctttctggctgcctctgctctgcacctcagaaagccctgggttggctttggtttgctttgctgcctttggtttgatgttcccgttctgtttggccctcatgtgtctctctcatcccaactcatccaaccgtctctcctttctgtgccttttctgtttgtgacacgtaacatgttccatgttgtatggtttcttaactgtgtgtggttttcctaagatgaatttttttaatagcctctcctctttcctacttgattcccacctggtcctcctccctgtctgcatggttgaacctctgctttaaagtgaacaaggctcagtctctcactaggtgtgggtgcccgcaggagtcgactgtgcttcctttaaccactgttccccatcatctctttgatggtgcttggtgattcctcctgtcctaacactagtttctaccaaaaccaaagagatttttaaaaaccagctcaaggatgcctataacctgagccccctttttcactctcccccatcctgtcaatgctaataacacccagcgactatggattccagccacctgctttgccctaacccttctcccacccgcccctcctgtgagccccccgagcctggctgtggtccctgggcagtgctcctgacccctgtgcttcccttgcagatccgcgtcgtgaaggcgttccgtagctctctctatgaaggtttagaaaagcctgaatctcgaacctccatccataacttcatggctcatcctgaattccggatcgaagattcccagccccacatccccctcattgatgacaccgacctggaagaagatgccgcgctcaagcagaactcgagcccgccgtcatccctcaacaagaacaacagcgccatcgacagtgggatcaacctgacgaccgacacaagcaaatcagctacctcttcaagtccagggagccccatccacagcctggagacgtcgctttagctgaggaccctctcgcctgcccgcccgccctcatggaccccgctgccacccgctttccgggcacccatccatccaggcacccaactcacccaagcagcaacgagcaacaatcggaaaccaaatactggagagaaaaccaacgtttccacccacagaccctttctctggctgcgatgctgtttgaactctttttcacttcaaggcaaggggcgggatctccactgggggcttacgggagtgagcggttttcccaaaacaagcccttcctggctcccacccagacatggaccagccatgcacccgcccagccaccacgtcccccgcatgaatgtactgtacactttcaatcctccccttgtttggtttttgggggttggggaggggtttttgtttgtttgtttgttttcttaggcgggaactgcaaacagactcttttctgagactatttatccaatccactggtctgtgagtttttgaaatgcttgcacagcatggtctcagttgtatagattaatttaataactttttgaaattgcagagcttaactcgcctagtagatttgcaccaatggaaccgaagaacttcatagacactcacaaggttatatccatttctttgtatctatatcaacgtatacttttccgagactgtatacgtccatatagataggtagatatatatatatatatataaatatatatacatggatatataaagtttctttgccggcatgttgccttgtttccgcttaaattgctctattttaacttatttatgtcctaaaagaagaatgtaatttgtttacaaacctgtagataacgtctttggctatttgtatggtttaagaacactggtggctgagatgctataaaaacagctcggcccaacagacacttcccctgggttgcatcctggatgttttatgatagccatgctctgatttttgcctgctatttccgttcaataatgtcactaccgtgagaggctcaggcagaagccaaatgctaccgagttgccatcctgaggggtttaacaacatgctccgtagacgaagggagaggaggagagaaggcttcctgggtttgcaacactaacggccatccggcccaaggatgccaggatctgcaaagcactgctcgaagacttttctctcaatgaaactcgcttgagtttactaagagcatttcaaaaataggttctctttggcactgtctgtacagagattgaggtagtgttgaaatattataaatggtattgtgttgatttttttttttatttagtaacttacaggtttgtttccttattaatggcagcatctgagctgttggcatattggatgaggatcagtatggcttgctgcttttatttttatttttgaagaagaatagcctttttctctgcactatttagatccgaatgaaccttatgatgtgtatattgagatgtactcagtgtgattttaaaccaaattgtcttcctgtagtcacaatatatactgtagccttttaacagcaagtcttgctttcccaaacagaaagccattctgaaaccctacagtatcacaggtgagaaaaggtggttattttttccccaagacaacagcactagtaatcccacttaataagagcttatttaattggatgtcagcctcttaactgctaagcactttgtgggtctcagcgtttttcataaaagaacttttgtatttaatacaaagtttgctttgagacttttcagcatatgatcttttttccataaacttgtacagtgcaaaagacattttgaataccatgatcgatgatgtcccatgcttcgaggaaaaccaaacactttccgcctctcttgcaaaatccattcctcatgctgaccctcctcacgatggctgtgtcagcccagccccttcccttctccaggcccagagaactcttccacaaacaagatgagagccactcgggaaaagagccatagtcaactgggagggcctacatctggatggcggtggaaaaacttgagggtttggggttcaaagtcagcccatcccacctggcaaaatcctcctggaaggaggaccttcaagagcgcatcacctgaatgtcgtgaagaagtatctctgaatgtatccaggagaggaactgcataaccaaaggggtgaccagccctcagatgtgcttattggattccagtacaaacgccaccaaagccagcccactgctctcctacaaggaaggaaagatctgcacgtgtaaaacatggggcagccttggaacatggtgttttttggagtttcctttctcacagttttccatctccccacttctttgatcagtcatgtgtccgtgacctcgttccatgacatcaggatagctgtgtttgcacaccatgctccatgttcattcggagccaggaggggttctcagtggagcctggcttagggaacagggagcgatggaagaatgccaacattagcgttggtcttctcttgtcaggaatgaaggatgcttgcacacatgcaccccctcactctcacacttgcacacatacacacacacacacacgaaatggttggtttgtcaaaactcactgtagtacataaagcttgcactctgcgtcctatatctagcagcatggggtacgtttggcagttcactccattagggggtaaataatttatgaccattcatctgtttttatgaatttttttatctagacaataattgtaaataaagaactcaccatctctgttcatttaatactatgcaatggttatgctttcaatcgctggctcttctgactcgtgcagtgtggttctgaaatgtttgtggtttaaaaaaaaaagcaaaaaacaacatcaaacagaacatagtaaatatatctgtaatgtatacttttttctactttgggactgcatcatccacatagcttcttttctgtcctctagacaagggctccaggagtaagtggcagatttggttctgagagctaagctcaccaacttgtctccccctcaacagatgagggaagggcagggagcccgttcagtgactcctggcgctgcagaatcactcatctttggaggtgagcagagagagctctgaggagtttccttcttgcaactcaggcggagctttctttaactcaggagcagcctccattgctcccgccaacccctcaccatggccccttgtccccttgtcccaaccatagcatagagatgacaagagagaggcagtcctatttctgagactggaccaattaaaatgactgcactggctcaaggactctgaacctgtcttgtcctgggtcctccagttgttggaagccactcttttccccaaccatgctgaaatgccacctttaccacacactgatgtcttacatagacttagatctatttctggaacttctcttctcttcgcttacttgggtgtctcatctggcaccagccatacaattttaactattgtcaatttctaatgtcttattatgtggtgggatgagtcccttcactcttcttttacaaaatttcctagttattctctcacatctattcttccacataaactttaaattgtgcccagtcctccaccccctgtcccattcccacccccaaattctgggctctgtcattccctgtgccatcatcttccccccattgtaattactgtccactcagggctgtgaaatagactatgttctataaagagggacaaaaagggcatcctgatcttgagagaagcctgctgttcctcccatcatttcacctgccccctaagcccaggagttgtcatgagaggtcaccaggcccccactcaatctcagcttgggaaccaaagtcacccaccttggttgtgttggggtggacccgccatctgtccctggtccagacgagaaagaggagtctctcctaggcctggagctgggaaagaatgtgtggcccagttgtctgcacttctaattctcatcatggagaaacctttattcctatctccctttcctgaactggttttttgttgtttttgtttcattttgttttggggggatagtttcttgctctttaatttggagtctccagtacctttgggatgcaggcagttcttgcctgggccttctcggaaccctcactcccctagcccactcttgcgctacctgcaggaggctgccaacctggtgcattctgacaagcctcccacccaaatctctctcctgccattgtgtccaaaatcccaccattagaggctcttgtagggaagagcgtttcttgaaggcttttaggccttccagagccaggagggaagtcagacaatagcaggaagtccccaggccttttcaaagttccaaaccaagctctcctgattttaatgtagagatcataccaacccaggtgggggaggagggtccccagccccaggcagcagccatcaccccctccactgaaaacaatattggaggctgctttgggactgcccttctcagccccctaagtctgttttgtaatgcctgtggtgctctccctcctggacctttcctctcgggggtcaccacactttgctaactcttgtgtgcacatattttataatagagtagcgagggaatggtgccgcctccagcttccgtaagctgcccgggctctggggggctctgggacaatcggggctgggaagtgactgtgctcttattgtacactctttatttctctgtatctttggcttgtgctctttgtaattaatgggatttgtctgccttttcaacactatactgagcaataacaataaatgcacacgtggaaatgcagacacggtacacatcacaaggcctttttctgaaggacagctgggtccccgcccttcgtggagttgaactcagggggaaactgagtccctgggagggaaatgcactttgcccaagggcccacagctcagcgggcagtctctctccttccactagatcacaccttttgaacacccaccatttgagggagacaggctcaccctgccatgagccattaacctatgaggaatggttgaccatctcatagaagaagactggggaacggggcctcaggacgaagcggaggaggtttgggggcaaggggtgggggggcaaaaatcagggaaagttggcctgatttggggtctggattaaccagagggaggagatgcggaatacagacactggatctaggtggcacccccctactggggagaggggtaaggcagagggaagcctggcacctgaggagtctggacttcacaaacctctgctgaacattggcagagaaagagaatatgcccagaccaacaagtaatccctaaggttggcccaagggttgagagttacacacacactcacacactcacacagctcttcttaggttgaactgatccccaaatcaagcgccataggcccatctgacttccatacgcagtttcatatccaagggttcatttaatcccaatatcaaccttcagaggaggtattattataattctcactcaaaagagcaggagacagcatctcaaagaggtgaagagcatgcccacctggtaagcaggagatccagcactgatacctagcagtcttgatgccagcatctgtactctaaactgccatattacagcgccttatgggccaaataccttacagcaaataccttaatgaataagatacagttctgttgcttgtcacaaatccccaatctcttcaacatcagtgtctacacaaggaaattcttttaatcacaattatgcctgatgcattatatttacatctaatatgcccttgtcctcattttccactcaaagaaagtgaggctcagagaaaagtgacttggccttatcacctagaaagtcagtggtgcagctatagagccaaggccagagcctgttccttgaagaacaggagatctggcaggacgcagcggctcacacctgtaatcccagcactttgagaggccgaggagagtagatcaccagaggtcaggagtttgagaccagcctggccaacatggtgaaaccccatctctactaaaactacaaaaattagccaggcatggtggcacatgcctgtaatcccagctactcaggaggctgaggcaggagaattgcttgaacccgggaggtagaggttgcagtgagccaagatcataccactggactccagcctgggcaacagagctagagtccatctccaaaaaaaaaaaaacaaaaaaaacaacaggagatccaagagatcccctgaaacctgcctttgttccctgctctaacctaaccaccaccccctcacacccctgcaacaatttctccactagagggcaataaaaaatcttgaaagctgcagtggggtagaagagttgcccagaggcctggcccttaattctaacaccctactcccctggcctcccctccaaagctccttgacagtttgggtctatcacattctctgagccttaacatcttccttcaagcagtgaccatctccagctagggtccttactcccagtttcagcagaggaaactgaaggactgtgacttgcccaaggggagccaaggcctcccccagctcatctgcctccttaatgtcacaaggggcccagggctagaccatatgtggctgaggcggggagcccaggctctgtcctccagtgtggcattctcactgcgcttgtggggagccttcagctgccctaccttgtgaagccagagacctggggttggggaccctgaggattaggtctggggctctagctgcaggagcctggctgagatccttcattgcctaggggggtctccttgatgggacttactcaggaccccaggggatcggtttggaaggggcagtcctatataggggttagggatggcagggccagaggtcccagcctctggcgaggggcattccctggcctcctctgccctggtcccagtccttgggtactgagagggagactacaacaaggaagcactaggacagtctacttactcctaagatgtcactcatcctacaacattcatcataagaccagtcgcacccagagccgtagtgaggcgggtgaagctgcagatagatagatgatagatagatagatagatagatagatagatagatagatagatagatagatttttttcttttttacaagagtgtctctctgttgcccaggctggagtgcaatggtgcagtcacggctcactgtaacctccacctcccgggttccagcgattctcctgcctcagcctgtagctgggactacaggcgcgcgccactatgcccggctaatttttgtatttttggtagagacggggtttcaccatgttggccaggctggtctcgaactcctgacctcaggtgatccaccccccagctcagcctcccaaagttctgggattacaggcatgagccaccgcgcccggccgatagttatattaatcctttctttcatttatggatctcaggaaaagggcagacttggtcgggagagtagacccaccagagcttcagattccaaagccctccgggtcagggtaactgcggcaaccagagccccagccctctggtctcgcacgtcactggaggataggggctgggccacgggagggcggggcgcgccctctggaaggcgcggaactgctgtgcgagccgagcgcgttgctgcccggaggctcctacgccacggcccgtcgggcccggcgccggaagtgagctgttccgaggcgccgccgggagctgccacgtccgagacctggagcagccaccgccgcaatcatggtgagtgttggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgaggccgaggaacctccctgactttgcggggcgcgccgctcctgcgtctcctgccagtctcccttccttcttttcggtcaacaattgaaaacaaaacgaggaacagcagaggagctactgtataccgagccctcagcattgttcgtaatctccgcctgctaacagccttgtgaagaaggtgctattcttctcaacactttacagatgaggacacttgaggttcggagacgtggagcctcttgcacagctgcttaagtggtagtagagccgagatttgaaccctcctaaccattcctttctgccgcctactgcagctcccagcagagatgattgaactgttgctcggggtagggcccccaggtaggatgggcacctcgggaaacgtaaagatggcctgaacgaccctccgaaggcaggggctcagggttttttaagtctctgtggcatctgcagtgtacattcactccacacttactccttgagtgaatgaatgactgaaggagaactaaagaatggaagtatctgggctgagcctggaatatctagtacatgcattcttttagaaacatgggtgtgtctcagcagcaggtttgagggaacctgcaggaacctagaaatcagaacactgtgttcttgttctgcagagggttaggtgtaaatcactcacctctggctcttccactgcaggttagagttgaggcttttatgctctgacattcagctcatcctaaatgaatttttaactcattatctgatctcaaagaggtgaattattttgagtgcaggtgttaacagggaccagataataccaggtccctgggaagaagtactctaagaagttctctctctctctctctctctcccaccctccctctctccccactccctctccctccccccttcctctccctctccctttctctctctccccctccctctcttctctctctctctccccgctccctcttcctccccccttcctctccctctccctttctctcccgcccttcctccttccttccgtccttttctctccccctccctctttcctcccccccccccccccccgccttccttctctctctctctctctctctctctctctctcattcagaagtgtggttcatcaaccctgactggtgggtgagagtggttagaattaaatgctgattatttctaaggtcctttggtaacctggttgaaactacctctcagtaaactttcttcgtgaacctacttaaccgcagctttacagaactcagtgtaacaactgctttacattctagacaggcagcctggtggagtgaagttttgtggactcagcattagaaggttaggggatggggctcttttcccaggtctgccttgaactagctctgtgactttggcaagtgctttctcttctctgggcttcttcatttccttagtctgtcgcaggtctctgattgactgtgcccttggtaccctgccctccccgccttcctgtgcactttgtaacctatacagctcggcacatggaggaaactccttattgtccttacttgcctttgcagacttcggggacctggtttttagagagtctagaatctgatgagagaacctgtgcttacttggtgtgtacctcttgaactgctttgcagccatcctcttccactgtctgcctttctgaaatcacaagtcaaactttatacctacagggcttgtgctggaaaagatgaaatggggaaaatggtaagaaatgtctgttccacactgaaacttcttttaagtcctcttttctatcccaagaatttaagagaagagtggttgagcaaagaaaaaaaataacagcttttgttcatttacttattcattcagcaaatagtcgctgagttccttctatttgcaaagcactgtgctggatgatttgaggggatttgaaactgcagatggctcagaccatggctccaaggagctcaccttctagtggggagaagaaacagcataaagtgttgtatgtgttccttgctgaagatatgcaagagagtccagccatttgagggtctgagaatcttcaagaaaggtgatggatggccctttttgagctggacctcaaagaatagataggagggagatgaccatgacaccatgttccagccctacaaactgttcaactctggatcccactacgtgacggaccagggagcagcctcaggaaacactcgaatcaagtctcccagtctgaagtaataaccccgttatgcataaactgcctggaacatcagaggctctgtcatccaggaaaggaacaccagctgtagctcccttggggtctctcctcaaccttaagggtagccaggactgcttgccgtttccccacacacatcaggctctctcagacctctttgtctctactcgtgtattccctctgcttggctgcttggactggtattttcccctgtgccacctgcaaattcctacccatcatctagggctcaattcgtgtctaccaccccagcccctcaggctcctacaggacacacaaaccaccattaaataatttatcttgcgacactagcattattcgcgagcttctcaagggcaaaaagttcctcttatttgtgtctgtatatccagttcctagcacagtgcttggcagaaagaaggtacttagaatgaatgcttactgaatgaatgaatgaatgagtgagtgaacaaacaaatgcagtcaagaacttgagatggttgtattctaactgccatgagttaatttaccagtgatatctttggttctaggtgtcagtaattaacactgtggatacctcccatgaggacatgattgtaagtattaatatcaccctccctggaggggtgtggacatgggcatttttgtgggagggaagcaatttggggttttcattacccctttctgttgatcattcatggatccagggtggctttgcagtggttgcctatcagcctgtaatctcggggtatggcaggctccctagcagtgccctctgagttgtcaggactgtggcagtctaatcactctctgctgggaggaacctgggaataatttgtagttctaggctgtcagtcttccagccaacacaataacctgctctcggatgaaggctgagtgggtacggaggcttgacaatagtcttcccacctgtcttcctcctgctgtcacttcttagccccactggaaaggggggtgaaaagaagagagtgtagaaagatgactcaatacaaaggcagagggcagccacagtgaaagccccaggcagagcccagtcaaaccaccaagacaataggccagacaaggccctttgaaccagaagtccacactcagggcatttcctgagaggtaaacacaaggctcagtataagaggacagggctgcaggagaaggtccagaggttaaagtctaccgcaggaaaaacacagactctgcttcattcagggccaagcagcctttgagcaagacccaggacagctggctgacagtgtttcatgtcagggttcttgccctcacaacctgtccaccaacagttgcttttgggtttctgagaggttgtctggtcccagagttgtatatgttctctggattcagtcatgagtggtctagctgtaagaccacacctccttggagatagcatggaatcatgggcaggaagacccagtctgagactccctagccaatatcttaacttttctgagccagcctcaatttacttacgggaaaaataatggatatgctacctactcgtatgagtttggtttgagaactagatgaggccaagtagtaatgacaaacatttgcatgctcactgagtgtcaggccccatgctaagtacttttctttttttttttttttttttttgagatggagtttcgctcttgtagcccaggctggcatgcagtggcgtgatctcagctcaccgcaacctacgcctcccgggttcaagtaattctcctgccccagactcccgagtagctgggattacaggcgtgcgccaccactcccagctaattttgtatttttagtagaggcaagttttctccatgttggtcaggctagtctcgaactcccgacctcaggtgatccgcccgcctcagcttcccaaagtgctgggattacaggcgtgagttttcattcaatatcttgtttaaccttcataacaactgttgagacagatgctatctttagccttatttaaagataagggaactaaggcccataggatgttggtaaataataaagataaggaaactgaagctcaaggagatgaagtgttttcaaagtttgcacagcaggtaaactaaggagataggatttagatctgaaaggtactatgtcctgcctccttccactgagaagcatgagaagtgcttcagaaacactcctctactgcctgccctccaagaaaccaaggcctgatacagtggagggagttcccaaagaaaaatcaggatgtgttccttgcgtagggaggtgagaattcccatctgagccagacagaatgagtgcctttgaatgggcataattgcccctggtggccatgggagtgcagctgatagtcctgaaactcccagggtgggacagctggggaaagggacatccattggaataggcagggccagcaagcagaagggaccagggtgttcagtggtgcaggaggcatggtgcctcagagaccatcaccctgcggacaaggatctgcaggtaggggccaggcctagttctgcatgctcagtcagcatcaaggaattcggttcacaagtggtgagagcagcgacacttaaggcattgtgttccttgggtggaaagtctgggaagctctgggcacactactagggaaaaggtcgagcagaagccccaaaacaaaggtccacaaaggatccagggccagggctggaaagagcccaaatatctgaatggaaccctgtgtgcaggccagagctgcatcacagaagacctgactggggactccaggcagtcagaggcccactcctttggcctgctcccatgcattagcatcaggtgctagggctgagctgaacccaggggtattcccctttagcccacagagcctaagaactgaatagggcctgagaggatggaggaagaagagggcagctaggccaactttttttctcccatacccaccctgcggaacaggaatggaagagcccttccctgaggtatgtaaagggtctgtgacaccagctgggcatggcttgctttgtccatttcagagagacactgcccataggtgaagtgagaatgtccacatgctagcttcctgcctgagggtgatgatactttgagatcagattgatttcagggagattctggtccaaactagactctgtgtagtgacagccctcaccccacccacccacccacccagcctgcaggcttcccgagctgtcctccctttgcagcacgacgcccagatggactactatggcacccgcctggcaacctgctcatcagacaggtccgtcaaaatctttgatgtgcgcaatggagggcagatccttatcgccgacctcagggggtaagtgctggcgagcccagggaagggctccaggaatggtgtgggttctcaggccctgcttcaagcgtgggagcaaagcatgggagcccagattcagagcaaccccaaagcacatttagcggagaggacgctgggatcccagccagcctggctgtcctcagcggacgtccccagggatgatgctgttaagggcacaggtggatacaggtgtgaatctcagctctgccactttatgtgtacccaccagaagaccttgggcaagtgactcagtttctctctcagagccttcatctgctcatcctcaaaattgggccaatgctacctcctatccagctagtgtatgcaaggccctgacacagggcccaggacacagtaagtctttagtgcaggcagctactgctacttttaaaagtggtaaacagtaccatttcgttcaagtttagccagtatgacctaaagtgtcacaaaagcatcaccgtaagaataatgtaagaatgctatcattttataaatcccattgttctgcctatatgcccgtggcacgtgttcagtgattatttacaaatgtttgacctgccctgctccctactgagattcttgaggaagtcctggctcatttttatggccacatctctactgctttccctcagctcactgcctttcacgtatttgtgggtttgcctgggtgccgtggatctccaagggttctgtgaatagagttcaggggttgatgaattgggacagggggaaaaaaatgcattttcagtgactctgatatttagcatttccttcaattatggatgtaggccagaaacttcagtagtatttgtagtgcctgtcactttgtcaccagtagaagtcacagatattgtcatcacacatcacggttacttagctacctcaaaataccacttatgctcatcacaactttgaaattacagtggttattagacctgccgctagggtttgttgcttgaagtgttaacaaagaagtacatgcatcactatctcataaattgctttataatattttgataacaggctgggcaaggtggctcacgcctgtaatccttaacactttgggaggctgaggtgggaggatggcctgagcctaggagtttgaggctgcagtgagccacgatggtgccactgcactgcagcctggatgacagggtgaaacccttctcaaaaaaaaaaagttgattactgtataatttataattgaattttctttataagcctagttctgtgtgttttgtacattagtctgatgagggtccataaccttccccagaatgcacagaaaagattaagagccatgacaggtgggtgctcagcatgtgtttgttcactgaattaaaaagcataaactaagtcagtgtccatttggggaaatgggcctagaagctcccctctgtctgagtgtcaaatgatcaagtgactgaggagccaaatcaagcttctctatgcaggagccccccaggcaggcagagagctgctgcagtgcagcgtgttggccaaggcagttatgtttgctgtgactctgtcctttctgctgtttttcttacattcaaaggatgtgaaatattggagggataaaaaaaattcccaccccattcttttttccccttagtaaaaactgtgctagttgttggaagattgagtctactcagtttcattagcagcagctttgtagggactgggaatgtcctgttgtcccagccagagggaggaggagacttgagtgtgtgcagcccacggtgaaggagtaaaccaggagcagcactaatagctaatgggtattgagtggcttttttctttccttctaccaagcattgttccaaactttatgaaagaattcttattgatgtctccattttcaggtaaagagacaaagatatccttgcctaaagtcaagagctagtgaatgggagaatgggtctggtctcctaaccactaactctaccatgctactctacctcttgagtgctaaggtgcaaaaccttccctgggccagagaaatggtcaccgtacaaagcctggcacagagcatgtgctcagatagcacctgttatcaggtgaatggataaagatcagaagagaagggaaagacatgcctttcgaacaaattaaaagagtagtggaaaacatcaaaatgaaaccaataatgcctcctcaggaagctgaccgtcgggaaggatgaatagcaattcagtctacaaatatttcctgaacacttctggctggaaaccttggaccaattaatgactatgctgtagacagcacatacagacagtgctggctgcagtctgggcaagtgaggctcctgcctggccaggacaggaaggctgacccagaggctcaactctctctcaaaggctctgtgaccttaggttgcttaacctcttaggacctcaggctcctcactgtccactgagcaccccttttgcaatggcattgtatagttctccctttgaagttcttaagcaattctgccctgatatatcgtctcagggagccatttagttctgtccaaagtagtgcctgcagaggcactgtgggttcctctggcctatctctccctttgtagtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcaggtatgctgagcttggcagcagagcgggcaaggggaccactgggtaaaaaaggactctgtcccggctggagccctggctccctgcccctcgtggtgcctcttgtctgtctcttgagctttggttggcttttctgctactctgtcctcagctgagtaaggccctaagacctaaagccagtccaaagcaaataagaaaagacaggtgagtttctcttcaggattattcattgcaaggactacccttcattctcagattgttttcctacccacttttttgttagatagactgtaggttatgaaatcgtggtattagtaggtgatggggtttttttgtgtcctcagttgaccaagttacagcttcccccggtgactcctacagttgtttgttgtagacatttagtaaaacagtaaatctgtggaaggcgggacctggggccgcggtctccctgctttgctcactgcactctccctcttcccgcagtgaactcggtgtgctgggccccccatgactacggcctgatcctggcctgtgggagctcggatggggccatctccctgctgacttacaccggggaaggccaatgggaagtaaagaagatcaacaacgctcacaccgtgagtccatcccctgcctttcgtgcagtgagagcgcctgccttgccccgtgtctgctgcagcctccctagagggtggcacgggagggtccccgctggacagtgggccggggagtggtcagctgaccagacatgattgctctagagcagctttgagcctctctgccctgaagccagaccaggcagggcttggcactgcttccttgttgtgtgctcccaagcaggggagggctggtgcagcagcagcctgctcactgccaccttagctatggttgcctccaggtgacatgccctgcagtagtcattgggaccctgtagaatggagtggtgttattaaaacttttaaaaagtatgtgagctatgcatacatttaagaaagattaatataaacaaggtcattctttacccaacttttggtgaatcagcgagtgacagtggtcgtgatgttggtggttcaatcaaggaataaatgtttgcaaagcgaacatcaatgtcctacctcctaccaccacacagttcaaaaaccaacaataaccaatgtggggggctcatatgactaatgccacatcgtttgctgtcatgcatctgtatgattattggatattttatgagtttaattctacaataatttgtatctattctttttctaatctactcattccagttcagggtcacaggtggttggagcctgtcctggcagcttagggcatgaggcagaagccagccctggacaggataccattccaccagaggagcactcacacacacccccacactcacactgggacaatgcagacgtaccattgaagtgaacatgcacatctttattgtgtgaaaggaaaccagagtaccaggagagagcccacgcagacacagggagaacacacagactccacacaggcaggggcccccgctgggagttgtttttttttttttaatcttgtcagcattataatgaaatgaaattgaggatcagttgtacatagaatgagacaatctgtggtcttttgtgactggcttctcctacttactataatgagttcaagtttcatccatatcatagcgtgtatcagcactccattcctttttatggctggataatactccattgtgaatatagacattttgtttatccattcatcagatgatggatgttctcggccttatgaataatgctgctatgaacatttgcagataagtttttgcatgaacatatgtttttaattctcttgggtctatacctaggtgtgaaattgctgagtcatatggtaattctgtgtttaactttttgaggaattgctaaactgttttgcaaagtaactgtacccttttacattcccatcagcagtgtatgagggttctaatttctccacatcctcactaacatatgtctgtcattttggttacagctgtcctagtgaatgtgaggtggtatcttattgtgattttttgggtttgttttgttctgtttttttgagacggaggcttgctctgtcacccaggctggagtgcagtgacatgatctcggctcactgcaacccccgcctcccaggttcaagcaattctcatgcctcagcctcttgagcagctggaattacaggcacacgccacaacacccggctaatttttgtatttgtagtagagacagggtttcaccattttgcccaggttggtctcaaactcctggcctcaagtgatccgcccacctcagcctcccaaagtgctgggattacaggtgtaagccaccacacccggcccttattgtgatttttatttgcattttgctaatcaaagatgatggtgagcatcttctgggggcctttggagaaatgaccaggaggggtttgcactctgtaacaccgagtgagtggaagcggcccacaataagaaaggctgaaggggcgggaagaaatctgagctctgtgatcctccagagcaagcctctgggacagggcccctcaggaggaagaactgcaggaaatgaaatcacagttgagctggatagggacacaggaaaggaaggatgagatgtagaccaatgtggggaagaggaacaaagacaggaactcctgaaagccatctcccacgttttttaacaccacacagaaacaagggagagttctgagcttagactttcctgagcctttcttatcaggaaaactcatctcacctaaaaataacagaaaagtatttgaagtgaaattgcatacagttgttatataagaaacaagaatatgcaaaataacctccctgcggacaatgagagcacattagaaagacatgcccacataaccgagccaagctgtaacctgctatttcaaatcaagccaggtgacattctaacaatacaaaacaagagagaatagtgtaaatcaactttttaaaaatcagaaataaggtgacagaactcaggaaagaattagaattaaaaatcatttcagaagtaaagaaagactaagacgaaatgcaagtgtcgatgaacacagcagatcctgcctgaaaaggataaacagtgtgaaaaaggaaacatttcaagagcaaaaaaatgaagaggtaaaaaggttttgaccaaaagtaaagacaggcagaaaggtcagacatacgaataccaggagtccctggaaaggaaaacagaataccaaaaagtaatccagaaaactttcttaaaattaaaaaacaaagatttgaaacttgagattgagagatcataccccacacttaacaatatcagccgggcgcagtggctcagcctgtaatcccagcactttgggatgctgaggtgggcggatcacctgaagtcaggagtttaagaccagcctgaccaacatggcgaaaccccgtctctactaaaaatacaaaaattagccagacgtggtggcgcacacctgtaatctcagctactcggaaggctgaggcaagagaattgcttgaacccgggagtcagaggttgcagagagccaagatcacgccattataatccagcctgggcgacaaagcaagacttgtctcaaaaaaaaaaaaaaaaaaaaatcaaggccaggcgtgatggctcagcctgtaatcctagcactttgggagatcgaggtgaactcctgtttgaggccaggagttcaagaccaacctggccaacatagtgagaccccgtctctaaaaaaaaaaaaaaaaaaaaaattcaactcagcatcaccaacaaaaagatataattctagtaaaattattagactttaaagaaaattttggggggttctagagaaaaggaaccttgtgacttaaaggggaaagacaattagattattgtcagactcttcaatagtaaggattggtgcagaagaaaaaagaataacatgtttaaaatactccaggaaagaaagtgtgagccaaggatttataaccaggaaaattgactttgaagttcacacaaagacttatacacaaaaggttatagcagctttaatagccaaaaactggaaatagtccacatgtccatcaacaggtaaatgataagttgtgatatatccatactttggaaatactgcgagcaataaaaagaaatgactgcaataaaaagaaatgacttaacaaaataagatgaagaataaatttcaaaataattatgctgagtgaaaaaaagaagaaaaaggacacactgtgattccactgctgtaatatctaggaaatgcagctgagcaggcccatggtcaccacgattgggggctgcaggatggggagatggattaccaggggatccgaggaaacttttgggaatgatgggcatgttccttatcttgattgaggtgatgtgatgatcctacaggatatatttttgtcaaaattcaccaaatcatgcacttgatatgcagtttatgtcaattatactatatcaaagctgtttttaaaattagcttttgagtgtaaaggatatgaactattatcaatatgcaagaattcagggactattgtttctaggagcccttcctgagaaatctactagaggatacaagtcacacaactaaaatgactacaaagacttcagcataaatatatagttacttgtagagaactaagacgaaatgagggttaaaaggctgggcccagggcaggcacagtggctcacacctgtaatcccagcactttgggaggctgaggcaggcggatcacctgagctcaggagttcaagaccagcctggccaacatggcaaagccccatgatgtggtttggctgtgtccccacccaaatctcattttgaatgcccatgtgttgtagggggtaaccagtgggagttgagtcatgggaggaggtcttttccatgctgttctcttgatagtgaataagtctcacaagatctgatggttttatgaaggggagttcacctgcacaggctctctctccctttttgctgccatccatgtgagatgtcacttgctcctcccttgccttctgccatgattgtgaggcctccccagctacatggagctgtaagtccattaaacctctcttttttttgtaaactgcccagtctcaggtatgtctttatcagcagcgtgaaaatggactaacacaccccgacgctactaaaaatacaaaaattagccaggcgtggtggcacacacctgcagtcccagctacacgggaggctgaggcaggagaatcacttgaacctgggaggtggaggttgcagtgagtcaaaatcgcgcctctgcactccatcctgggcaacagagccagactctgtctcaaaaaaaaaaaaaggcagtggctcacacctataatcccagtactttgggagtctgaggtgggaggatcacttgagcctacgaagtttgaggctgcagtgaaccatgatcttaccagcctgcactctagcctgggtgacagtgagaccctgtctcaatttttaaaaaaaaaaattgttaataataaataaagaggagaatcagtcatctttggaaagtgatagaaccagttcagaaagaatcaagcgtttatccagcctttcctttttgaccttgtattagtctgttttctcgctgctggcaaagacatacccaagactgagcaatttacaaaggaaagaggatggagaactcacagttccacgtagctggggaaacctcacagtcatggcagaaggcaaggaggaacaagtcacagcttacgtggatggcagcaggcaaaagagagagcttgtgcagaaaaactcccatttttaaaatcgtcagatctagcgagacttattcactatcatgagaacagcatgggaaagacttgcccctgtgatacaattacctcctaccaggtccctcccacaacacgtgggaattcaagatgagatttgagtagggacacagccaaaccatatcagacctctatccctgggtaactgaatagttaatgagaagaagtgtccctatctggagcattccatggaataaatgacaaagaaaggatggaattagagtatcaccattttacaagccccagtgaattaagagaggcctgagttattgacagctgttaatataagagacaatctaacgtgcctcctgatgagagaacgcaccagctctagtcttgccaaagggatcacacctgagtctgtccagtcttggctccagctgacagttttcaggaattcagaggaacatattgaactgcatatgaagcagcaaaacccagaccgagagactaggctctcttcagcagaaaaattgtaaggaaaaaaatcagaggaggaatctgcaaagtaggagatgtaaaaaacatccaaaaaaatgtttaatggacaagactaaactatagtatctaggggtgcacatttgggtgataaaatggggggaaaatgggttagaagttagggcagtggttacttatagtggaagagggagctgtgattaggaagggcataatgacagggcttttcaggcaggtggcagaatttttgtttcttgatctattactttataataaaagatttttcttaaaaaaaagctccaatgtaccattctttcatgtgtttagaaaatgtcctgtttcttaaacttgtgggagttcttaatttctacttttagcgcacactgcagaaaaatgcacacactgttgggatccttgagggagaattctgagcagtggaccccatgatgagtgcttcatgtcagccttcacacacactccagtcctgagaagcggaggggagagggacagcaggcttgggtctgcagaagcagtgttctcttgcaaggcagagtcaccatgtgtcccatctttacagattggctgcaatgccgtcagctgggcccctgctgttgtacctggaagcctcatagaccacccatcggggcagaaacccaattacatcaagaggtttgcatcaggtggctgtgacaacctcatcaagctgtggaagtaagtagggatgtgtggccttctctttgaggggacacttctaccctttaccctactcaccatgactcagccacactcacaagaaacaaggtcacctttctttctccctcctgccagtaaaatactgttttcaatctgttggaggacatccttgaaaaacaacacaacacctgttcacctaattcccaactgttggagctgactctttggctgtggaagcagagcattttctggagggttttttttacagctggggtgaagggaataaaatgccacaaactccatgaatgaaagaagaaagatggaatcgcttctccaccccaggcagagcctgttgggttggggaggagttgaggtgtgggaacggccccctgctgattctctttctgtccccactgttagggaggaggaggacggccagtggaaggaggagcagaagctagaagcgcacagtgactgggttcgagatgtggcctgggccccctccatcggcctgcccaccagcaccatcgccagctgctcccaggtcagcccagggccatgagtatcccttgtcatttagtctcgagtcaggcccatcagctcttagtctccttagcagaaagtcctctgggaaggtaaagggagagcaacaggcacctttggcccagagcacagggagtcaggtcattgtgtggggaagtcttggtcagaagccacaagtggcctgcctccactgagatgagacagctacaacagaaccggcaccaagaaggaggcggattcgggatgaattttcccttctgacccatgtgagactagggcgccgaggtgcccaggtgcagttccaagtgttcccaagcaacgatggggttggatgggaattatacgcttagctaccaagccacccttcccagacagcaaggacggccaagggtgagccttcagttatacaccaccaccctagagggagccagctaggcctttcacatcatgggaacctgtttggtttggttctaaacttgggatttttgtgcttttttacttgtgccttctcattcttggagcttggtttttggagagctctgcccattcagttgagaaggtatagacggccagtggaagtgacttggcaggcatgaggaaaaccccagagaaaatctgagttagcaatgcagacagagtccacctccgaaacccggatgagaaaaggaatccgggagactcttaaccagtgtgaagagacagaaacaaagctgtggacgccccagaggtcctcggctcccctttgaatcccccaccctgttcctgcagagaggtgccgggtggctctagactgggaggacatcacatcacaaacgcaggagtcttgactccacctcctgactctatcctgtttcttcctaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtacatacccattccccgtggcatggtggacacagcctgttggtcttcaccccgcccactagagagggcacttgacattcccatctgactgcaggctgggcaggagccttagccaggactgcgttttgagtgtgcctcttagttacatcattaatgtcacagcccctgaggtagtattaacacgtccccctttcacagatgaggaaagaagctgacagaggcgatttgacttgcatgggggtcccaaaactatgaggtggcagagccagtcaggcccatcaccctactaagcatttggtcacctcatggtgatgttcagttagctgtgccaaaaaggcaagtgtataagaacccataaacagaagaagattggggatattttttgtccataacactgaaaaggctttttaaaaacctttagagtttatgaatacttgttatgctggtaagaggcaggtacacagtgggtgcactggaagagtttgcattttgcagctgaaagagttctggagaccagctgctcagggacacaaatgtacttcacacaactggactgtgcagttaaaagtggccaaggtcattttatgtgacgtgtattttacaattagaaggaaaaaagctacccgcagaaaggaagcagtaacaagccatagccatctgcccagctgaattcccctataagacagaggatctctaacgccgcagggtcagttccacgtggagtggctgtgctgcgttttcaggcacatctgctctgcgcctgaagtgcgagttggtctggatcctgccagcccttgctgcttctctcccttgcctatgttggtcttttactgtttcccagtggccactttggctccatgtcttacctttcatttgtgtggctcacggcacaaccaacacaggcaaggcagagaagcagctggtctccagaactcttttcagctgcaaaattgaaactctgtacccattaaataactcccttccccattgcccctccccagccctggcagccacccttctcctttctgtctatgtgaatgtgactgctctagcgacctatctaagtggaatcatacagtatttgtccttttgcgactatgtcactagcagtatgcccttaaggttcctccatgctgtacgtagcatgtgtcagaattccttcctttgtaaagctaagtagtgttgcattgtatagacagcccacaccctgtttctacacttattcctccaccaaagggcacctgggctgctgccacctcttagctattgcgaatagtgtggctgtgaacatgggtgtgcagatcttgagagcctctgcaggcggcttttctggccgagggtccctttcatctacagtggtcccagaaagatctagcaggccccctctcaaagccatatttctagtgagtgccagagtcaggaccagaacccaggttgatggcactcagggcagaccaagggacccagattgcctcaagcaggcccccagtgacttttttacaaggctgtaagcaagtgcctggctgtgcacgcagtgttgtggggcccgtcactgtgcatttaggcttcttgctcttctttacaagcctgtttcctttcgctgtctccatagcacccttacctaaaggacttagtatgttttcaatcccagagcattctgcagtgtgttgagtgaatagtttgtccctaaagcaagagttcttaaaatcaaaatcgttattttcatttttaatcaaactaatatatgtacataggtttagattgtttttgttttttgttttgttttttgagatcgagtctcgctctgtcgtccaggctggagtgcagtggcgcagtctcggctcactgcaacctccgcctcctgggttcaagcgattctcctgcctcagcctccccagtagctgggagattacaggtggctgctagtttttttgtgtgtatttttagtagagatgagatggggtttcaccagttcaggctggtcgcgaactcctggcctcaggtgatccacccatctcagcctcccaaagtgctgagattacaggcgtgagccaccatgcccgacctagactgattttttttaatgcagcctcctaattttctctccaggggcaaaccttttcagctcttagctatttcttatacagtttacttcagtgtagaaacaacatattgaactgttaccttcctctaccacagtagttttcaaactgcagtgttgttaaacctgttaaaacagattgccagccccacccccagagcttcctaatcagttgttccaggccccaagaatctgcagttgtagcaagctcccaggtgaccgatgctctgctctggtctggggaccacactttgcgaaccctgctccccgccaccccatatcctctcgctgtagctctgtcacagtttgctgaaaacagtatcctgtgttgacatcatcatccacagctgctgttattgttactcctttttttctgtgagtttttattcctggactctcattttggtgagatttcagtggaggagggacatgctctgttcacccacaagcctctgggcagtggttcttgatgaggatgaggctcatatttaggggacagcagagggaagggcacagacccgtgataatctgcttgtgcactgactcgcaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccagacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataattcctgctgcgttatcctaaccaccccaccccaccagctcagtttgactcttgtcggtccacgcactagaacaaactattcacaaaggccacggctgtgatggcctggcttaaccccacgcacaaaggtggcttgtcactgcatgagcatctctgattcagtttatactgaaagcaccatacagagcactggactcagcctttggtgacaaggactgtagccctgggtctgctacttaccctctcggtacacatcctgttctgcagaatgggactaatacagtctgccctacaggatggctgcaagattcaaacacgctagtgcatctggtgacctacaaaatgccacgcaggtgcaacgtggtattaaccaaacaccaatagttaagatgctggcccagaaagtgggcacgattcatttagtttattgaccctgtcaggaaaaggagggccccatgatgggagacctaactgaccctgaaccaggtatcacctttcagcggaggccctgtgaccctgacaatcgccatagccatcagtgagcctgcggtgagccagaccctacactggatctttcacacattcgctaatttaagcaacacgagaaccccgtgtgggtgtacccagttcactgatgaggaagcgctcagaaggtagaagccctgcccaggactgtgcaaacgtaaagccagcgtcagggcctggcccatctcaacagttactccccactgtagaatcagggtgggagctggggggctctcctcagctgtaatacaaggatgtttctcacaccaaacctttgtatgaatagattcagataaaaggtcagcccacttgcctcaggccccctagtctgcctacttcttgtccttccctcctttttcagcagcaaaatcccctttaaaaaaaaaaaaaaatctttgatcatactatgtaacatagaagaaagtgaaactgctttggttaaaggtgaggacagagaggccatggcctggcccagtcagcctccagtcagtccacaaagcccaagccttctgagaccaacatgaaaacagctgcttccttccttcccttactcagaaaagcaaagcccaggaaggcaccttcacgtgcactactgagtgtcgagttctacagtgaatccttgaaccatatccacgtctgcctccctgatacgctctgtgctcctcaagcctgggcctgggcttcctatggtgccagctgctgtcgccaagaaaataccgagaaggaactagtcccgtgtcactctgggttggtggtaggttaatgggtccctgactgtgtgctctattttaactcccaccaccaaggattggttaagataattatgaagttggcaccataatagttgtttatacttagagtggcaacacattaaccattcctgggtaagaggagaccccaaaatttattaccacaaaatagcctagtcaaatagaaatactatctgtaaaacttgccgggcagttgtcaagcccaaatgagataaaagtaagggaaatttaaaaggcatagagctctggttagggccagatggcgctagcagccatatgtttttaatccttttgcaaaaacaaagcaactgggacagcaaaagaaacccacagaccctagaacatggagcaggccaaagccttcatagacacaatacctctgagagatcagcagggtgaagaaaagggagtttttatggtgctataagccagagaccccaaaaattgccatcaaatactcatccattctgagtgcaaaactcagcaagccactgtgaaaacaactcccaaaactagaagattcacaggcttccatttacaagtgagcccagaaacactaaggggagaccttccacttctgcatataaaggattaacgattgtaagaatttcccagccaacatggtggctcacaactgtaatcccacacttcgaaaggccaagacgggcggaatgtttgagcccagaaattcaagaccagcctgccaacatggcaaaaccccatctctactaaaaatacaaaaattaggtgcagtggtgtgtgcctctgtagtgccagctactcaggaggctgaggcacaagaatcgcttgagcccaggaggtggaggttgcagtgagccgagattgcaccactgcactccagcctgggcaagagagtgagactctgtctaaaaaaaaaaaaatttccctggctgggcgcagtggccagcactttggaaggttgagggaggaggatctcttgagcccaggagtttgagatcagcctgggcaacacagcaagagcctgtctctttaataataaataagaatttccctcacactatagacaactaggaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaaaatgggagaaaattttcacaacctactcatctgacaaagggctaatatccagaatctacaaagaactcaaacaaatttacaagaaaaaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggggaggggacgggggagggatagcattaggagatatacctaatgctaaatgacgagttaatgggtgcagcacaccagcatgtcacatgtatacatatgtaactaacccacatattgtgcgcatgtaccctaaaacttaaagtataacaataataaaataaaaaaataaaataaaataaaataataaatttaaaaaaaaaacaacaactaggaaatcatgaaaagtacatgaaacaactactgctttcagacataggacaacaggcagtgtttgggaaaagggaaacaggtaagcacaacaaatgcaccaggttactactacccagaagcagtttctgggccaaaaggtaaagagagactccagagtctagtagtctccaggagttgaagagacagaagtcagagttcaggaagaccaaggcaggccgggcgcggtggctcacgcttgtaatcccagcactttgggaggccaaggcgggcagatcacctgagatcaagagttcgagaccagcctggccaacatggtgaaaccctgtctctactaaaaatacaaaaattagccgggcgtggtgttgcacccctgtaatcccaactactcgggaggctgaggcaggagaattgcttgaaccagggaggcggaggttgcagtgagcaaagattacaccactgcactctgccctgggcgaaagagcaaggctctgtctcaaaaaacaaacaaacaaacaaaaaagaccaaggcagaactgaaggcagaagaggacgagaggaggaagctgcacagagcaagctcctgagagctgaagagtctcctggagtctttggacaagtactaaccttcatatatgaagggtgaaaccaatagaccaagcagctggagctcacataggggtgggaatagcccatgttcccagcaaccagaaaaaaaagagacattccatccagaagaacaaatataagagtggcagcaggccaggcgccgtggctcacgcctataatcccaacactttggaaggctgaggcgggtggatcacgaggtcagaagtccgagatcagcctgaccaagatggtgaaaccccatccctactaaaattagccagacatggtggtaggtgcctgtaatcccagctactcgggaggctgaggcaggagaattgcttgaacccgggaggtggaggttgcagtgagccgaaatcacgccactgcaccccagcctgggcgacagagcaagactctgtctcaaaaaaaaaaaaaaaaaaaaaggagcagcagccaacttctcatcagaaagtaggcaaaccataagaaaattaacatctttaaagtactgaaaaaattaaaaaaaaaaaaacctgtcagcctcaaattctatacctagtgaaaatatatatatattttaatacagactctttcaaataaaagctgaaagaattaatcaccagcagagctgccattacaagaaatgtcaaagaagtttccttcaggcagaaggaaaatactagatgaaaaacaggctgggcacagcggctcacacctgtaatcccagcactttgggatgctgaggcagcaggattgcttaagcccaggagtgtgaggccagcctgaccgacatggtgagaccttgtctctacaaaaaaaaatacaaaaattaggatttacaaatacgacttcaggcccagcgcggtggctcatgcctgtgatcccagcactttgggaggccaaggcagatggatcacttgaggtcaggagttcaagaccagcctggccaacatggcaaaaccccatctctagcaaaaatacaaaaattagctgggtgtggtggcgcatgcctgtagtcccagctattcaggaggctgaggcaggagaattgcttgaacccaggaggtatgggttgcagtgagccaagatcacgccactgcactctaacctggacaacagagcaagactccatctcaaaaaaaaaaaaaaaaaaaaaaaaaaacaaatatgacttcaacatattgcaaataccttcaacaactccgatatccctttgcaaatatccctttacaggctgaggtgggaggatcagttgagcccagaaggtggaggctgcagtgagttgagatcacgccattgcattcaaccacaggtgacacagtgagaccctgtctcaaataaaaaagaaaagaaaaatggatctgcactaaggaataaggagcaacacgatagtaaatacctgagttcataagactttttcttaatttctttaatctgtctaaaaactttggctatttaacatgcattgtggggctcataccttaagtaaaaataaaatgtgtgacaataatatcacaaagaatagaagtggggaaatgaaagcattctgtggtgcagttcttacactatctgtgaaaggatatcgtagttgttgaaggtattctgcaatatgttgaagtcatatttgtaaatcctagagcaaccactcaaagaatagaacagtacagtatagctaataagccgacggtgaagacaaaatgataccattcaaaaccctctaaaagtggttatgacaagagaaagaaaaggaagaacagatgggacaatggaaaaattggtgacttacaaatagtctggagattaacagtaatgtgctaacactggtgttttaattttgataaatgtactacggttatataagatattcacgagtggaaactgaattgggttattcagagagaaagatttcatcttccatatgtttatattttctgctggaagcaagcatttataatcaaaatttacctgggatacttggtaatttataatcaaaattacctgagatacttgaaacagattctaaagcccccacgccagagctactggatcagaatccaaggatggagtcttataaacgtgcataaaacttatgaagctttcctcatgaatccaacacaacccaacacaggtctgtatctggaaattgagacgagatggccctccaagccacgtcccaccctgaggtcgtcctatggctcttagcggtccatagactaaaaggctggatgatcagcaacgctgagacaacagtttcagtacagcagtggggatgagaggcaaggtcaagttttgaggggccaggacacagcaaagaagaggacacaaggaaaggggaaggaaatggagatggtaacacgaggggagggtgggatcggtgcacaacagacgttttcaggattaggaacctgggtgtattttaaggcagaaagcagaagccactggaggggaacagaagacacgagagaggcaaagtgttagagctttggccccaagatggccggaggctagggaagccccagtgagagaggcagagcttggcgaagaggagggatgagagagcatggctaaggtcagggaggatttaagagcgatggccgcctatctagaatgagccgcatgtggctgctgagcatttgaaacatggctagtccaaactgaaatgcactgtaagaacacacactggatttcaaagactacacatctgtaatcccagcactttgggaggcaaagtcaggcagatcacttaagccaggagttcaagaccagcctaggcaacatgtcaagactctgtctctacaaaaaatacaaaaattaactgggtgtggtggtgtgacctgtagtcccagctacttgggagcctgaggtgggaggatcatcttagtccagggaggtggaggctgcagtgagccatgatagtgccactgcactccagcctgggtgacagagcaagaacctgtctcaaaaaaatatatatgtatattcatttagacatatgctgttgcacacttagactatagtatggtatcagcatacgttttatatttactgggaaaccaacaaaattcgtgtgacttgcttcattgtggtctgggaccaaagctgtaatgcctccaaggtatgcctgtatatttctattgcaaaatgtgaatctcgaaattataaaagctacaactaggacaaaaagcaaccccaccaaatagccctatatcaaagaataaaatctctttctagaaccccagaatttgcctctttcagactgaagtttagccaaatctatgaaaaaagagcttgctaaaccaactaattatcagtacaaataaaattataatgaaaagtctatgaagataatttgttctcagatgcccttcacatatagcaattaattcacaaatgatgagtcactcatgtgccttcatgaaggcaggccctcaagagacccgcaacagaaaggaaagccaccgactggagagaacctgcttcctgagccccaccaagttccaaaaaggagaatggggcttcgtcctcaccctcaaggagttgccaaactgggcttggttattattcacacttgaaaagaatgaggaaggtcagccagtcccctccaggtcgctcgggcttcctccaagctcctcttggttcaaatttgctgtgtcctccagccggcatctctcctctgttccgtaactgacagggcagcgaggtagcttccggatgactcctcccgccatggttcttccgtccatcagctcttccttcctcaactctgtggtatgtggctaggggagtttccaactcccaggggacatttcagttccccaaagataacacagctttgcacagtggatgtttacttgctggtggtcttatctaagatcaacattggcagctgtgcccggagaggcctccagggtccaggtaagtggaggcttcatgtctcaggaggtacctggtcaccacagttaggatttttctgtttggggatttttttttttatgggttggtggctctgaaaaagctgcaagtcttctctgaggactacagacctctctccaccctctccacattcagcctctctgggctccagggccaaaagatgtctacactcaggtggcagacaggcctgtgaagacctcctggtgacatgctcatatgttgctgggactaaaggtgggattttagccaccacagtgggttggtggtgagatgtttaccaacaggaggtactttgtccctcatgtccacttaaagattcagtccaacccggcctgtgcttctgctgtcccaagagactctagaaagctccaatcctccctgaggttgatcttttaagtcagggtaggtggtcattcggcaatcaactgctctactgcctcaatgtcctcctcactggacgtcctgccccaattccatcctgttcagcgcagactgattttcctggaacacaatgttcattatggagccagatggcatatcagaaagagcactgtattaggagtcaagagatccatgggggaatcccagcattgcccctgatggctgtatagctttggggaaagtgaggccctcttggcattcagtttttcttccagcgaaataaaggattcagcctcccagagctttaaagtctttccaactctttcattcattctatggtctctctctcctcaagaatcctcagtggctgccctcctgcaaaaaaagcccaaacttcttgggctagcagttcccaaggcatccatcacctggccccaaaccaccttcttatgtttttgttatgaccccatcgccaccctcccccaagccacccagccttctccatgctgccctgatgtactctacccacgccttcacctcccctctgcttgccgcaaagccctccctccaaagccctgccccgagttcaccacaggcctctttcctggagcctttgctaacatccctgccgcaagccccagcctaaggtgagctcctctcctgaactgctagaacttctctgcagacaactcattggcccttaggggttcctgcctgggcacccagttggatgaagcactccagaaaggaagaaattcctggggccgagggaaatgaggcagtggccttggcctatgctgggaagtcctatgggcctggtatgaaaccattgtcatctgcagggtgtttcacaggttagaagccactttccccccatcgcctcatttcaccctcaaagactctgggtaaggggaattatttgtggtcggcgtaaggccagtcaatgagagaggagccaggcccgtgctaagcgtagatcttccacctccaggtccaatgcacttccctctcagaagaggcatccgctaaaatagggaccaaagctgctggagggaggcaaggcaagctgctatgtgaaaaaacgccaggccaggcagtcatgtcacacctggcagaaatgactgaagcatagccactggctgaagttatccccacacccactctctggagaggatgatcaggagcagtctgctcaaccgggaggtgggactcctcctcgggaaggtgtagaatcaccagcctggctccctgcggactcccggggctcacagaggccagagcagcaacagcacatgggaaacaacggggcgctggactggggaggtctcagagctctcctagtgatgacagcctcattttacccagggagaaagggcgagtaagctaaggtcacacagcaacaaagctgcacccagaccccagagccactctcctccctccctcctccaccagggccatgcccacttggggcaccccgccaccgtgttccagggacagctggagcacatgcttcttccctcgccaacccagcaattccgcagggcatctgacctccactgttgacttctacccagaggacaagaacatttttagttcccaaggaatgtacatcagccccacggaagctaggccacctctgggatggggttgctggtttaaaacaaacgccagtcatcctatataaggacctgacagccaccaggcaccacctccgccaggaactgcaggtaagctctctctactctccgtgtgcgtttgctgacaggtttattgtccgtgactgctgcccgtccgtttaacctctctgggcctcaggagtcccctctaaacacgggggatgtcggactgtctggctggaagacagagcttcatttaggagctacctctaaccccctccctgctgagtgccctggggcccttgctggttcagcttcctccctcctcatgaaaagactcgccatgagctctcagagcctgggacaaaaggcaccggggaggacccccagcccctatcaagtcctgctgccaggtgttctgccctgaacggccttggagaagagaacacacatccatcatcttctaccttgggaggtggaagcgggggtcctctctacacagcagtcaggaccccagatggtaaagcccttcacgccatctgctgggctcctacctgagcaagctcagaggcacatgagaaggggaggcagctgcctggagaccctctctcccccaggcccacctgtctgcaacccagctgaggccatgccctccccagggaccgtctgcagcctcctgctcctcggcatgctctggctggacttggccatggcaggctccagcttcctgagccctgaacaccagagagtccaggtgagacctccccacaaagccccacatgttgttccagccctgccacttagcaaccagctctgtgacctggagcagcagcgccatctctgggcttcagtcttctcccagagcacaaaggactctgggtctgacctcactgtttctggaaggacatgggggcttagagtcctaaacagactgtttcccccttccagcagagaaaggagtcgaagaagccaccagccaagctgcagccccgagctctagcaggctggctccgcccggaagatggaggtcaagcagaaggggcagaggatgaactggaagtccgggtcggtacctctgcagttttatgcttctgtggcagcgaggagggtggggtcaggggagagggagggcagggagaggtggcagtgaacagggtcccaactacaagctccccagaactataaaaccagtaccacaggagttgagctctgccctgggctctgtgaggtctttacccattaagagaaaaatatctagaagaagtaactttgctacaacagaatagggacggaaggagcctgggcagaggagagagggtgccagagcctccaggcgactcaaaggggacagaaaatacagtgcccagagacaaagacacccagaaataaacggcaggcccagactgaagatgttgctctgcagaaaaccatgttttactcaggggcttccagggcctggactgtggggtggagtgcttccgaacagcaccctggatgggagggctggcgccagcccaggctccggcacccactcacctcgcctggaggcaaggagggggcaggtgtgggtgatgtgctctgacaaatcgtgcgtggggcaaggagaaagttaagacaacccaaggatggagaggaggagggagtaaaggattttacggggttttctatgcaaccttcctgtggctgtggttcagggaatggtttcttctaaatatttggttggtgacaccatttcgcagctaaggcaggattcccccaaggtagcacttaataatggcagctattagacgctgtgcccgaggataccaacttcacctctaactgccccacctcctccctacgacaacctgtgaggtaagcagggctggcattactcccactttagagccaaggaacagttcagaggtgaactcacttgcccaaggtaccacagcggtgtgtggaagggacgcgacacaaggtcagggctgactccagtccccaagccctcttcctcctcactggtctgatggacagagacagcgcacagtggcccaggggaggcctcttccttccagaggagtgaaatgtgcccgccttggcctctgcctgcctgtttaccatactcttctccagtcgaggaataaagccgtcggaagctcccccagcccctgctcgctttcatcctcaccagcacctggcggtgttcagacctttcctctacacggtgggatccactagattctcatctgaaagagctgcatacccttaggccaaaaccaggatattttgctggtgagacggctagctccacacatggtcatcccagccagaggagctgcccagtacccagatgagaaagaggtcttggtggctgacgacgcaaggtggggctggtacagcgggaactttgcagtttctgtgaaagctagccttggagcatgtgacccacactgccttggctggaaccagaagtcaaacgcctggggggtgttggggctgccagaagaggagtggctgcagagacctggagcgccccactaccaaacccctcacaaccgagtgtcccacccacctctctcatctcaggcccctctacctccccccaaacgtttccctcccaaaatcaagtttcagagtagaagactttggagaccaagtcccactcccattgaacagatgggccactgaggccaggagggaagctgccccccaccagccagcactgtgtcaccactcacttgcctgcaccacagcgccaggtgttaggccaggccagcagtttcccagaccggtgctcctgtttcctaagatgtctgccaggtgatcagccaccccgcatttgcctcagcggtggaagaaaaacaagtatttactggagggaatggaaggccccaactctccttaaaaaaaaaaaaaaaaaaaaaaaaaaattcaatcatgtcattccccactgggtccaccttcatggtggagttaaggggagggagatttcgaaaagggaacgcatagctattggttaatagcttctctgcgcctctgtcctcacctgtaaaatgggcacagtggtagcgcctaccccacagggaggcactgaggacgcctggcctcacacagaggaagggcaataggactaaagcagttttcagggccaagtgggtttaaaagtcctgcattctagtccttggcctccaactccttgggcttctactgtgaggaccaaatgacccagcactaagatccttccctgactcagataagtcagtgcccaatatggccaggcaccgaggtagccactggcagagacaatctctgctctcaaggaaagtctgccatgtggctgcagcagagctccttcccacttacccaaagctttgagctccaataaatcatctcaggaatacctggaaaatggaagagatgaggcgctctccctgtagaggggaagaaatggaagcacagaaaggacttggctcagagcctctttctaggaaaacatcaacttccttttgattttccaggcatcaaagaaaggtctatgcatatgagagaaaaaatacctagggaaggagaaaaaggagaagaaacagacaagagagaaaggagaaagagctgggagcagggaaggaatagaaggccagcaggccagtgctgagaatgctgggcagaccccctgccagggcctgaaatgctgccattggtgactcaaccttttgtcttcaaaactgcaagggagaaaaaaaatctcacactagggggcaccacagcttttatcagcaatcccattagaggctaaggctgagaggcatgagagtgcaaggtaagtgtctgaaagatggtgagtgggaaggtgagctgtggtcctgagaaaggaagagaacctggctgaggtgtcactcagcagtccctgctggggcccaaaggccattctccctctccactcctgaagagaggcagagagcccagagccccctttgagatggggatgggcatgacctctgacatctcctgggtcctccctgccctgcctcctagttcaacgccccctttgatgttggaatcaagctgtcaggggttcagtaccagcagcacagccaggccctggggaagtttcttcaggacatcctctgggaagaggccaaaggtgagtcctgcctggactgggtttgctcggtttccttgcagccccacatgggagttcactctgtgggtgatgagttttccccaacctctgcctctccaaaagaacttctaatttccctttcccaaagatctgcaggatagtggttggctagtatttgtgagtggctcagaagggagttcatcatagtctttgtgttcaaagaatgttctaagaactagtacattaactagctttggggcctcagttgaacctcagcttccttaactgtaaaatggagctattttacctattgtgagagtctacaattatttggtgttacaccgtcttcactgcgtaactttactccacaaacaaaaaggaattggtgccaaaatagcactcagaacaggttctgcagcctgttaagcagttccttcaaatattagagcttcctgagttaagcaaagggtttgctttgaatcccctcaccttgtaaaagaaaaaaaagaaaccgcccaactgattgaggtggcagaaacacctgcacatctgcaaagcactgtcctcaccaaggcggtgacccgtcacccctggggaacagcaggggtagcattcaccccgctgtgcaaacgaggaaaccaagactcagagctttgaggtgacttgcccagggcacaacagtccacacttgagtgccgccctctgactccaaggccagtgcttccccacaacccccaccattacatcccacctccaatctcaccaccgtggaagaaaagcactagcaggacggtgcacccagcattcttactcaacctcttgctttccagaggccccagccgacaagtgatcgcccacaagccttactcacctctctctaagtttagaagcgctcatctggcttttcgcttgcttctgcagcaactcccacgactgttgtacaagctcaggaggcgaataaatgttcaaactgtatgctgatgttccaaatgggaatttatttcaaagaggaaaagttaatattttactttaaaaaaatcaaaataatacaaataaaaataattcttggtttatggtctgtgggaagggaataaaaggacaagtagcaaggccaatgtgcatgtttagaaaacctaatcacaccagctcactcaagcagagaagctactgcatgtgcatgcattgtgtggaattaagactgggtttcttagagaaggaggagagaaagggggagagtaggagggagaggggaaaaggaggagggagaggaagagaaagaagagataaagtgggactaagagaaagagggaagagaggaagaacaaagacacagttcctttaaacatcagggcttcctgagtgcaaggctgcattaacagcttattaacaaccagccagggctgtgtggacaaagaaacttcaggatgacattatcgaagccaacatccattcaagattggagaggaagacaggaatgcccaagagtgaatctgaagttagacgttaagtgaggtgcccaatcacggctcttgggcactgctagacagcactgaaagagctgcattctccttcctcccttctccactactgagaaggcctgacaaagcaaatgcctcacatgggcaaggctggccgtcgccatggttcccttactgataccaggtgggatccccaaacattccctcaactccagttcacagcagacacgagccttgactcttatgttccacaacttaattccagttacgacactggtcttcccgggggaaggccactcggtcatgcccaccttagcctaaacatgtggactgacttgactgtaggcaacggatgggacacatcgctaaggggagggaaaggcaaagaacgaggtggccccaaagagcagcaccacagacttgccaattcagccatctgagcgcttgtgggaaacatgcaggaagccgtctgcagagacagttggggtaatgcccacactctggaaaacccctaccacagagggtgctaggagccgagcgtctccccaagtaaaattctggccgccacacatgcaggcactaactactgatcaggtgcggcaggcagacagaaacccaactgctctccctcacatagaagctgtggtctgtgaatgccaccgtcatccagggactcttagaaatgtagaatcttgggcagcaccccagccctaatctatcaggatctgcattttaacaagatccccaggctacttagtaaacggctgatgggaaatggcttagaatccccttcccaggcgtcacagcacactgcaggccccctactcacccctccaccctcagacagccatgcccctacctccccaggcacctggcacaagtgggtacagagatcaacacacttgtcctggaacttaactgtctcagctctgtcacttagttgggatacgaccttgattatcactaactgcccacagccctcttatcaatagctacagaagaggagcaaaggcccaatatggccaaagtggtcaggagatggtttctttttgagaaagcaccactgattgggcttgggagaggatgggtaccaggctctggacaaatgctggtcacctgatgcttcccccaccaaagacaagaacttacttctctctcaaagaaatcacaagcattattacccgcctgcctgggtcattcaaatagaaacagatattgcgcacccactatgggctgggcactctcacctgtgccaggcaacaaggtgtagtgcaaagatctgggctttggcctcggacctgaatttggataccagctctgtgatccaggccaagactgaatttctcaggctcctcacatgtaaaatgcctaccttgctgggttactgccaagactgaacatgaggtctcacatgagctgtagctggcaaagggcccggcacgtagctaagcattcaattactacagcagccagcactcactgtcacacccctgatgtacaccaggcaccgtgttaaatgctcatgcagattaatgtgatttcacttcattttcacagcaagcctacttatgagggagaaaactaaagctcagagaaattaagtaactttcctaaagcacacagcaagcacgtggccgactcacagccaacgccacaggactcaggggctgctttttcatccggttccacagcctctcagccagtgcagcttccctcgctctactgcctaggatgagagaggtttccatattcattcattttccttcagaatacactgggtgaacttggtagaggggtgaggacaatttcaagtcaacaatgggcagaaatataatttatcaaagaaaatggttggaggacacccttgagaaaatgtattatttcaaacatgttcctgtatcagctttcttaaacccactcctttatggatcgtttaatgataccactgtaacttgagggtctctaaagtggggtgtatgtacccctagggtgagcgagctatttgctggagaaaaaaattctccttgtgaaaaaacttttactttgtgtataattagcataagagcacacgtatttaagttctcatgcacttatagttgtgtgttcagaaatcatcttgagagagtgcacagaaaagggttgagacgcctcaactaagctacccaccttaatctgaatccacctacaaatgtcactggcatttggggggccgaggcaggtggatcacctgagatgaggagtataaggccaaacaggccaacatggcaaaatctcatctctacttaaaatttaaaaaaaaaaaaattagccagtcatggtattgggcgcctgtagtcccagctactcagaaggctgaggcacgagaatcacttgaacctgggaggtggaggttgcagtgagctgagatcaggccactgcattccagcctgggcgacagagtgacactcagtctcaaaaaaaaaaaaaaaaaaaaaaaccaaaaccaaaaaaaaatgtcactggcaaatgagcactttttaatacagtgatcctgagagggactggctggccactaatcaccatctttgacagagtttgcttctttaatcactgtacattccggtggccatttgcccttactttacaaaaatgaacaaagcaaaattaaggtgctgaaagcaaacgatgagtatcggtctcaagcttcctatagaaagatggaaaaacaacagaaaagccaagaacagtcacaaggaccatcactgagtggacaaagccaactgcacattcaactgtgaaggaaatgaaacaaagttcaggacgatgccaaaaatacataatcaatgattgtatctaaaagatgaggcagcaacagagacttcaaaggtgttcagcattcttggaaggaagagagcctttctttttatgcgtaagtttacttttttggccggtgcacttgtattcaagaataccttagtacaaaataggagggctgagtgcaagtaatgaaacagaatttcctccagagtttacccagaggcatcaggaattcacagtccaacgcccaccatccaactgattcatcagtacccccagggactagatttttcttcctcctacagccttgagctggaaacaaaaaaaaaacaaaaaaaaaagaaaagaaagtacctacataggtcagaaagaagcagtgcatctgagttcccagacagtaaaattacttaacactctaaggctgtagaactttaagaattcttttctggggggaggcggggggaggggaaagacagagtctcgctctgtcacccaggctggggtacagtgctgcgatcttggctcactgcaacctccacctcccgggttcaagtgattcttcagcttaagcctcccgaatagctgggactacaggcgcgtgccaccccacccagctagtttttgtatttttagtagaaatagggtttcaccatgttggccagcttggtctcgaactcctaacctcaagtgatctgtccgccctggcctcccaaagtgctgggattacagaagtgagccaccatgcccggccgaactttaagaattcttatatgcagtttaattttacagagagccacatagatactcaagaaagtctccagctggccgggcgcggtggctcacgcctgtaatcctagcactttgggaggccgaggcgggtggatcacgaggtcaggagatcgagaccatcttggttaacacggtgaaaccccgtctctactaaaaatacaaaaaattagccgggcacggtggcaggcacctgtaatcccagctacttgggaggctgaggcatgagaatggcgtgaacccaggaggcggagcttgcagtgagccgagatagtgccactgcagtctggcctgggcaaaagagcaagactccttctcaaaaaaaaaaaaaaaagaaagaaaaaaagtctccagctacctggattcttgggttacaatgctggccaacaaccagactaaaccactgcatcactcaggtaagtctatacaaacacggagagactgggttggctagaggatccatcactttattttcagaaaaagatggccaaagaggggaaaaaatacagaggcattcccacagcacagtgaaaacaattagccatccaaaaagctgaatcaaaaacaatgccaatcagctttcacgcccacacaggtgaggtttcactgtgcaacagcacataaatgataatctaaatcctagagagaaaagtagatagcaccttgtgcttttccttggcaggtggatggcacaggcttggagacttccatgtcatctccgcttttcctcctctaacacagggctggttggtttcacctgcaggcactactgacttcagggcttgctggagaggagatggttgtgctgcagttcacttggtgactataaacactttgatatgctcggcagtcccccaagtcttccaagcaggaaatcaggtcccccccgacttcccacatgggccaatctgcagcacagacaacataacagcacagctaatccgtgaagacggacagtgaatcaaggctgagttccaggccagtgacttgtgtaccaggggcaagatggaaatgccagataggaaatattaaatccattccattttagctcacaaggctcaaatgcgccttccaaaaacacctagaggaatttaggattccataagggatgtattttacaatttaagcctccaagaccacagacgagggactccaggtgatctatccacctcactgcagatcagggtgaaggatcctttgaaacaaagtacagtctcctctcacttaaccctggaccattagaacctctagggcctgtaacgagtatacctttacaaggcaccagcaggcggcagagcagagctcaggacttgagatgactcagttgctcaaaaggtgaaggagaggctctcacttctaaaacgcagaaagacaggacacaggagaggcaaagccaagggggcacccaggagatgcgggagaaggactggtacatttgcagacaccaggcctgcttattctgcatagacaatgtaacatggctgagctgcccagcagagcttcggagaattacgctgattcacctctcaacctgggcggggtacacaaaggactgtacacaagatgaaatgaggattatttttggtcaaatgttcccaagaagggggcaaaagtgaaacaaaaggaggctggcagcccctgacacaagactagcaggtagtttccgccgcaaactgaaccttatcagcttaacacacccacacagcagccctgagggcatcagtgaggaggaagtacctcctttggggtcctcttccccaagaaagcctcttcccggagtcccccagtctgtcctggatctccatcatggacaatgagtgctcctctgcacccccccatatcaatggcagtggaaccaatgagaccagcagctgaagtccttctgcctgtgccgacgctggagttgacaccagaacagtgacagtcaaactgaagagttatccagggaagggaggaggacgacttcactggttgcaagaaaataaacctccgagataggtgtccagttaatttcccccaaaaagtttcccagttggaagtctgtttttagaaccgagaaccaggaactgagttacacacccacatgtgcttagacaagtaggcgggtgactttattcacaaactactcaaaaacaggctgcagagaacagaatttggactgccaaactcactgtaccctcatatcgcactctttcttctttgctgcctaccctggagcattttggctgggaggcaaaatcccagtgctattacaggcagtccccatacccctcattccatgcccaccccaccccacccaccacccagaagctgaagccttatgacccgcttggaggaaaacatcctgtcctggttttctgtgttccaatcagctctctaaacacatcctcgacctgagacacagacttcaagccagcctgtgttctgtcaggctgctggtcgccctggagggtggaagagaaaaagaagaaggttccaaaccatgtcactcaaaacaaatcaggcttaatgctcatactatgtttatattctttacattaacaaaatgcaacaaaagacttgtcctggtttttaaaaaatacagaatgtgagttttacgaccttttctaggagactcccgaggactgtaccttctctgcttaaagactgtagaggcgactggtgttctcacgcaaggcagccaaggtgagggagagtggctgatctttgactctggcaatctctcggaccgtatgcaaggccaggcccgggtgggcatactggcaaaggcttttgggaacctggaagacatcaagtggtcataacatcattgtgccatgtgtgcacagtcataatctagaactccctccctgtcccttccccagcaaggacctctttggggctgccctgtagagacccctttacctgcaggtgcagggagagtcctagtcatgggggctctgggtgagcagggtcccacgcttccttggactaccctctacagggtagggctttgcactgcctggaagagagtggttacccttcagcttctcagccccctagacttttggttctgcagagtaacagcaaggaggcatctacacagcccaggatgggacctggaagtcactggggctctggccctgccaaccttgtaagggtgaccacccacctccccaccctctccctccggtgcctccactcagcctgaagacccccttacctggcgagggaggaaatagggagcatccgtttccacgatgattctctccagtgggatctgcctcaaggcttcccgggcctcccaggcagaggagtatgtcagcactgccgtgaagcccacagacatgttgggaaagtacttcagcaggggctcaatgaccgggtagctgccggtgaagcaatgcctggagacagaactccacatcagggctgctcacagtcccctctgcagcagcccccagctccccccacacccatcaccccttttcaatgattcccagaaatggaaagactgcatcctagggaaggactccacagtaaacacagacaagggctggctccaacacaggaagccccgagatggcacttggtgagtgatcagagatcactcagagataccacgcacaccacagagtgctctgcagtcacctgagatgaccaccacagagaacacactgggataggaaatgcttctaacactgaagaggagcaaaatcaacaactgtggcccctatgatgacaacgacagcatataaaaactatgcccaagtagtcaaatgaactgaaaggaaatctaacaaaatactggggagtcgaactacaggtggattttcttaatctgatacctgttcatgttcttggtgccatatatatagttaccaatctgtaaatttagggcctcctcctgcaataccacctcgttgggtcaccttagccctggcctaccagccaccattacatttccttcaaagttagcccaaaatgaagtaatgaaaaaccaaccgacccagaaaagccaactgactgcctcatcattggtgtgtgcagcagccaggggtcagaggcttcactcattctgcttaggtacccaaaggccctgacagccccatcctcctttttctgccatctgacaagacccgatttgggtgctagagtccttgttattcagccaacccctctcaaccatctttaaggagccggccaggcatcacctcctgagtcttctggctgggctatgataatgggcccctgctgtggctcccacagcacctatgaccacccagtcccacatgctatgtaggcagaagccaccatccaacctgtctcctggcagcacctccagatgtccccagaggcaagccaaagcccaggacctacacgtggcaagagttcagaagttcagagagtttaccaaactgaacttaagcacccatagatgccattctgataaaacatgaccttgattttcataactggggagaaaggagctttcaagttcaaaagaggaaagaaaatgtcctttcaagtaccctaagatgctctgtgtgctaagccaccacaccccacagcaacctctcaagatcagcaatcctcactgctgagaactgaaactccatttctgcccatccccaggatgggggcacaaaaggccccttgtgctcactggtgatttagggttattagttcaaaccatacgaagttactattttgtgagcaaaaaaaaaaaaaaaggtcaaatatgagaaatttcaagtggtttaacctaa

SEQ ID NO: 11981 - DNA, 7495 bp, Human
gtttttttgagatggagtctcgctctgtcacccaggctggagtgcagtggcgtgatcttggctcacggcaacctctgactcccaggttcacgccattctcctgacttagcctcctgagtagctgggactacaggcacctgccacaacgcttggctaattttttgtatttttagtaaaaagacggggtttcaccgtgttagccaggatggtctccatctcctggccttgtgatccgcccgccttggcctcccaagtgccggaattacaggcgtgaaccaccgtgcctggccttcattctcctctttctataacgcaatcttaggatgcaaaaccaagcaaagtctgaattaatctatctagaatagcaccgtggagtcacagccatggtcaggcccctccaaagaacagactggatttcggaacccatgtctctccctgccacaagcaactagtccatatgcaacttggaagcagccactgtggatcttggcttctttcttgcttcctcctcaatagttactgccactgatttagtgctaaagagataggaacatcacttaaaaccatctctacacataaatccacttagaataattttttcccctggaggatctattattgaagtacaaggctttactgtttattctactgtagacaccacaggacaccatgttcttggttagaattgagtacttgagaaactatatgaataattgcttgttgaacagtacacgtgaattatctctattttccagctaaagattgagcctaaaatgattagtatttttgtaattttgaatcatttgatccatttgaagttggattagtgacaaagtcttattcatttttcaagtgttagttctgagggcttctcccagaactagcagcaaccagcgttgctgctagataatattgcacctttaagctaacaagtaaaaagctgatcctctgggttgatgttgtctcatgctagggctctaggcagagtgggctggagttcagtccccagccatcttcttagcagggcattctagatgtttaatcttttatgttgacgtgttgatatcacttccattagccatttgttagaattactaaattaaatttacataattcaaggatctaaaaagaccagaagttcagtcagagccatttttctgagatatttctgcatccctctgaagaagataatttgtccaaacttaacaaaaacaggtgttaaaattgagtacgttctgagaatactcagactttttttaagactttttttagtctcaaaccctacatgaaatacaatcccttaaatcttccaatcttagagctagaagaaaagtcgagcaccctcactttacccagaggcaattttgtgccccagatgacaaagctcttagatctactcatttgcttatggctccaccagtacttctaggtcaggccctctttcacctgaaggattagccatacttctggaaccattttccaggttccttgaaataaatatcttcgctttgctggggaccctagtttcctgttaagtagtgaatgacccttctttcctcccgccagccacagtcctatttcacagaggaagagaatgaccagcaagtcaacttctactacagagaagcagcaactgataaaaggccaaatcttacaaggtgccaacgtgaagaaaaaggcccactatcctgcagccaactcatatcaaaagtcaatctgtttagtcctctctgccggggtgaatctacagtttttctttttgtctccctcttgccccatcaccaggtggttgtcgttgtccttcccggctagttgccaataaagttgttacaaagtgaccttgagtgtcttccttggtgcacccgaaaccccgccttcttcatccgggtgctgcggcgcgaataagagccggaccgcgcttgcgcattgagtcccactccttcgacctctgctgcagcccgtgccgccgccgcctcctgggaaggtaagtggagggcacagggagcccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctggtgcgtagcccaggcagggtcggggggattgaggggtgggcgttttggcctagagcgtccacgttgttgaatggggcaaccttcgggcggggcacaccgccctctcgggaacggctttctccttacctattaacccattgccgttttcttcctaatcttagggcatctcagccctctccttgccactagggcgaggcagagcagccgaggcctagctgtcaggcctcactcggtgtaggtcaaactctcttgtccctagaccaggagtggccctttcccccaccttctctcagcctctctgttggattggggtcgacgcgaaggttggagtactgcagaggatgtagggggccgttgaggcctagttcacctcagcagcgctttccagtgcctgtctgtaggtcaaactcgttgctgcagagggagggactttgcctttccgtgtgggggcggaggaaggtggtgggggaacgagcccaaagtctttcttcctgcctctggagtattattttcataacaattttgcaggcttaaagtgaggtctagatctggaggatttgtcttagagaatcaggttttggttcggaagggtttttctgtgaccttaatttagtggacactcaagggcagagaagttggactggaatatgtccttatggtcagatatttcacagattattcttaaactgatgtagaattgcttaagttccttttttagaaatttttttttatgattaatggtcatatagaaatagctttgaaatggtcagggctattaactgctgggctattttgaatgataaatgtttattgtgacgctcctaatatacttgttggtccacttaaaattgccaaagaacgtgtggtatttattgcttttttctgacttgacttacggcactacaataatggaaatgtcaaaagcagttcttactctctttgtaactgttattagaaattttattcaaggtagcaagcgttacaatttcattagcatgaaactttattaaaattgcttatgtattaaaaatgaccaaacagcaaagagtcaattcagaagtttctgattcatttttactgcttgcttttttagaattcatggtaccagaaaagtcattgaagtcttacctgtattctttcttaatattgaaatctttatttttttttcattaatagatccgagctggatccagagttgcatacagaccaatttctgcatcagtgttatctcgaccagaggctagtaggactggagaggtaatagtagcaataattgaaattaggtaacactaccaaataagggtagggttttgattagagtgaaggaaaaaaactttattaataagagtttgagggcaagtctttcccacccttttatccaaaaaactagatgagccaaatagccaaaaatagccaaaaaactagatgagacgaatagagaaatttctctatccaaaacttggccaagtatttatattcaagtctattgatttaagttgcctatatttaaaattataatagctacagttattgaaaaatgtactctattggactggatgcggtggctcacacctgtgttcctagcactgtgggaggccaaggagggaggattgcttgaccccaggagttcaagatcagcctgggccacatagtaagatcctgtttctacaaaacatttaaaaattagcccagcctggtggtcacctgtagtgttagctactcaggaggctgaggtggggagctggcttgagcccaggagttcaaggctatagtgagctatgatcacaccacactgtactgcactccagcctgggtgacagaccaggtgagaccttgtctcttttaagaaaaaacaaaacaaaaaaccctactttatttaaaagcatatttatatatgttgtttcttaattttcaacacccttttaagatgtagatattgttatccctgttacacaagagtgagattattctaagctcttgatttgtctctttacactcagctacaaaataaaaaagtagttatcattttgacaatatggtatttaattaaaatagctacctgtggttactgatacgacctttacctttattttctgttttccagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccaggtaatcatttctatccctaaataagttaagagcatgcttgcagtagttggaaacttagctactgaaataatagctactttgcattaagtgcttactctgtgtcttgcattatatttaaagggctttgtatgcattatctcacttaattctcataacaccatttgggatgttatgagaataacatctatgaaggactagagacacagaggccacattacttgcccaggtcatagctagtaaatgtcagaaaatgaattttaactaagtctgacttcagagtctgcattcctaattgttaagctattttgggaataaaattattagagcacattccttaaaaggatcaatttattttatttaagacctaaactgtcagatcttaaaaggtatagatcatattttcagatggataagaatgtcagaacccatcaaaatgaatgaaaactaaccatttatattgacagacagctccctacctttacaccatattatcaggattgaaggagaatagtgtaagagagatctaggcaaatactcttccagcagacttttcagtttacaaaaatccccacactagtaatctgattctttaacatttaccaaacatgttgaaattaatatttcaaagtaacagtcatatgtggtctcttttagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaactttaatttcttctgtgatttgtacttacactaagtttagattatcacaaagaagaacgtgcattcaggcagatgctgtcccattcagaggaagctacagcagttgctccactgatgaaaaatattccaatgtaatttttatgggaattcttttatatagtgttctgcatattgtaattcatagggcttttgtttattcatataaaggataaatatttgggtgttttgagcttctataaaatatgattaattaaaggtagttaatactcaagatggtcttgagtttttaaggtctaacatcagttagaatacttcaaatcagaatcaccttccaagactgacttgacaggtggttctaaaaataaatcacgtcagctttttaggaaatgaagccttaagctagggggtaatgtgacttttgtttttcagtaagtctcacattaagcaattgtgtgcctctaatgaatcttccatgtcttttcagaacagaaactagcagctagtttcttacttgaacaagactattaaaaaccaaatatcaaaaaactgaattggctagatttttacagccaaaaattgctgtaaggcagtgtgtatcactgttgctaacatgtttatagtgggagtcttggggatgatagctggttcaacagtattttgctgctaatactttatgttgcttcttggtcaaacttttcccattcaaaggaagaagatggtgctactatagacagtttttcccctagcaaatatattgtaccataatatctatcatccaagtttcagggttttttgaaagttgataattaggaaagtgacattttacttttcttagtgccctttgcctgtttgatttccattgagaaagagcagtcaccaaagttcctcaagtgtcggaagaccaccaccatcagaatcagtgcttgtttaaaaaataaaaatccctaggttccagacctactgaattggactctttggacatgagactcagcaatctacatctttaaaaaggcttcccaggtggtttttgtgcatactgtttgagagtcactaagttatatatatatcctaccttctgtaaagtgaaatgaggccccaaaaagctaaagaggtagagctgctacctcgtttttagttgattcatcatctagtctatatcacccaaaagaattggaaataggtattcaaacaaaaacctgtatacaagtattcatagaagcactacttacaatagccgaaaggtagaaacaaccaaatgtctatcagctgatgaatggataagtaaaatacatccatataatggaatattcagccatgaaaaggaatgaggcactgatacataatgaatagatgtgagtgaaccctaagaaagcatgctaagtggaagaagccagccacatgattccatttatatgaaatatccaaaataggcaaatccatggtgacaaagccaattagtagttatcaggaactagggagggggtgaaaagggagtgactgcgtaatgcgtatggggattccttttaggatgatgaaaattggatgaattacagctggtctgatggtagtgggttatcagaacttattaacattagtgtcattaaagttggtatatagcccctcactgctaaatctggctcaaaaattaaaagattattaaaatttgatgaattagtggtgatggttgcacaacattgtaaatataataaatgtcactgaattgtacactttaaggtggttaaaatggcaaattttacatgtcttactgaaactactgtactatttaatacaaagtacatagtataaaattttaaaagtgataggaaaatgcttagattaatattcacctattccaagtatattttaaataaaaacagtcttggtaaagacctgttcttggtgctggttttggtggttgaaaaggcttgaaacgttgatttgggaacaggtttcttgtaagagatgtcccagctgagggaatctcccagaatgaaaatggactaac

SEQ ID NO: 11982 - DNA, 33498 bp, Human
ctgggcatggtggcgggcgcctgtaatctcagccactcaggaggctgaagcaggagaatcgcttgaacccaggaggtggaggctgcagtgagccaagatcatgcctctgcatttcagcctgacaacagagggagactctgactcaaaaaaaaaaaaaaaaatatatatatatatacacacacacacacacacacacacacatacatattatatatatttcatattgctcaaacaatataaatttttttaaagttaaataagagtcttgctcaagactcttttatttaactttttattttgcagtaattatagatttacaggaagctgcagagataggacagagaagttccttccattggcaggaactcaatagtatgagacagataggcttcatcttccctaactatagtacaatatcaaaactaggaaattggcattggtaccgtgtgtgtgcatagtgccatgtcattttatagattcatggactcactgctgcaatccagatgcagacctgttccatcaccacagagatcttcctcatgctgctccttgatggtcacacccacccccgccctccacaggagagttctttgaaaggatgggcattaggaaccagagacctgaaatgggtcctcaggagggaggatgcggggtaagattttgactctgtgaagagaaataacaagcacagtctcctccagtctgctctgagaaacatagtagctgctgctttggtttcaaattggctgtcctgagtcacctggagtgggtgcttggggacagtgatccctaggcaaatgtacttctgccgttccctctgctcagtggtatggtttggggaggagcttagaaatgcagaaatcctgagcctagaatgaggcatgggggtgactagaagaccttgggttgggcaggtccagctaccacccagggtccaccctgccttgcccagaggaactgtaccacactccactcaccaggagaaaccacaactcttagtttcatgacatgaagagagagttcttgggaagcagtggtgaggtcttgggtggaacccaggccaggctgtgcacatagtttgatttataactccaggtatttagttatacaatacagggacctccattttactttctgacctgggctggaaaggtcagggcaggcctgctgtatagaaatctggaggtgaatgtgagaagatgagacacggttctatgatcagatggagagagaccagccctcattctcaagaactctcaatagtatgagacagacaggcttcaggagacccaggtctgtgggttgagacacaggctcagcttttgggggctcacagcccagtggcagggacaagagaggcctctcctaaagggcatgacttaggaaagaggctagatgtgtagtaaatcttggctgctagagaatccagagaaggcttcatgtaggagatggcactgaggctgaccaggaaataattctctacagatgttcaaaaagatgacgatggaattgtcagggggcagaagtatccaggtatagtcagggcaaggagtgcagggtaaggtcaggttgcgagaacagtgaagaaagggcagcctgccagaagttgggtgtggagagaccagaaagagctgtggtgagggacgagtgtgggaatgttgacagcacctgatggtccaggggaggaattgaattcatacagtttggggttggcggggaggaaccgcctagcacagaagaaggaaaaagccagccctcccctcttcccttctccctccacatcctccagctctcaggtgacgggggcccctcccagacctgcacagcttggtgtggggaaagcttgggagccagagccccaggcttccttgtttactgtcaacctagaggaggaggagagggaggggagggggagaggggaggggtggctgcaggggaaggctgagcagctctctccagctccagctggacctgaagtctcagagctgccaccagcagcaggctcagacactgggctcccagctggggactgctccatggccatggagatagacagcaggcctggggggctccccggcagtagctgcaacctaggtgcagcccgagaacacatgcaggcggtcacccgaaactacatcacccacccccgtgtcagtgagtagcccctccaccgtgacgggtgaggtcagggtggggagctggggtgggctgccaggttcccgggccccgcttcttgcctcagaaaaggaggaggacccaagacctggggagacctggagggctctctgtccagcagagtgacgcagtggggccacctggaccagaggccacctctgcaggtgaagggttgcaggtccccagcccagcccaccccagaagagagggctggggagtagctgtcatcagcccaatcctgctgtaacacccgaagtccagagatagcttccagttgcccctgagagtggggtgtgctgtgcacctgctcttgtgtaaacgtgcctgtgtgaggagtgtgcacccaagcactcagagtcaggcggggtgtgattaagtgtacttggagtggtgtgtgtggcagtgcagagtgtcagcgctctcagcctgaggaaataggtgccccgtgtgcgtcacatcaatgggtgcatgtcgtatgtgtgttctgaggagggtgcctgtgtgcataagcaggtaggagcatgtgcctagggggtgctcccaccttcacttggggtaaggaaatgtgtgactgcatgcttatgcactcagggcaaaggtgtgtgtgtgtgcacttaggtgtgatgtacgtgtgtgcatgtgcactcatggagagaacacttgtgtatgtgttctggcagtgtcacatatctgagtatggtgagtgtgtgtacagctgggataagaatgcgtatccaggtgtggggcatggaagtgtctacaggtgctgggatgtacccttgtcaatttcagaggggaggccctacttgtggctcctgtgcctgtcctgcaagggtggcccagatgtctggggcaaggtccagaggaccaaagggaacccctgcatctccttgtccaaggtcactctccctggcctggtgaattctcaggccgccctgctcactggagtaaaccagcatggcccgccacagctatgcaaagccagaggctcactggagtaaaccagcatggcccgccacagctatgcagagccagaggctcactggagtaaaccagcatggcccgccacagctatgcagagccagaggctcctaacagggagtgtggtgtgaggggaagtgagcctgatgcagccaccccacctccctctgttcctctgttgctatccaggccaggagaggaggtggagtgaactcagagggtagctgaggggtgaaatcagagtaaaggggcccgggggcgcatgggaggagagccctggggtgtggggcacctcctgaggcctgaggcaggtgctgagggtggagcacattccagctaagaagaaatggtgagaatggggtgggtcagatttctcaagcaaggcctgtaggccctgccccatggagctcgggggaggataggaggtccggatactccctaggccaaagctagggtcaccaaggcccagaaatatgcagtgactgggcccccttgggtccagagcccaggcctggagccctgagctggcatgtgtgactcttgccagtctgttgtgatgagccccactccctgcaggccgtccctcctccctgcaggcacccgggagttgctgggtgctgagtgtggtgtgtgatctgcaccttcatgctctgctttccttcttcctggaaagtgcccccacctcctgatacccagggaccctataggtaccatctaaccccacactcctctgggcaggttggcccaagcctggagccacctccagccagctctttcccacccagccccttatgtatagtcaacatgccctggaggttctgacccaggctggaacccagggatggctgtgcccgccccccatgtttgcatgcttccctcgatgctggctctatatggcctccacccaggagaatgtgttcacaccaaacaacccaacagtggacccagagcaaaggtcagtgcaggggagcccctctaggctctgctccctgccagcgcctttacttttgctgcctatcaagtatcctcacaggatgcaccgggccagcctcagcccagcccagatgccctcccacccccaggggaaggctgggattccttggtgtgtcccttcatccacagtgtctcccaatcccctccccgcctcactcacttcctcctcaggctctgggagtgggagggatgaggggggtggttctccctggggcctgtggacaggcgcagggctggcaagggtttggaaatttagggctgcaccctcagtacgccagaggcagggccactctgtccctctccacctgtctcctccccagcctggcctcctaccctgggtctgtaagcactcccagacaggagaactctgggagaaaagctgggggtgcctaagggcagggaggccccagtgctcgctgggccacggtggaggtgagtccaggtgacttaggcattcccctcccccgggggaggtgggctaaagaggcctgagactttaaggctgatttcactgcagtggctgagagaggattggctagaaaggaggagacactagaaagagtggaggcagcctggggagctgaccctgccaacatctaccttgggaaagaagggtcccctgtgcctcccgtggagctagaatggttccccaagggccttggctcccggctggggaggaggtatcctggagcttcatctgtttgggcagaagatgttgggcttggagggtggaggtgcccagcaggagcaaaggtcaggaaggacaagctggcagcctggttggagggatgaagccaggtcagatccctgaagatcccccaggagcttgagtgccaaaccactgtctttgcctccccacctcggtttcctcaactggaaggggaaggagttacacggagagagtcccaacaagcagggtcttgggctgaagagccctcagcttccagcccctgccctccctcctctaatccctccagcgggatcagggaggaggtgcgggacctgctgccccgggcttgcccccatcccggcctcacgcatgggcgcctgtctcagccctctcccaggacgctgcaggtgtggctgggccagcgctaattagtgggccgcgcgggggccccgctgagcctttgacagaaaaggcggtagggaggtgggggcagggaggcgctccaccagccagaagtccggagcgcaacccaaagtgtcagctaagacaatggagagggggtgggccgggcagctggagggagtgtctgcaaagtctctggaaggcccatggaaggagcgccctttgggtcttctgatccagccctctgcctgtggcaatgcacccgcttccctctccagggtcaaggcgaacatcccagggttgcagagtgggccataatcgctgagcgctgcaggataccgtcttgaactgtggtgcgtcctgccagaaactagcccactttctgggcctcgttttgccactccatgcaagggacacacggaggtaggggcggcagtgtacaaacaaaaggaccggcttgcggtcaaggacacctctgttgctcagcccccattttggctgtgtccaaaccaaacagcctagaagaaaagatcaggctggcttaacaggggagaggcagagctctaagacgtctgacgggagagacatccctctagggtcccagtctgtagtaccgtgggacagcagtggggagaggacccagtgggctgcagtagtcagtcaagggcaaggccttgaaggatgggcatagtccaatgctgaacagaaacagccgcctaagtggattatctgcaatgatgggtccaggccatgaagcgatgtgttcacccagagccaggcctggaggctgcgagaagcccaggaaggcaactcacagctgaggctgatgtgctaagatgttgagcttcgatatctcaccccggtcacccgagcggcctggccggggaaggcatctgactcccagaggacctgcagcaagcactttgcagctgcctctaggccccttccagcccagcccttcctcctgagggaagggctgtgtggatcccctaatcctctgtcccccactctgctgctgcccccactcccaggtggagttgctggatgtcagggctaatggggattctacatgacaggggctgtgaagtgggggagcagctgtgaaggaagggaggaagttgaaagacttgtctcctgaggcagtggaattagaaatgattccctggacttttctggtccttgggccccatcccctcccacacccccacctccctatccagcccacccaccctgcatctttacatcactgctttcttcccccagcgcagccctttggcaggtgtggcatgcaagatgccagctctcccgggggcttataaaaatgagggtctctcctgcctgccctgcatccctttgcttgcacaatccactagcaatccagacaatctgatccaaacaccatgtgggtgtgggagtgctgtggctgtttggagttttttttaattgatgggaagggtaatgcccaagcctctgtctcctaccctttctcgttgaggagtcttcctatgcccaacagccccttagcccagtacatcctctttctcttctactctctgccttctcaggaagtatggctggtgctaggggtgcaaccctttaggctggtcaatgggactctcatttggtttggaggcttgggaaggtcgggagggggcacacaatggttctgatgtgggaagtatgagaaggagcagatggggtcagttaacacctttcataatccatccacaaagatttctttttcttctttttttcttttttctttttctttttcttttttttttttttttgagacaggatcttactctgtcacccaggctggagtgcaataatagcatgatcagagctcaccgcagcctcaacctccctgggctcaggtgatcctcccacctcagcctcctgagagctgggaccacaggcacgttccaccatgcccagctaatttttaaatttttctgtagagacgaggcttcaccatattgcccaggctggtctcgaactcctgggctcaagtgatccacccacctcagcctcccagagtgctgggattacaggtgtgagccactgtagctgtccaaatatttcttgagtgtgtaccatattcccagcactattccatgaagtgggacacaacgatgagcaccacagatgatgtcttgccctcctggaggtgacaggtcttactgcacctgaagcgagcctgtgcatgccagcccactgcccctctttctgttccacgaaggccctggatgagtcctttctctcctctgccagaagtgccctttccccagctccctgggggctggcaccccttgaccctgaaggctcagctcaaacggcccttcccataagatgcttcctccaagcgcacccagtctggtcttccctcccactctcgttcacccatcctgatctttcccttaggagcacccactgcagtttgtaattatgttatttgctctgtatccttcttttagcctgtaggcacttcacattttcatttgtcactttcatttgcctagcttagtacatagaaggcatccatgcagtagatatgcttgaagaaaggaagcagggagggaaggaagaaggcagatctcagaggaaaggagaggaagaagtggagagccaggccaaacctcgaagtcctccagcacccaaaggtctgagagcgaggagtgtgagtcttcagaggaggctgacaggcggccccagagggaagcttccaaaggacagtgcacccaggctctgagtgtagccatcggaggccactgaagccagagtggagaaggccaaggagagggtggaaggtggggaaggaaagccagcagtggggggccatgcttgtgaggggaggaactggagaaggactgggactgagcgaggtttattttgtactggaaacatcagagcttcatgggaagacaagagagggagagagagacagagagagaggcaaggaggctctggtccttcaccccatggagtcatctctagggcctgtttcccggtgcaggggaaggacccactatgaaggaagcagggacacctccttagtgggaataggaaggaagaagagggtggctcaggtgcaggccaggcaggtctgtaaggtaggtttgaaggcagggagctgagggagatcccctgctctggcaaagtgcaagttgaacttatcttctctggctgtcctcaaggcccggagttttccaaatggttgttacacttggaggatccttataaaaatctgtgcaagaatcaccgtgcccagttgatcttcctagtccaagtcctggtgaaaagagcttagatcaaacaaaaagaagaagcttgaccacacatatccagactgggaaggggagggacttttggtttttctttggcatggggtggctcggggccaggcttgcccaaagcaagagggtaagtgaactgagaaccagtgtggtccagcaagaagcacagggtgggttcccagccccagctctgctacagatgtgctgtgtggccctgggcaaggcttctcacacttctgggccccattttccttgcctgtgaaagaggggttgggccactcccctctgcatcctgccagcctgtggctgacccagaggcctcacagaccccctgcccaccttgccaaatgccttcatctcaggtgtctcatctcattggtgcatcacaagaacctcagagaagggcactggtcaggactatgggcaagggactgtcccaggtctctcagccagcctctagcagaaccaaaactaggcttgcctcccgcaagtccacagcttcttctatgggagttaggaagtattttttggcatctaacccaattccctctgcaagctgagctcatttgccatgtgtgggtctctgcagctgccacatctgcaggcatttccctccttcccttgccttttcactccctcccctcccatgctgagcacccagtgagcctggggagtccaggaaccttgtgatgagagcagaggccccgtctggtttttctcactgacgtctgcaccccctacacaccacatacacacacacacacacactgctcaatcagtgtggggtgaatggagggaaatgcagtcctggtgagggcagaggagggcacttttcggccacagccgggggccaggagcttttggaaaatgcttggagtgagagaggagggagtgggtgaggtgggggttgaagccagaggggaagcagcctcagggatgagaggcctctgtgtggtgggggcggactctgaggaggcctctgccctctgcctggccctcccccagcctcctgcaggtgtccgagcagcaggggccctgcgggcaggggcatgacccttacagcaatggtggctggccctgtcacagctaatgaccctgacggcccaggctgggaaggaggtggggtgtggagagaggaagggaaggcagaggatgcctctgtgtgtgtgagcagggtgtttggggtgagacccctactcacccccgcccctcccccagcctacaggactgtgtgcagcgtgaacgggcccctggtggtgctggaccgggtcaaggtaagactcttctgctgcctccctggcactaaggccaaatcccagggcgcctctcccctgccctgcaggatttcttctaaattaccctttccctccatggcccccagggcctgctctgttctctccatccaggcacccactcccactctccttccctagctgtatccccagccgtccaagctttctcctccctgccttttcagtaaaaaccataaaaaccccatggaggcccagccctgggccttgggaaacctcctactatccctaacaagctgtcctgcctccgtttccctatcagtggcatggacgtacctaacctcctcagaggaaggctggaccacagcacggctgtacctaacctcctcgagggctagactctccccaccctcgactctcacaggatcttcttttaacgggaaagaggaggaggtggcaagtcaatgccaactaaattttctagggatcttgatggcctccaaaggcctttggaatatctcagtctcagcaacatgggtggtaagtgaagtgggccccaccaaaggtaagtgggctgtgggctattttgtagcccctgggaaactggcagacactgacagtatcttgagtcctggggttgggaattcttgagccataaagagccctgcaaaggtacaagatcactctcttatcctccctccaccaaccagccccactccctcagcgtcccaccccacctcctagctgagcaaactggaagtctcggtgcccctttgacccctcttgtcccagaccccacacctgccagcgcccatgtctgtagctccctcccaccccactgctaccttgtgatggcgatggccttgggctcccagcctggcaccctcctatcctgtctccatcctccagcccttcagacctgacccttgcatcaaatttgcccagggctctccagtgccctcagcttacaggtcttttcttttttttttttttttttgagacggagtctcactctgtcccccaggctggagtgcagtggcgcaatctcggctcactgcaagctccgccctccaggttcacgctattctcctgcctcagcctcccaagtagctgggactacaggcacccgctaccacgcccagctgattatttgttttttagtagagacggggtttccccgtgttagccaggatggtctcaatctcttgacctggtgatccgcccgcctcggcctcccaaagtgctgggattacaggcgtgagccaccgtgcccagctgcttacaggtcttttctatgagggtgcctgcaagcctttccactcactctcatcactctcccttccctgtgtagaaaccaacacctgaaatagtgtctgcatggggctgccatttgagatctctgggcacttgcatgtcattttttaaaaatgtgatcagtaatgtatgtttattaacaaattaaattacgagatgtcaccgccagtttcactgctataattttaaagcagtgatgagcacaaatactattttgagatacctgcaacgactgtaatgtggtatgaaaatatctgtgatttctgatggtaacaaagtcacaggtaccgtggaaatgctaattctaccgtggtttgttccttacattcagaactagaggaaacactaaatttgcgtaaacgttaatgaatgtaaaaatgtaactttcccattcaagatcacagaagccctgagttctctctgtagactctgagataggttctaggcaaagaacccttctcacaattagttggacaagaggatagagtatgtagaaaggaatgacaaagaatgggggattgtgtctgtgcattttataatagacacacaataattgtacatattcctgaggtacacagtgatgttttgatacatataatgcatagtgatcaggtcagggcaattagcatatccatcatctccagcatcctttctttgtgttgggaatattagtatcctctttctggctatttgaagagatatatatatatatatatatatatatatatatatatatatagttgttaactacagtcatcctattgtggtatagaacactagaacttattgctcctggctagctgtaattttgtgcacagatttttccctctgcctcctagactacacttccccctattccctccctctgactcatccccagggttgagaggtcaccttctcctggatgcctctccctcttctctactttttgtggttttattagtggcatccactgaggtatttggtcaagatctggccatgtatctcctccctacccttccccacacacaccgtgccctgctattggccatgaactgtgttttgttcatcttcagctccagaagcccaacacagcatttttactgaacacataggctatagtaggtgctcagcatgtttgctcaaaggaaaggtgagtacattaatgagataaatgaatgaataaatgttagcatgactagctatgcacctgtcaaaacctgagccaacaatattaaataaatcagacccattctttgctaacaaacagattctgagttcatacggacattaccacttgaccccccagtgtaagggacgccccaggaggaagtgtggctgagtagttaagtgcagcacactgggtttggattttaatcccagatccatcccactcttttctgctagctacatgccaaccctagatcaacagcattagcactgcccaggaacgtgttagaaatacaaattcttgggctccacctcagactgacagaatcagaagctctgggggtagggcccagaagtctgtcctcacaagccttccaggtgaactgatgctcaagttagagaaccatcaatctcggattgtaaatcccagtttcctcatctattaaataataataggattattgtgaggttcacatcagacaaatgtagtattattctcccttgagaatagccagcaatgtttctgcctggaatgcagaaatgctaataagcctgattcaacagttggtgccacctcctgccccctctccacctccaccacactctccaccagacctgccattctccatgggacccagtgtggcatggagtcggaacctatacaggtgtccattttctccactgtaaaatgaggccgatctaggaaaccagaactaggtccccagacctgtggttttgcgactatcggatgcatctgtagctttggcagagaaaaataattgggtggtggaggcacctctccccatccctctccgttgcccctacccctttccctctaccaggatttggcaaatgctacaattctgtttctacagcgccaccttctgcccacattgaatcacacaggcaattactcttcctgcttccgtcctcaaatgtaagaacatttgagggaagaattttgtgtagatcagaggttcttagcccaaggaattaggcccttgaaattgtgtgcagacctttgaaggtatgcatgaatgtgcctgtgcatttttctggtaggagtttctacagtttcgtctgatttttcagggttcgtgacccagaaaagtctaactctctgatttgtataagttgaacaagcatcagaatatcaggggtgcagggggcttgttaacaggcagattgctaggccccaccccagagctctgattcagcatgcctggggtaggaggcccaagaatgtacatttctatcaagttcctaggtgatgctgctggtatggggaccacacggagaacctctgttctagagaatcttctgactcctgtagtctgtgattcaaattggtccctgtttgagaattggagtaagcactcaccttaaccaccagactccatccccaatgtctgtggctgctttcaaaagagtctgcatcagctctgaagacaatttccaaagaggagcctccgcactgccctggccattgtcagcaggagggaccttagaggcagcattcctgtgcacaaatcccgacaggcttgctaagaacttccagtcctccgtgtgtagacagcagctcccctgtgcctggccacttgctggttgagagctcagttgaatctccagcacggggttacattgcactgagtcatgccctcttcctgcagccctcttagtaaccgacatcaaccgagttgatgggatcaggcctgctcagtatgcggctgggaaatagggccccttaagatacaagctcctggactagctatcccccacgggaattctcccaggtacccactgccataactggtcatgagatcccaccaccaacaacaataacgacgaacatccagcacacacttagagcctggggctcttcctaaaggttccagacactacaccctccatgcctgagtgtgaaaacctgatggcccttccccagatctgaccacaatttctgccatttaaagttcattttctctgattttgtccttcagggacacagaacgcaccactctcctctccactctcctctcctgccaccctccctctctcacccacataaactcacatgaaaatgatcactttttttttttctttttgagacggagtcttgctctgtcgccaggctgaagtgcaatggcacgatctctgctcactgcatccttcttctcccgggttcaagcgattttcctgcctcagcctcccgagtagctaggactacagaaaatgatcacttttaaatcactccaccgcctgatttctttggggcacactctggcctgtgttctgtacagcaacttttcccctgaggttgaaacagccctccgtcacctccagggagatgacaaataatgaggcagggcccgtttcgtatcgaaacacaggttatcagagtgggagaggaaaacgagccgggacgtgtgttccacgcgtttcccaggccctcgctgtccgtgctcctgggctccctcttgtggttgagaacccaagacgcctgggtgttcggagctcctcccacctcggagccctcctccccggccggcctagtgctgaggcccccactccgcaaggctgaggggtggtttggggaaccacaggtcaccttcctggcatcctcttcacaggacaagggaggactcaaggtagcgctcccttccgtgtgattgtcagggctgcaaacctagtctcaagttcgaccagcaggggttccctggcggagtggtccctacttggtcacaccttgctggggaattggaccctccgccccaacccgcaagcccttaaggtcactagtttgtggccagtaggtgatataacgatagtaatgatgatgataatcaccagcactgtgctgtaacatgtcctaaaaatgtattatattttaattgcaaaaataatacatgctccttgtaacttagtgaaaaagaggaaagacacgtaaagttaactatctgcccctaaccgctttattctcagccccgaaagaccctgctgaatacgctcaaacacaggcaaatatgttagaggttgacctcggggtcagtcccttgagagccaagggactgacagtggatccactgacagtgtcagcggatacacattttacgcattcttttggatactggcatagcaggcgatagtatggatgtactgtaacttactcaatagtcccattattgacagacattcgtatgttctcaggttttgccattacaaatagtacaatattgtatcccttttaaacggacgcttttgtggttataggatagattcccagaagtggaattgctggttcaagtacttttttatttcaaattagatattgacaatttggggcaagatggcttgcccagaagggttgtggtaattcatatttccaccaaccaggtatgagaggacccacttccccacatccttgctggccctgaatatgttctctctgtagttttacctatctaataaatgaaaactagtactgtctcgcttttatttacatttctctgataactaggaaagttgagtgtctgtccatatgtttaccattttgattttgcttccttctccgtgaaatcttcctaccaagcaagttgtgcatacgggagctccttgtttattgctcacaggctatcttttgcaacaataaatgaaacaaagatttcatctattgtgtctctgccatacagaagtttgaaatactcatatgatcaaatattttttgtttataccttctgaatttcttgtcttgcttaaagacattgctcatctgtcttttaattggattattcagaaagataggaaagaagaaaagctcttccagtattttttaaaaattgtttttactttatatttaaattttttttacatgcctggaatgtatttgggtttatgatgtggttatcttctaactagatatcctcttatgttctatatattatttcccctctgagaattaattaatatacaacatttgttctataatagtcctataaaatctgggatctccttctggactttttttctttcctactgatccatttgtctacctcatatcaatttactgcttgacttcagtagctttataacaagttttaatatctgaaaaggcaagtcctctatctctgatctttttcataactactttggctattctcagacatttatgtgaactttaaaataattttattaaattttaaaataaacaataatccattagggttggatcaaatttatatacttttcaaaaggattaatgtttttatgctagtaactaagaacattaagacaataatgttcttcattgtttaggacttgttttatgttattccataatttttttttgtacctttcttgttatatttatttctagctattttatgagttttggccctattgcagatgggatggttttctccgttgcctcttctaactggttactactaaaatagaaaaaaaaggagggggggaatgatttttaaatatttatcttataaacagccaaattatcttattcattctaaaaccttctttctaaaccagaacctcttgagtctttctaaatgtataatataatctgcaaataaagggaattatgtctctttttccgtcagtatacttttactttactttttattttgaaacaatttcaattttataaaaatttgcaaagataaaaatagtagtaggaacatccatgtcaccaacggttaatatattatttcatttgctctatcatttgctctccatgtgtgactgtgtgtgcataattttttcctgatttttttttttttttttttttttttttgagacggaatttcactcttgttgcccaggctggagtgcagtggcaaaatcttggctcactgcaacctccagctccccggttcaagcgattcttctgcctcagcctcccgagaagctgagattacaggcgccctctaccacgcctggctaatttttgtatttttagtagagacagggtttcaccattttgaccaggctggtctcgaacttctgacctcaggtgatctgcccgcctcggcctcccaaagtgcagggattacaggcatgatccactgcgcccggccttcctgaatcttttgagggtacgctaagctcaagtacttcagtgtatatttcctaagaattaagatattcttttatataactacagtagagctatcaacttctgaaatttatactgatacaatactttaatctaccatccacattccaatttatcagtttacctgatatcgggtaagctgataaattggaatgtagcattttttttttcactccagtataggatccagtctagggtcaggtattgcatttgtcatgtctgtctagcttcctataatctggaacattttcccacagcccttctttgacttcccacagcctttctttgacatttttgaagaatacagtcaccttcaaccaccacctttaaaaaaatagaacactcggccaggcgcggtggctcatgcctgtaatcccagcacttcaggacgccgaggcaggcaggtcaggagttcgagaccagcctgaccaacatggagaaaccccatctctactaaaaatacaaaacattagctgggtgtggtggcacatgcctgtaatcccagatacttgggaggctgaggtaggagaatcgcttgaacccaggaggcagaggttgcagtgagccaagatcgcaccattgcactccagcctgggcaacgagtgaaactctgtcttaaaaaaaaaagataaataaaaataaatagaacattctctgtttatgtttaattttcttttttctttttctggtcttactgtataaacaaaaacttccaaaacaatgttaggtaacaattataatataggcatctctgttactgattttcattggaaatgaaagtaacgttagcattttaccatgtacaaggatgttgatgttggttttggttaatagtttagtgttcaagtagttgccttccattcctgttttatatagaattgtattagaaacagatgcttggccaggcacagtagctcacgcctgtaatcccagcactttgggagaccaaggtgggcagatcacctgaggtcaggagttggagaccagcctggccaacatggtgaaaccccatctctactaaaaatacaaaaaatcagccgggcgtgatggcgcacacctgtaatcccagctacttgagaggctgaagaaggagaattgcttgatcctgggaggcgcaggttgcagtgagccgagatctcgccattgcattccagcctgggggacagagtaagactctgtctcaaaaaaaaaaaaaaccacacataaaacagatgctgaattttatcagaagccttttggcttctatttacataatcttataggattcttttttaatctatgttgacgaactctctattattatgaattttgttatcaaatattgacaaattccctaaagttgattgctctagtcttgcattcttggattaaatcctacttggtcatacatgtttatttaatgcactgcttgattagactaataatttatttctgcatctatattaataagaaatattgatctatagttttccttttggctctatctttaatgtatttgggaattgggggctttctatttggtagttgtttccttctaattgttattcattttattttattagcttagctagttcctcccgtacaaggctgaatagaatgagaatagcagggattcttgctttgctcctaattttaaacggaatgctttatgcatcgtatcattgaatatcatatttttctgtagggtttgtttgtttgtttgttttttgttgagacagggtccctctctgtcacccagtgcagtggtgcaatctcagctcactgcaacctctgcctcctgggttcaagtgattctcctgcctcagcttccccagtagctgggattacaggcacccactaccacacctggctaattttgtatttttagtagagatggggtttcaccacgttggccaggctggtctcaaactcctgacctcaagcgatctgcccacctcagcctcctaaaatgctggggttaaaggtgtgagccactacacccagcctatgtagggttttttgaggatattctttttggagttaagaaatttcccttttatttcctgttttcaaagagtacttttgttcttttttgttttggttttaatcatggatgggtttttttgacttttttcaaaatgtttttaggtgttcatagtttttaatcttttaatttgttaataaggtgaattacatgaatagattttctcatattagactagccttacttccctaaaataatcccaacttggtcttttaaaatttctgtttatgtgtatatgtttatcttcatttcttttctttactattttggcttataacttggtcttttttatacattgctagattgggttaatattttgttaggatttgtgcatccatgttcacgagtgagattgcctacaagtttcccataattattttattttggtatcaaggctataattgcctcataaaatgagttaaatacagtaccttctcttcctggctttgaagagcttaagtttcaaattatttattccttgactgttagaactcactggtaaaactatctgggattgctatttaatatcttaaagatttcaggattattctggctttcaatatcattttcagttggttctggtttgagttatatttattcatgttatctaatttctcaaatgtgttgcataaaattgttcatagttcatctttttaatattatcagtttatctagttgtgaatttatcccaacaattatttattcatgcctttcttatttcttaatctgtgttgccagcaatttgtctactttattcagcttttcaaaaaaccaattggctttgttggtcttctctattctatatttgttttctgttttaataatttctcctcttatttcctctactttctttggggttttaatgctgttcttttttctgacttctcacattgcatacttttagcttcttcaacatttttcttatctaatataatcatttaaagctttgaatgcatcacacatatattgacatacagcttttcactattatgggagcgaaatgttttctagttctgattataaatgcttctatagctagaatgcttttctttccaaatgtaagaggtatttctaaccatttttttgctgttgttattgatttctaacttacttttatggtcagagaatatggcacagctttatatctttcataggtaatggcacaaaatcatgacctcctcattcttttccagataatctgttatttcagttttgattgcctctaatgacaaggagtaattcagaagcgtgctttaatttctcagaatattaggaatttgggaggaaagtgttgtctttttaccatcaatattttgtttgtttgttgttttgggtttttgtttggtttggttttgtttttcatagagatgggtctcgctgtgttgcccaggctgatctcaacctcctaggttcaagtgatcctctcacctcagcctcccaaagtgctgggattacaggcgtgagccactgtgcctggccccattaattttagttggattatgattatggcttactccctggtaaatcagcgacctgggaagtgaggtgaggagcctaggggatgcaatgcgtttgctccaggactttttccgggaagaaggtgcaggtatggggcttagatctcttggtgctgatgacagctgacgatgagtgtcaatggggatggtgtgctctgctagcccagcttcccaggccaagtctgtgacctcctctagctgtgggtaaagactgggacttggtggctcccagagcgtgcacagacagcagagctcagggattccccggggcaaagctctacctgcccatgtgctgcctgtggtcctggaggaacagcctgatggtttgttggtttggtttttggtttggtttggtttggttttctgagatagggtttcactctgtcacccaggctgacgtgggacatgatcacgcagtggcatgcagtggcatgatcatggctcattgcaagttcgacctcctgggctcaagtgatcttcctttctcagctacctgagtatctgggaccctgatgtgttataaaaattgaaatataactcacatactgttaattcagtagcttttagtatattcacagttatgcaaacatcatcataataaaattccaaaacattgtcatcacctcaaaaagaaacctcatgcccattagtcctcactccagtcctccctctcccagcccctgagcaccaactaatctactttctgtctttatggaattgcctattctggacattttctattaatagaactgtgtaatatgtggcctgctgtgcctgacttttttcacttagcataatattttcaaggttcattcatgttgcggcatctatcagtgcttcttttttttaatgaattggcatatttgtttatttctcaattcgtgaaaatgtccttaatttgttgatgtagcaaacaaatttcaactctgctaggcaaaaaaacaaatccgctttgcagtgaacttcatataattcaactgcatacaggcaacacactatatatgaaaaaagttactaactgaattatgggtattaactactgaaaagagttaacagtttattataattttttttttcacaatctaggaagctggcagccagcagcagttctaacacaatttcgggtgctattgggaattcgggaatcttggtggagctgttactgtagtgaaacttgttcgcaaaatacaagcatacttttactagcacatgtgaaggaatctctctaaaattgacctcattggttttgttctcagcaaactgatctgggccattcaacatagtttttattgtgcctggtgttgatgcctgttctctttttacaatacattcatgaccattggatgatatcaatttgacatacatggcatcagggacttcatagccaccataggttttctcctctccatccattttgttcttatgaaatcctcctttgcttcccaaggaacttgagaagtttttcattagccccacagccaccatagccgggtccccatgtactgccatagccccattccagggctgccccctgacccggctgcctgcccccatgggttccagggcagtcccttcctttttaatgctgaatgatattctattgtatgaatacatcatattttgtttatccattcatcagttgatggacattgagttattttcacttttggctattatgaatattgccagactgctttccaaagtggctgcactattttctattcctcccagcactgtatgagcattcaaatttcttcacatcctcaacacttgttattattattttattttatttttttgagacggagtctttctctgttggccaggctggagtacagttgcatgatcttggctcactgcaacctctgccttcctggctcaagggattctcctgcctcagcctcccaagcaggtgcccgccaccatgcctgactaatttttgtatttttgtagagacagggtttcaccatgttccccaggctgatctcaaactccttatgtgatccacatgcctcagcctcccaaagtgctgggattacaggcatgaaccaccttgcctggcctatcttttttattatagccatcctagagtgtgtgaagtggcatctatctcattgtggttttgattttcgtttccctaataactattgatgttgagtatcttatcttgtggctattggccatttgtatgtcgtctttgtagaaatgttttttcaaatcctttgatcaaatccttttgattattatggtttaaaagttcttcttcttttttttttttttttttggatggagtctcactctatcacccaggctggagtgcagtggcgtgatgtcggctcactgcaacctctgcctcctgggttcagtgattctcctgcctcatccttccaagtagctgggactacaggtgtgcaccaccacacctggcaatatatatatatatatatagcattttcagtagaaacggggtttcaccatgttgcccaggctggtctcaaactcctgatctcaagtgatccgcccacctcggcctcccaaattgctgggattacaggcatgagccaccacacccagcctgagttctgtatatattctggatattagcctgatttttaaaatccttgatccctggaaggactgcgtgagtcaattctagtcccatgccactggtatcgaaggacgcctgagcagagggaagcactttgcgagtgtgtttacccctagtccacagaggcagaaacagatatgctgtccaggatcccgaggcagcccagtcattattacatctttattgaggttttacaaagtgccaggcaccatgctaatggatctgcatatgttatctcatttcctccctgcagcagccgtgggaagtaggtgttattattatccacattttaaagacgaggaaactaaacctcattacttatgacttacgtatttaatgagttactgaaatcgtaaagtaacttccacaaggtcaggcagctactaagcttcagagtttcagctgtaacctggtcttgcaactctgaagtgggtgcaactgcctcccaaacagaattcaaactttcacttcccagccccttgagttcatttccacaagtgtctggacactagaggggagagaacagtttgggactgggtcagggagggccggaggaggagaagggactttgcctccagtctcactgtcacgtggctgctctcccctcctgccagtttgcccagtatgcggagatcgtccacttcaccctcccagatgggactcagaggagcgggcaggtgcttgaggtggctggcaccaaggcgattgttcaggtgagtggggtcaatgggacattggctagttaaatcaatgaattaacccataaagttcccacactatctacaaactctgaaggcaggaaatggtctatttccctgagagcacagaaagtgcccagaatgggtagccccattccctccagcaggccccttagtggagaaactccctcttgttcccacaggtgtttgaagggacatcagggatcgatgccaggaagaccacttgcgaatttacaggggacatcctacgaactccggtgtcagaggacatgctgggtgagggacagggaggggcaggggtgggggtgctcctctgccctcccagcccagcttctctgaccaaaccctcagcacactacactgtcacttcctgtttacttcctgcctgtctctctggtgggctctttgaggtctggggtatgtcttctctctgattcctgaccccagctcagggtctgacatacaggtgttcaataaatgaggaaggtgggttcaataaactagagacacagtaggtagccacctatttggagccaggctgaaagggactgctaagccttgaatatcccctaattctctcccaagacctggcctggccctctcctctctctagtcctggaatcccccattagagtcatggtcctgggccaaggccttgcctgtaaaggtttccaggagaggaaggaagactctcacaggacagtccttgtagctggctctctgggttacctgtgggctgccggggagggggatacagggcactcctgtggggagtgggtgggagctggtggtggtgtggagggtagacagtagtgagggacacagggctagcctgagcaccctgcaacactcctcgtccaccctcaggtcgggttttcaatggctccggcaagcccattgacaaggggccagtggtcatggcggaggactttctggatatcaatggtgagtgactggaggttctggatggcttcgggacccagccctaacaccttccccactcttggaagttctgcccagactcacaagcagatcagatgtgatgggagagcagcaaaggcctctctatccccaaatcttccactgaaccccaacactgccgtcagcactccatgtccatcccctgtaaaatgccatcatcattgggcagtgttccacgcctgcccgaaggccatcatgcccctgcctttggcttcctgtccacaatcctgagaatgggctgcggtgctctgccggctctcgtccattcaagtgggcaccttccccaggcctcaaaccctatcccatctgtttactgaggacacactgggaggcctgtgggagcccgtggcttgccctacgccacacagaaagtcagtggcagagcacagaagactcatctgctcagacaggaggctgagtcacccgcaggccctctgaaccctgcactagtatctggaggtggtgatgagggctctgccctcttgggccctgaagcctcagcctgagtttccacctgcctgccacttccaaagcacaagggcagctctgtccaaggtagcactgggcctgtggctatttaaatttaaactaattcaaacagaaagaaagtcccatttcagagtcacacgtcatgtgctcaatagccatttgtatctagggctacatcaggcagcacggccagagcacgtttctatcatcacagaaagttccgtcaaacagggcggctctggagtctggggtcagtgtcgaggagagcagggaagggtttgaacccctgagcatggctctgtgatcgccctctcccaggccagcccatcaacccgcactcccgcatctaccccgaggagatgattcagacgggcatttctcctattgacgtcatgaacagcattgcccgcggccagaagatccccatcttctcagcagccgggctcccccacaatgaggtgaggcctgcagggccagcaggcatggctgggggagggacagagcagaggctggggctgctggaccagtgaggacagctcctgtgccaagcaggcaggggctggcagggctggggtcgccagcatcgagactggcagctgtccctgggcagctcagggactcaggactgcacaagatttcctccaggtccaatcttcaggctgccccaaatgaggcagcccatggggagctcccagagtagaaagtcctgcttgggggagctcacagcccctaccaccatccctgcactcatctttactcacccgctcctgcttctctcaaccaccaacagtgaacagccgcttcctctcagagcagctggtgtgacaaggtctctagatgctcctccagccacccagcaccctgatcactcaaaatggcctgagtgatcagagggcataagtgcccccaccctactgtgacccttccttcccagctctggacatggtgtcttggaggcccacagactacaggcccagggcaactctgtgtccaaatagcgcccccagcaggctgtggaggggtatggagctgccctatgccaaggtacccagacccataaagaggcagttgctctttgggactgttactctgtcctgcctctcgtgtcaggcacccccagcccactagcagcccacaataactcccaccccccaccccaagaaagactagcacctggggcagccccctcacctctctgggcttggatccctcccaccaaaggccatgagccagtggtgctcagtgggacaggggtcagctccgactctgacgtcctcctgcccaatccactctgccctagattgccgctcagatctgccgccaggcggggctggtgaagaagtccaaggctgtgctggattaccatgacgacaacttcgccatcgtctttgcagccatgggggtgaggagacttagtagactggcaagttctggaggctgtgagcaggcagcctgtctccctcagcccctggcatgacctgatctgatggggaagccatcagtgtcccggccagccaggaggggtgaggatgggagcagtgaccacggccatgtgtccctcagggtgtcccaaaggcaatcacagtggtaggatgggccctgggtggcctgaaggaggggaagccaggggattgggggaaaaaagatagcttcaggaacgggaggcctgggaggccagggaggtgggcagagcagcagctggcgacaggaggggcagggatggcactgagcagagctggacttaaagaagtctcagcctctccagggggatctgacaaggccctatgaggactggggcagcaaacccagtgcctgccctttccagccccggggtcaccccatggccttggtgtcttcacccccagcgactggtagctggtcagtccacaggctttcctgaggacacctgggaggggccaggccttgccctcaggccacagggccctacctccagcccaccctgctgtgtatccaggtgaacatggagacagccagattcttcaagtctgactttgagcagaatggaaccatggggaacgtctgcctcttcctgaacttggccaatgaccccacgtgagctttccctgatgcccaaactgccctcaggtgggcagaccccgtccccttccaagacctacagtaccagggctccagggcatcccagaactacagccatacgccagagctgggagaacaaccctcattgtgtagatagggaaactgaggcctgggaagggctaggaaaactcacaggcagagggagccagaacatgactctgtctgctgcctgtgccctctgctcttcccacaacccatgtccagccaccattccaactcagggctcctcatctctgtgtcacatccacaaagtcaccccaagaagatcaaactgctattataaaagtgtagaaaatgggagtttaaatctgggggtcaggtggatgaaaacaattctaataaactatcctgggtatttctggagggtactccagaaagcagataatagaattctggaggttttggtgacatccccaaggggaagagccacagctccagagctgggaactgagagtgtctgaagctgaggtacggtattcaggagcacttcacgtgggaagggttcatagggctggcaagcatagggacgagcacattaggtgtgctttgagcagtgaaagggacagtgagaggagcagtgagagggacgaaaccatccagaggacatgcagtgagggtgctccagctgacccaagtgtgggtgccctaggataagacagagctaaagcaggtgcccccaactcatctacagtgtgatatgccagagtccttccccttcggtccacaggggacaaaagccactctcatcttcatcaggcactcctggccctgcctggcttttcccacccaacttgcctcctggcctcagcccctgtcccctttcctaccttggacagtaggcgaggtgtgtgttggagtctgcctactcccaggaaccatggccctggcctaggggatgggggcaagggctcatcttatccattcctctgccactatgcacaacaccagcttcccagttcaccttgcgctcagcccccaggctatgtggtgcattagcccaggcctccaggctctctaaacacctggctacacctccaggatcgagcggatcatcaccccgcgcctggcgctgaccactgctgaattccttgcctaccagtgtgagaagcatgtgctggtcatactgacggacatgagttcctatgcagaggccttgcgggaggtaagctggctagcaaggggtgtcagattcctccctacccctccctaagcctgacaccccagacggtcaccctgcaaatagaggggagctggtccacccaagcctgccccactcccatgagttccagggcttggtctcagcctggccattcctcccctgccccccactccatttctcacagggtcactgaacctcccacccacccttcctagcttcagcctctcatcccctttcttaccccagtgcccatggatattgcaggtctctgctgctagagaggaggtgcctgggcgccgagggtttcctggatatatgtacacagacctggccaccatctacgagcgggcgggccgcgtggagggtcggggaggatccatcacacagatccccatcctcaccatgcccaacgacggtagcctcctcacagcccactaccctccagagctcccctgtcctcccttttccaaccagatacttaaagggcccacgttgctttgcacagatgtgcagcagcgcttttcctccatcgagatagacactgccctttcctccaccatccatgccccccacacatccctatcactcccatgagggaaacagaccccaggtggccctgagtggttggagacctgggcccccacccacactgaggccagtgagttttcttgtagatatcacccaccctatcccagacttgacgggcttcatcacagagggacagatctacgtggacagacagcttcacaacagacaggtactgccctgtccctacccacttcctgctctcagcccagagaaacactgaggaacagatgtttcactgcccccaggcatgaattaggaggggccagccaaagcgaaccccaaacaggagacagccacagggaagactgcatggttcacagacagaagacaggcctgagcagaatctggtttacctggctctgggatcttgagaagataatttcatctcttggatcctaggtttcctcatccataaaatgggaataatcaaatatatcacccagacgcattgtggaggataaaaataagttggcatatagaaagcatctggcagatagtcaatactatttgccttccctttccagttatttgcttcggtgggcagaaaacaacggctaactaacacacatctgtcctgtgtgtaggttaaaggtgacctctatgacgtttttctctttgcttggcaggtatttttttttttttttttttttttgcagctattaaccattaagcttcaaagtggtttttgtccacattatcaaaagttttgaaatactgagccttttattaactaatgccatgtcatcttccccctccactgttctgtctagggccacatataagacagctgatgcccaagccctagaatttgtgggagataagagagggtgggtgtggctgttgacccctcggaatgtaggataagtgaggagcttctcctgagaacaatttggggacagggggagcaaagcttgagtcctgctgtccaccactccctttttcttctccctcagatctacccccccatcaacgtgctcccttccctgtcgcggctgatgaagtcagccattggggaaggcatgacaagaaaggaccatggagatgtctccaaccagctggtaaggagaagagggtccgggggctggtaggtcctctagtttccgaagctgaaggcctgagccccatctgaaggacaagcttttctcctggcaaaattcctttccgaacggggtcccagtgtggccaggttgggggctactggactcccgtggtaagcccgcagcggccaccgacgccttgcccctcccccagtacgcctgctatgccatcgggaaggacgtgcaggccatgaaggcagtagttggggaggaggcgctcacctctgaggacctgctctacctggaattcctgcagaagtttgagaagaacttcatcaatcagggtaaggcgcgtcgctggtgtggagccagtaacctcttcaccctccttccgccccacacacattcctaacactccctcccgctctgtccctaggcccctacgagaaccgctcggtgttcgagtcgctggacctgggctggaagctgctgcgcatcttccccaaggagatgctgaagcgcattccgcaggccgtgatcgacgagttctattcccgcgagggggcgctgcaggacctcgcgcctgacactgcgctctagccccgcgcgccgtggcaccccaacaccggcagggaacctaccctcggctcccgggtctcccctccctcgccaccccaaccagcggcttctgcgccgccctccgccctccgctggctccgaggtggtgggggcgccgcacgctccatccctttccctcgctcgattccttttcccgcgctccatgcctccccctcgactcccggtgctgcggaagaactgaaggttgcgatgccttactctgacgggagcatctgtatttttatgttaaaagcccacaaaataaaaataaaaagtaactgagatgaatttaccttcgttgaaaacaagattggcaaaagaaagataaaaatgaaaggaaaagataattgttgaagctgggggctggggttatgagcacacggagttcattaaactattctccctatttaaaaaaaaaaaaaaaaaaaaaagcccaacgcggatgctgagactgttgtcccagctactctggaggctgagacgggaggatcgcttgagctcaggagttctggtctgtcgtgcgctatgctgatatggtgtccacactaagttgggcatcaatatggtgacctcccggagacgggggccattaggttccctaaggaggggtgaacaagtccaggtctgaaaccaaacaggtcataactccagtgctgatcaatagcagaaccgttcctgggaatagccactgcacttcagcctgggcaacatagcgagactctgtctcttaaaaaaaaaaataaaaattaaatttaagcccggcgcggtggctcacgcctgtaatccaagtactttgggaggccgaggcgggggtcacttgaggtccggagttcgagaccagcctggtcaacatggcgaaacccccgtctctactaatacaaaaaaaattagttgggtgtgatatcgcacgcctgtaatcccagctactagggaggttgagaaaggagaatcacttgaacgcggggggcagaggttgcagtgagctgagatcgcgccactgcactccagcctgggcgacagagtaaaactccatctcatattaattaattaattaattaatttttaaaaagctgcattaatgtcttaacagttgacaataaaatttttcttagggagataattatcttccttaagaaatagcttgggccaggagcggtggctcacatctgttaatcccagcactttgggaggccgaggcgggcggatcacttgaggtcgagagttcgagaccagcctgaccgatatggagaaaccgcatctctactaaaaatacaaaaaaaaaaaaaaaaaaattagccggctgtggtggcacatccctgtaatcccagctacatgggaggctgaggcaggagaatcgcttgaacctgggaggcagaggttgcggtgtgccaagattgcaccattgcactccagcttgggcaataagagtgagactccgtctcaaaaaaaaaaaaaaagaaaaaagaaaaaagaaaaagaaaaaagaaagaaagaaatagcttgataggctgggtgtgataattcaagcctgtaatcccagcactttgggaggctgagacaggattgattgcttgagcccaggagttaaagaccagcctgggcaacatagtgagacccctgtatctactaaaataatttttaaaaatcacctaggtggcacacacctgtagtccagctacccaggaggctgaagcgggaggattacttgagcctgggaggtcaggctgcagtgagccgtgatggcgccactgcactccagcctgggctgcagagtgagacagggtcgccccctgtctcagtaacaaacaaataaacacacaaatatcttgataaatttcatgtggaacatgagctcaggagccttggaagggacaaccaaggccacaaaagatgtgtgtgactctaaacagctctgcctgagagatgctaggtagaatttggtttgctccagacaggaagggagaagagttgctagggagagggcctgaaggacttggggggtatgagtgcagaagactgaagatccccagttaagaaatggatgaagagtattctataaattaggctgcctgatgttcctttgaaagctgccaacttttttgtaatatcaatccctcctctgtctcccctgccccatctacagtgaaatcatgaatgcttcctaggaagggaaagaagggtggtttgggaggatagaacttcagcaaagagctgagtttcatttctaggtaaacgtgttgtagatgacgtcagaattattggatcaagagctaggaccaaagg

SEQ ID NO: 11983 - DNA, 8229 bp, Human
aatggaggtgagtttggacgcagtagctcacacctgtgctcccagcactttgggaggccgaggcaggtggattgcttgagcttaggagtttcaaaccagcccgagcaacatagtgagactccacctctacaaaaaaatacaaaaattagccgggcatggtggcatgtgcctatggtcccagctacctgggaggctgaggcaggaggattgctggaacccgggaatcggaggctgcagcgagctgagatcgtgccactgcactccaccctgggcaacatagtgagatcccatctctacaaaatatacaaaaattagccgggcacggtggcgggtgcctgtggtcccagctactcgggaggctgaggcaggaggatcagttgaacccaggagattgaggctgcagtgagctgagatggtgccgctgccctccagcctgggcaacagcgagacctcaactctgaaaaaaacaaaagaaggagatgaaatttacataacttaaaattagccattttgaacggtacagtgaagtggttttcggtgcattcaccgacttgtgcaaccatcactgctgtccagtcccagaacattccatcaccccaaagaaggaagccccatctccatccatcagccatcaccccctgccctcccccggcccctggcaaccacagatccacttcctgcctctgcagatttgcttgttctggacatttcgtctatttatttttatatagtttttaatttgtttttatttattttttttgagacggagtctctctgtgtcacccaggctggagtgcagtggcgcaatctcggctcactgcaacctccacctcccaggttcaagcgattatcctgtctcagcttcccaagtagctgggactataggcgcccgccaccacgcccagctaatttcttttttttttttgaaatggagttttgctcttgtcgcccaggctggagtgcaatggtgcgatctcggctcgctgcaacctccgcctcccaggttcaagtgattctcctgcctcagcctcctgagtagctgggattacaggcatgtgccaccacgcccagttaattttgtatttttagtagagatggggtttctccatgttggtcaggctggtcttgaacgcccaacctcaggtgatctgcctgcctcggcctcccagagtgctaggattacaggtgtgagccaccgcacccagcttgtcaattatatctcaataaagctgttgaaaaagtttaaaaaaatcacccaatcgggcacagtgtttcacacctgtaatcccagcattttgggaggccgaggtgggtggatcacctgaggtcgggagtttgagaccagcctggccaatatagtgaaaccccatctctactaaaaatacaaaaaattagccaggcgtggtggtggacaactgtaatcctagctactcaggaggctgagacaggagaatcacttgagcctgggaggcggaggttgcagtgagtcgagatcacaccattgcactccagcctgggcaacaagagcgaaactccgtctcaaaataataataataataataataataatcacccatacagacgcgcaggactcaacgcaggactgccagctccactgccctgagccccccggtgccaggcccagcgggcagtgctggagccccagtggcttgggatggggagactgggactctgagctggcaatgttcctgggtgctggctgcatgcccgccatgtgctgggctccgggatccactggttcctgacaccctcacctgcccctgggggtgtggccatcttctagagagggaaactgaggatcagtgcagaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagacttaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagtgaggggtcctggggagggggcctagggggcattggggctcagagaaggggcttggggggcttaggcattcagtgggggtgcttggtaggtgaggaggggaggggattgcaaaaggaggggctcagggaaaggagggggcttggagagggaaatggggactgagttgaggagggacccaaggatattggggggctcagatggaggaggcccagagaagggaagggggtcagatggaggaggcccagagaaaggaagaggctcagatggaggaggtgcagtgaaggaaagggggtcagatgggggaggcccagagaagggaaggggctcagatggaggagggggcccagagaaaggaaggggctcagatggaggaggtgcagagaagggaagggggtcagatgggggaggcccagagaagggaaggggctcagatggaggaggtgcagagaagggaaggggctcagatggaggaggtgcagagaagagaagggcctcagatggaggaggtgcagagaagggaagggcctcagatggaggaggtgcagagaagggaagggggtcagatggaggaggtgcagagaagggaagggggtcagatgggggaggcccagggaagggaaggggctcagatggaggaggggcagagaagggaagggggtcagatgggggaggcccagggaagggaaggggctcagatgggggaggcgcagagaagggaagggggtcagatggaggaggtgcagagaagggaagggggtcagatgggggaggcccagataagggaagggggtcagatgagggaggcccagataagggaatggggtcagatggaggaggtgcagagaagggaagggggtcagatggaggaggcacagagaagggaaggggctcagatggaggaggtgcagagaagggaagggggtcagatgggggaggcccagataagggaaggggctcagatggaggaggtgcagagaaggggagggggtcagatggaggaggctcagagaagggaagggggtcagatagaggaggcgcagagaagggaaggggctcagatggaggaggtgcagagaaggggagggggtcagatggaggaggctcagagaagggaagggactcagatggaggagggggcgcagagaagagaaggggctcagatggaggaggaggcgcagagaagggaaggggctcaagatgggaagggggccctggaaggtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccgcctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttgggaggccgaggtgggcggatcacgaggtcaggagattgagaccagcctggccaacatggtgaaaccccatctctactaaaaatacaaaaattagccaggcatggcagcgggcgcctctagtcccagctactcaggaggctgaggcaggagaatcgcttgaacccgggaggcggagcttgcagtgagccgagatcgcgcccctgcactccagcctgggtaacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggttcgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctgctcctggtttctgttcattggtgggggagggggctgtggggacgcgtgagtggcaccttcaccggccttaggggcacccaccgcaggtgcactgcctgtgcagatgtcagatgttcagagattccctcaaagcccgggaagcaggggctggtgttatctgcacccgacagcggggtgttggggggaggcccaggttcagagaggttgggtggctgcccagaggtcacacagtgaatgccgcccagcactttgggaggccgaggtgggcggatcacctgaggtcaggagttcaagaccagcccggccaacctggtgaaaccccatctctataaaaatacaaaaattagccgggcatgatggcgggcgcctgtaatcccagttacttgggaggctgaggcaggagaatcacctgaacccgggaggcggaggttgcagcgaaccgagatggcgccactgcactccagcctgggcgacagcgagactccagctcaaaaaaaaacaaaaaccacgggagaaaacggggaacattctcctcttggatccaatagaaacagtaaaacgtgaatatgaaataataaatataattgtatatataaataatacagaataaaatatgaatatgatggctggatgtggcagtcacatctgtaatctcagcactttgggaggccaaggtgggagcatcgtttgagcccaggagtttgagaccagcctgggcaacgtagtgaaaccatgtctctacaaaaataatttttaaaattattaaaattacacaggagaggccgggcacagtggctcatgcctgtaatcccagcactttaggaggccaaggcgggcggatcacgaggtcaggagattgagaccatcctggctaacacggtgaaaccccgtttctactaaaaatacaaaaaattagccaggcgtggtggcgggcgcctgtagtcccagctactcgggaggctgaggcaggagaattgcttgaacccgggaggtggagattgcagtgagccgagatcacgccactgcactccagcctggtgacagagcaagactccgtctcaaaaaaaaaaaaaaaaagccgggtaagtggcacctgtcgtcccagctactctggaggctgaggtgggaagattgcttgagtccaggaggtggaggttgcagtgagccgtgatcgcaccactgcactccagcgtggtccacagagcaagacccagtctcttaaaatgataataataataataataataataataataataataagaagaagaagaagaagaagaagaagaagaagaagaagaaggaagaagaagaagaagaagaacctgtagtctcagctattgaggaggctaaagtgggaagatcactttagcccaagaggttgaggatgcagtgagctatttttatctcatttatttatttatttgagacagagtctccctctgtcacccaggctggagtgcagtggcgcgatctcggctcactgcaacctctgcgcccccagttcaagcaattctcctgcctcagcctcctgagtagctgggactacaggtgtgagccacaatgcctagccaatttatatatatatattttttagtagagatggggtttcattatgtcgaccaggctggtcttgaactcttgaattcaggtgatctacccatctcagcctcccaaagtgctgggattacaggcgtgagccaccgcgcctgaccttatttcatttatttttgagacacggtctttctctgatgcccaggctggagtgcagtggcgtgatcaaggctcactgtagcctcagcctcccaggcttcagcaaccgtgcccggccttagaattcactcttttaaagtgtgtaca

SEQ ID NO: 11984 - DNA, 26763 bp, Human
tacagtaacagactggagcaatcatcaaagttttgctttccatcatgaaataccaaattcaaactatgtaacactgatgtaacaataatcatatactgtccatattcaaatttcaccaatgtcctagtaatgacctttatagcaatttcacttccaatccaggatccaatcctggtttattgagttggtcgttaattattgtttcttggtctcatttattcttcaataaattttttcaagtaattgatttcatgtaagttaccaaattaattagcataaaattgttcataatattccctaattaatgtcagttggatctataataataggcccactttcattttgagctatttgttatttgtgtcctatcttgtttttatttaatcaatctaggttgtggcttatcaattttttagctttggcttcattttataattttaaaaattatattattcttcctttatcattcagtttgaaatatttcctaatttccagtgtgatttctttttgactcatgacataaatatgtttgattttcaaatatttgggagttttctagatggcttaatgttattaatttctaatttcattgagatatatgatttcagtatttttacatgtatcgagattttatggcctaacttatggcctatcttgttgaacatgccgtgtacatttgaagttgttgaggcgattagggtaaggtcattatagtgttcaaatctatgcctttactgatttttttcaagttttctaccaattgttaaaagggatttaaacaccttcactcatggttatggaattgttatttttcctatttctccttttaattctgtcaatttttgccacataaatcttgaaatccattattcggatttatggtttttatgatcttgtcatatagatatatgatatatatatattttataatcttagtcattactactttaggtttcttatgcttattgttgcatagtatgtgttgcgggaagtcagggaccccaaatggagggactggctggagccgcggcagaggaacatgaattgtgaagatttcattttaatatggacatgtatcagttcccaaaactaatacttttataatttcttacacctgtctttactgcagtctctgaacataaactgtgaagatttcatggacatttatcacttcccaaataatactcttataatttcttacgcctgtcttattttaatctcttaatcctcatatcttggtaagctgaggatgtacgtcacgtcaggaccactgtaattgtatctgactgtacaaattgattgcaaaacgtgtgtttgaacaatatgaaatcagtgcactttgaaaaagaaagaataaccgtgattttagggaacaagggaagacaaccacaaggtctgactgcctgtggggtcaggcagaatagagccatatttttcttcttgcagagagcttataaacagacgtgtaagtaggagagatatcgctaaattcttcttgtagcaaggaatattaaatattaagaccctaggaaaagaattgcattcccagggggaggtctataaacggccactctgggagtgtctgtcttacgcagttgagataaggactgaaatacaccctggtctcctgcggtaccctcaggcttattaggatggggaaaaaatcctgctgtggtaaatctgaggtcagaccggttttctgctcttgaaccctgttttctgttgtttaagatgtttatcaagacaatacatgcacagtggaacatagaccctcatcagtaattctaagtttgccctttgccttgtgatctttgcattgccctttgccttgtgatctttattggcctcagaagcatgtgatcttgttctcccttttgccctttgaagcatgtgatctttgtgacctactccctgttcatacaccccctccccttttgaaatccttaataaaaacttgctggttttgtggctcggggcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggtatgtatttttttcatttacttacttccattcttttaatgtaatttttcaccacaatccagactctcagtaatcctttccttgcttttgtttaaagatttactccaaaaatgtggcctatagttttagttcagcaaatacaaatttgaaagatttatttatgtgtatttatgactagtttctaacgacattatgtttataagattcatccaggttattgcatgtagttgtaattcatttatttttattctctagaagaagaattgctgggtcaaaagttattcatattgtcacatttattagacaatgtccaattgctttccaaagtggtggtaccaatttatattcccttagtagggcttgagtctgagtgattcacttcctaaccaactcttatttttggaatttttaattgttgccaaccttttaggtatgaaatacacaccatgattttaatttgcatttctttgataatgagattaagccttttcccataagcttatgattgtgtcctattgtctgttaagtacctgtttaagactttttctcatattcacctgagatttttagacattacttttttaggaatattttatgtatcccagttaataattcttaatcagttgtatctgtagcataagtcttgcaaggtagtagcttaatagttttcaagttttttatggagtatttggctgatcagacttccttaaaattaagttgaatttaagtttcctttaagtttgcactttttaaatgctctatcacctcaaaaaagatccagtacttttatggagatagtccttttattgtcatgtaaaatcctactaacactccgttctgtagctatttcaagaaaccatgtgaattagttgaggaggattagtaggagatttggtcctccccaaattctgaaagtggggcttgagtattttattactcattactgtgatcacatttgtagttttcatcttttgttgtctcaggaaagaaaccatttgcaaatgcagagccctccagaagttaccttgagtattttattgcagaagaaaaatatgccctaatggtgccaataggggtcaaacaacttctataaagaaaattattaaaataatgtgagtaaaatgtagtggcaatccctaagagggacggatttagagagaacagaaaatgaagagggaaaatagtgatacatttattgggttcaataactgttaaaaattaataggaaactagagcaagaggtatgtggtgacctagcacttaagttagctctgttatacttccaaaggcatatttgaggttttggccttctgggcaagttttggtagggtgtctgtcattttccctctactgctggaaaagaaggctcaagaggaagaatccaggtactttgtattttaatcaggactatttatttgggccgattggaaataagttaaaatctctgctcttgaattaaatcagagtttatttacctcagtgtttggaattttagcagttcatgaggacaaatagtctttttgttcatttcataatctcagctgtagagttgcccagagtgctcagataagtgtgtcttttcattttgatttgcttagaaaggatgtcagtagggacttgctattatgatgatattgagctgaaatttatatttctgaggaaaatgaaaggctatcagaagtcatttgttaaaatttctttattctgtcttccccatccccatcaatatttctccctcttttaaaagactattgcctagaattttatagaataagccctcctattctgggaaactgtactgtggtcctatttatattttgtttgaagggtaattttcttttaatgtaagactaatgccatgttagaattagattctgtgaaaatatttcttgaagctttgaatatatgttatacctatttatgcaattcaggaatgctttctggtagtgaaatgtaatgttaaaaaataccaaaaaaagcaagtataagtttgagctaaagttaatgactttctaattgacttatttctgtttgggcacgctggttgatgcatgtgatatttgtatagaaataaattgaatggataatattgttaggggtggtgaatatctgagttactggtggcaaatctgtatgggtctgcagcaatctcatttcttgcctcctcgaaagaaagaattcaactgaggggcataaggcagtaaaagagaccaaggcaagtttcagagcaggagcagaagtttattaaaaagctttagaacaggaaagaaaggaaaacacacttgggagagacccaagcaggcatcttggaggtcaagtgcctcgttcatccttgaacctaggattttatatgctggcctacttctggcatcttgcacccctttcccttcatccttcccttaagggttatggggagccacccacatgcatggtgccctgcttgtgcttgggatgtgggcatgcacagtgtgtttactggagttttatgcatgcttatctgaggctttctttcaaattctggtggaatgcccctggaaggtcatactctgccattttgactcttaatgtgcatgtttgagctcattcgcccagttcctgaaagctgccaattatcaatttcaggtgtttttatcagttgagaaactgcctctccctggtgctggctgtgaccaattgttattttagagaagcagagtgaccatcacctgatagtcacctgacattctggtgggtgggggcaaccctctcctgccccactcatgcatgactagctacctactgtaacaatatgtagaagaaatactataccttaagcttatttagagtaggaactgcatcttatctgtcagtgactatgacatgtagactcttgataaattctttttgaagtactaatcaatttgactaagagttggaaatgtagattccatttctgactctcatgtatttctgtatgatcttaagtactcaatttcttgattacaagaaaacaaatgaaatacggtacttggaagctatagtatcacttatttttaagcttctcaggaaacatattcaatgtttactcaccactgaattatcattctcaggacttctctctctgtaggctcattcttgtcagcatgtatttatgtctgtgtctgtctcatctctcatctatatatacacatatatgcaacacaaacactgttgcatatattttcttttactttcaatctgtctttttttgacaatgtgtttctgaaaaataaccacttgctttttcaattagtttgacaatctgtcttcttttttatttttatgtatgtatttattttagagataggatttcagctctttcacccaaggtggagtcagctctttcacccagtggcatgatcacagctcactgcatccttgacctcttgggctcaagcaattcttctgcctcagcctctcaagcagctgggactacaagtttgccccaccacacccagctaatttttactttttttttgtagagatgggatctcactatgttgcccaggctggtctcaacctcctgggatcaaccggtcctcatacctcagcctcccaaagtgctaggattacaggcatgagtcaccacgcctggcctgtgtcttctaattggagtgtttgatctgtttgtatttaacgtaattattgatatgtgtgggtttaaactcccatttccattcatcccatttattatttgctcctttattcctcctttcctcttgtggcagattgcatttcccaaaaatgtatacacaaatacacatacaaatacacacacacagccaggtgcggtggctcatgcctgtaatcccagcactttgggaggctgaggcaggcggatcatttgaggtcaggagtttgagaccagcctgaccaacatgctgaaaccccatctctactaaaaaaacacaaaaaaattggccaggcatggtggtgggtgcctgtaatcccagctactcgggaggctgaggcaggagaatcacttgaactgggaagtggagattgcagtgagccaagattgcaccactgcactccagcctgggcgacagagcaagactccatcttaaaaaataaaaagcaaatacacatacacgtttcatccacttaaaaaaattttacaatgtgattgacatatctcctactgttaataggtatcaacattttctccacttgaattttgatgggagcttgtggctgctattaaatggcagagattatgctatgtgatttccagtgctaggatataaaaaggatacagcttctacctagctttttctctcttgtgttgcttgcccttccaacccagccaccatgctgtgagtaagcttgctctgtggtaagtgagcaggtctgtgcaaacctacccccaaaggccaagggagctgagacactgaacaaagagagtgacaaaacagtttctcagagagaaacatttaataggggcttacaaacagaagctgtgtctcaggcagctgtgagacaaaggatcccctcactgttactccccagacccagggttgatataccatagggaaaggatatacatgcttcagcaggaatatgtaggaatttgcctaagggtaggatttatggtaggtgctcttatacaagagatagtagataaggcagaaatcttaaaggcattcctagaagtgggattaatcagatgtcaactggcagattagaattcaagatggagttgctataacctccacactccagctttctaattgggcttttagaatctcacacactgtcctcttcttcaatggtctttgagtttagaggaagggtgcttgatattgtacagctttagcagcagtgcactggcaatgggaaacagatcaggcccagtgggatttcagatgagaaaaaatgcataggctttcttgaatcatctctagtctttggagtaccatgattttgattttcttggatgaagtaaaacaatgagagataaataacattaatatgcacacaagggactacaatcaaaaacagaatttgtatgccagaacaacaacaacaaaaaagaacctattccattagggagccaactaaaaacaacatgaagaaaattaaaaccgggtttgtctttagagacttcttgtagccacaaaataatttaggatttagtccaaattgtaggcaagtaataaaaacaatggttaagactagaatctaatcatgggtgtacaatagttttcttctgaaacaatttttttctaagtttctctatttctaccaaggataaattattgtaggaccaatttatttgcaaaatgaattttagtctcattatgcttgacctgattatttgcataaagtgcagcaagaatagtgattggccatataggttcttgtaaaattggcttttttggaacttttaaataaagaatctcagatttttttaaagccttgaggctaacaaagccagggatttgccatcaggctgcaatagctgtataaattgggtgaattcttctaaagatttccaaataactggaggttcctgggcatgtcaaaatgcgacattcgccggatgcggtggctcacgcctgtaatcccagcactttgggaggctgaggcaggcggatcacctgaggtcaggagttggagacctcctaacaatggtatttctggttttagatccttgaggaatcaccatactgtcttctacaatggttgaagtaatttacactcccaccaacagtgtacaactgttcctatttctccacatcctctccagcatctgttgtttcttgactttttaatgatcaccattctaactggcatgagatattatctcattgtggttttgatttgcatttctctaatgaccagtgatgatgagctttttttaaatatgtttgttggctgcataaatgtcttcttttgagaagtgtctgtttatatccttcacccactttttgatgaggcagtttgtttttttcttgtaaatttgtttaagttccttgtagattctggatgttagccctttgtcagatggatagactgcaaacattttctttcattctgtaggttgcctgttcactctgatgatagtttcttttgctgaacagaagctctttagtttaattagatcccatttgtcaattttggcttctggtgaaattgcttttggtgttttagtcatgaaatctttgcctgtgcctatgtcctgaatggtattgcttaggttttcttctagggtttttatagttttaggttttacatttaagtctttaatccatcttgagttaatttttgtataaggtgtaaggaagaagtctagtttccattttctgcatatggctagccagttttcccaggaccgtttattaaatagggaatcctttctctgttgcttgtttttgtcaggtttgtcaaagatcagatggttgtagatgtgtagtgttatttctgaggcctctgttctgttccattggtctatatatctgttttggtaccagtaccatgctgttttgtttactgtagccttgtagtatagtttgaagtcaggtagcatgatgcctccagtgttgttctttttgcttaggattgtcttgactatatgggctcttttttggttccatatgaaatttaaagtagttttttctagttctgtgaatagtattgaatttataaattactttgggcagtatggccattttcacagtatcacttcttcctatcaatgagcatggaattatttttccatttgtttatgtcctctcttatttccttgagcagtggtttgtagttctccttgaagaggtccttcacttcccttgtaagctgtattcctatgtattttattctctttgtagcagttgtgattgggagttcactcacgttttggctctctgcttgtctaatattggtatagtaatgcttgtgatttttgcacattgattttgtatcctgagactttgctgaagttgcttatcagcttaaggagtttttagactgagatgatggggttctctaaatatagaatcatgtcatctgcaaacagagacaatttgtcttcctctcttcctatttgaataccccttatttctttctcttgccttattgccctggctagaacttccaatactttgttgaataggagaggtgagagaggacatccttgtcttgtgctggttttcaaagggaatgcttccaggtttgcccattcattatgatattggctatgggtttgtcataaatagctcttattattttgagatatgttccatcaatatctagtttactgagagtttttagcatgaaggggtgttgtaaacattttagcttttataatcctatcaatccttatattttatgctctagtctcaggaacttctgtactccacccccagaccattttaccctctcttgtgaaaaaacctctgggttcccagcaaggagttgagccaagggatgtgggcctttttgtcaatctttatctgattagtctgtctccacattgccccaggaaattattaatcagctttctcattgtaatttttgccttctgatttttgaaacttccccaatctggtgtaaatatagaaaactgatttggggctctttaatgttggggaaccagcagggactccctttggtccacccaacatttgatagtgttgtattaagactcaaaaggtaaacaaaaattttattatctctcattaatactatccaaaaatcttgttcaaaagagaaaactaaattttgctttgtattagagtattatcaatagtaaagctaattttaataaaattttatgaatgatttcattgactctcactcagcttttgaccacacaagaattccataaagcttttctctatccaaaggaatataaataaatcactctaccataaagacacatgcatatgaaagttcattgcagcactattcacaatagcttttcacagtttcaaagacatggaatctacctaatgcccattaatgccctcttacaaaattgctttctatgtttctctttctctaacttttagatctatttatttgtatctatatcatttcttccattcattttgaaacaatctttaaaataccactaaaccgggccagcatgcctacatgctcctagtctttgtgcacgagtgggaggtggcaggcctccaacaatgcagctagtctttgtgcgtgagtgggaggtggcaggcctccaactgtggccttctctgctgactgttctagtgaggcatccccagccatgaaccattttggtacctggttggtgggaggcagggtgaccccattgctgccactgaaagcccgcaacaatgaaaatctcaacaaaattggtatgtctttggatgatatcatcaaactaaattgacagggaggaaagaagcataattttctaactggagcctggcaattcaggatgagcatatgatggagaattcaacagaattctggctttggtaagactagtctgagcacagaggatgagtaatgcctggaaagagacagctttatggagttatcactggccttgcatctaggaaagcaactggaattcacaaagaaattaatcctatgaatcatccgtctctaggtgacaggaatatagaacgatattttctagtgttaaaaaggaaggcaaaccttctgggacaaatatgaagtgcagaaaaaaaccagttgcagttctcaagggacctaaccagctaaacagaaaaaaaaaaacattccagccaattttaccaagaatggaaataaattaagccatcagaaacacatgcgtcaggcaacttttcatttcagaagagacgtgaaggttcagacccagttgaacacaacagcaactgctggataacgtagtcggaaagagaactcatcaatggcagatttttgttgcaggacttctttttagttcagctaaagatgtggtccttgtcccacggccacaaaaatttaggctcacaatttgcggagtgagaaaaatggaacttattgggcaaaaaggagaaaagggggaacagttactttcggcaaagccggaatcgcagctagtgcgctccctgcctcgccatttgaatccaaggttccacacaggaagaggaggggccaggctcctccctactgcaaatagcagaaacttcggtggcaccccagtgtgcattcctcccagttcgcccgcggttggagtttttccatggactccttcccactggctgtctcactttcaccacaaacggaggaattttgactctatctttggacaatcctggagcagtgcaatgcctaacacagaaatcaggattaattcatactgttgtatcttcatttttaacaaaatggaagcaatctgacataacgaaagttcctaaagtggaaccctacaattgacataaattgtgctggaaaacagacagagatgactttgaatgagaagtttaggatcctgaaggaacaaagagccactctgacaaacaacaaaggaggaagctgctttgtaactgtattagtctgttcacacactgctaataaagacatacctgagagtaggtaatttataaaggaaagaggtttaatggactcaaagtttcacatggctggagaggcctcacaatcatagcagaagacaaaggagaagcaaagtcatgtcttacatggtgtcaggcaaaagagcttgtgcagggaactcccatgtataaaaccatcagttcttgtgagacttattcactaccatgagaacagtatgggggggaacaactcccgtgattcatttatttccacctggccctgcccttaacatgtggggattattacaattcaaggttaagatttggttgggaacacagccaaaccatatcagtaatcatgggatagatcccatatcaaagggaattttgagtgatgacgctgaaaaattgaattgcttgaagagttcatcacagaaattcaagaaactatgcttcaaaacattcacaaggctaactcatttttatttctgaaggtttttttttttaaataaagcaggtatgatataatgccctgagacaataacagggaatatacctgttcttaaagatttcattgttggctcagacagaacaattatctatttgacttctttggttcctcttatagcagaaggaagatagaaatatagaaactgattatttttatgatagtggtatttaggatctcattgcctttgcccatttttttagattttatcatgacaaatcttggccttctgaaatatgggtaggtccctttgttgctatcagttatcctttaatagtgttgatgcagtaaatacagttgccttgtcttcatgagagatatttttaaaaatattggaattctagtttggagtttcaagatttatgaaaatatctgaaacttggttcacttttcaggtacattttaggctaataccccagaattatgaatttttagtgctgaacttagaaatgtggctctaggcattagtctcagcttaaaatgttggtgcttaaagactgaagatgcatatttacaaagttaatctgatagggccttggaggagagggtccagtttaagaatctgacagtttgtatttagtgaatgaaagcatgagagcaagtagcaagttgaaagacaggtaactgagatgagaaacttcaaaacttaggtcatgtgtactgtttggatttagtgtagtcttgagtctagtgtccacaaataattcttcaaatgatatttagaagaattataattatttaaatggagtccttcagacattttgatagtaaaattaataggcgtaaagtcctaaactttatttgaaaagttacttctcatttgaaaagttaaaatttatgagctttgaagcttgctaaattaatttatagctccaaaaccaaaaatatacttgtatatgtcacaaataacagaagcaaaatatataatagaattacattgtaccttgttgtttacctttcactgatttcttgtatggtataaagctcagtattgatggggagaaaagggcttcgcccctacccccgagacctttgatgggtgggaggagttagtctgtttgccaagatagtgctgagtcctcagatgttgaacactataaattatagtataatgacaaattcagcaaaatgttccagctataagttacaggtttagtcattttgaagcttgacgttttagtttgctataatgttaaaaacatccaagtaggtgatagtttctctggagtatattattagtgttgacttttcctataaaacaaaacatcgttatcgttcagcctgccttgcattttatactagacttcattcttgtctctcatgcttcttgggttacttaatggtttatgctagccctgaaagctatcagtaaaaatttcatgcttatatcaaagaattaaatctgatcctttaatatctgatattttgccagtacttctagtgataagggatttttggaagtcagtcacagaatttaaaaataaattctagtctttcctcagctatttgatactcatccctgttcctgcaaaagacatgatcacattattttttatggctatggggacaaataggccaagtactcattgccaagcatttttgtaagtatgcatgcttatatttggtccagaaacaatgcattctagattggtttagaattactggtagcttattttacagcaaggaaaagcagctgagcaagaatttgctgtctttagaacagtttgtgaaatatgatataagggtgttttcatttcctattccctattctctctctactctgctcctctgaccccattcattgaaaggcagctgccttattttacatgaaggtgtgcaatgcctcagatttctttcagcttgcacccctgatctcggtctgagcacatggtgaagctctacggaaagttggcagatagagaaagacttactctgtggctacagtttcttggaattctagtttatcaaaccaatccacacatatccattaaaagtacattaaattttctgttgatttctccttatttttttctgttgggtttattttttgctgctttatcataattgtaaatcagcatgtaggagagaaaactttctgtttcctatggagcagcttgtcacttgctggagttcaattcatgtagattctttgcattctcagtaatctaatgagttacaaacaaaacaaaaataaagaccaaaaaaaaaaaaaaaaaccaacaaccccaaaactaattttgtagtttatgcagatagttgtgtttgttagagagagaacagtggtaactcttgtggctttcttcacactaatcaaaaggagatgggcatttcttaatttttaaaaagttacaaaaagctcagcaagacttttatgtacctgaatggcctgtcagcttctagttttgctttcctttgggtaaatcctaagtacaaagctatggatgttttttctctaaagagcaatacacacaccaccccttttgttctttccaaagattttattctcattcttttgagaagatccttctgggtttttttttttttaactttcattttaggatcgggggtatatgtgcaggattgttacataggtatattgtgtgatgatgctgaggtgaacctgtcaccctgatattaagtacccaataggtagtttttcagcccttgcccccatccctctctctgtcctcttgcagtccccagtgtcttctgttcccaatgtccgtgtgtacccaatgtttagctcccacttataattgagaacatgaggtatttggttatctgtttcttcattagttcacttagggaaatggcctttagctgcatccatgttgctgcaaaggacatggtttcattttttcatggctgtatagtattcctattccatgatccctctatttttttatgttctgttgcaggtaaactcttggatgcaaggcattctgtttccaggacttggggaagggattagcgtgaagtcaaatgtctcatatatatataaacgttcaataaataaccatattttcaaacccacatcttatttttatcctccattgtacctgatttcttttaaaggttctgtataacagattgtgttatcttcctagatgtattgataccattcatgcatattttggctgctgcttctttaacagtggttcattattgttataaaatttgtcagcttgcttactgtcttctggaaattcattgaaagctctcaggtgtcttgtactagaagactatatcaggaagtttctaaagaactagagggttagaactgactcctaagtggtctgactgctgattcaattcacctttcatcaacccttatctctactttattttactgctcctctttctttcttttttgaggttttgaggttttgctgaagatattcctgaagaatcatcccaggtgccacactaaaaaaatgatccagttgacagctacccctgtgagtgcacttgttgatgagccagtgcatatccaagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggtgagtagaattactctgcttattgttattcttgtttttccactttaaatacattatccgtctagaaatttagcttgaatagcttgtagaattactctggttattgttattattgtttttccaccttaaatgcattatccctccagaaatttaacttgaatatggataatacctagagcactgcttcctgccttacaatcaatgttaaccttgggtctgaacaagaatgtggtaatattctactccagctcaagtttcatctcaacaattctgaagcttgtctaagaatgtgactacatatagtttatggagtccctacattatgggctttacatagctttggatttatgctaaatttttctgcactgaagccaagatgggaggattaatagaggccaacagttcaagaccagcctgggcaacatagccaaactctttctctataaatactaaaaaattagctgggtgtggtagcaggcacctgtagtcccagctactcagcaggggctgaggaggaaagatctcttgagcctcggagattgaggctgcagtgagccatgttcctgatactgcactccagcctgggtgacaaagcaaaaaaaaaaaaaaaaaaaaaaaggataatgcatgcaaaatgcttatcatagaacctggcaatactaagcactcaaagatgaacaaatgttagacaaaactttctatgatctgacttctgcatacttcttcagccttatcttatagctctaatcttatagctatatgaagaccctcatcttgatgtgatggaaaccatatcccagatccttgtacaggctctgtcaggttgagtttcagtttaggcatgggttattaccttgttgccacaacaagctggagataagatggactgaaagattgcagcaaatatagaggatgcaagaaactttgtaacctctagcttcataaatattacatatttatagactattccatgaatctaataatatagcatgcttcctaatggctataaaacttatcagaacgctcatagtttcccacagaaatctccaaataccaataaataagtggtttaaacatgttttggtacatttctcagagtttattgtggggccaaataaagcaaagttaatttctcagaagaaaaaaaagcaataaaagctttcctttccaaattcaccataacccatgtacttgttcggataaatttgagtttttaaaatacccagtaaatagcatatagaccactttattatgtatagggaccaagaattaaatggcacaaattgctgtgcctctattatcccaccccagttaaaaatctgcttattggtacaggccttccatcttgggatgatgtgctggtttagggtgtgctgtttgtgaatcctcttgaacactgcatgtgctgggtctcccgcttcaagtgtgttttctatcgggggaacaaaagagagctgagttgtgtgaggttataaggaggttgagtcagatcacaaatatttcatgactgtaacattcttccaagataaaagactcagtacttttaagtgttcccccattcttgtcaatcagatggtaaaaacatccttattcatttatgcaaatgataatttaaaactaagatatattcaacttcactttatttattatttattcattgtacttaattatagtaatttttaaaaattcccaatactcctttaaatcaagccacttctttcaaatatggatgggatcactctgtcttagttaaaaccacttataaaagaatagaatatccctaataagtgcatcgtaagtttctttcagtgtgtgggctctgctttattttggaaaaaagctgcctatacagagtgactgtagaatgatactctggccgtccctactttttaccacgtgtcagcctgcaaaaaatgaacatggcgttattgaataaaggggctcatcatttacataagcttaggtgtaaggtttcatcactgtatagtcaaatgaatgtagcagagcagtgttaagtcaggattttagctaatacaatcatttaaaaaatgtttttgaatcatgtatttctttgagaaccaaattaaatctgtggaacctctcataagtaaaattcacctacaaatatatatataccatattttgcatatattgtaatttcaggatcttcacagatttcctaaagcttatttgtatacttctttataggttaagaagccctggcctaatttatatgcctttctttacaacaagagtatagaaactactgtgaattcccatttcctcagctgcagagagtaaatatgtctctgaatgtagttcctagtcaaacgtctagatattgtgttccattatatattcaatggaccttaattctgccccaggtagaaggctgaaagtgttggaattgtatttgaatatttaaatgttaatttcaaaattacatttgaatgtaattttgcatttctgctttgtgttctcatgtttttattatcttttatttatttattttatcttttattatctaatcatttgtatttctgctttgtattttcaagttttcttatcttttccacaccttctcttcatgtacaattctgttttgttatttttcaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtaatttttgtcttttcagtaggtttgagtccctggggtttttttgtttctgtttttgtttttgttaaaagacagggtcttgctccgtcacccaggctggagtgcagtggcatgatctgacacttggccagaagccagtgccttttgatactacaatgtgcacaggctaacttcctatgcattttgtctttctgagcaaaagacactggatgagaaataaatcatgtgaattataaataacatgggcatgaatagaatttcaagttcactgagaatcgtacttggaagttaagagaagtcataggatattatggttattttttaaaaagggactggctgggtgtgatggctcaagcctgtaattctagcactctgggaggccaagatgggaggattaatagaggccgacagttcaagaccagcctgggcaacatagccaaactctttctctataaatactaaaaaaatagctgggtgtggtagcaggcacctgtagtcccacttacttagcaggggctgaggaggaaagatcgcttgagcctgggaggttgagactgcggtgagccatgttcctgccactgtactccagcctgggtgacaaagcaaaaaaaaaaaaaggataatgcatgcaaaatgcttatcatagaacctggcaatactaagcactcaaagatgaacaaatgttagacaaaactttctgtgatctgacttctacatactgcttcagccttatcttatagctctaattattaactagctatcatttttctcatcactatacttaactggacagataatctgtatttctttgaagaatgagtctgaatttttagttactcatgagcccttaaacataatactattagtgctttccaatccatatgccttttaaaattttaaaacatgtgctttgctactatgatatgggatagagttggagtttattaaaccttgttaattgcccaatattttttctttcctttccttttttttttttttttttctttttttgacagagtctcgctctgtcacctaggctagaggcagtggcacaatctcagctcactgcaacctccacctcccaggttcaagcaattttcctaccttagcctcctgagtagctgggactataggcgcgtgccaccatacctggctaatttttgtatttttagtagagacggggttttgccatattgggaaagctggtctccaactcctgacctcaagtgatccacctgccttggcctctatttttttttttaataagaattgaaataaaattaaatctccatactacatgtttttttatataaggatcaccaaaatataatcaggtttgcagaaataagataagcaacaattactgacaatctactgatgtagtgaacattttaaatggctatttttgatgcatataatggaactgccctcgaaatgtcagtcaatattatcattgtgagccttcttcttggcttagatgagaagtggagaggttatgtgattctcttttttcacggtctttgcctcgttccccttatatttgctgcatgactttttcatcactgttcttgccagtgtcacatagatagctagttaatgattaatccaggcctggaaaccagatttttttccccagactctgagaaattccattaaacctacttcacattgtctcttctgcaggatgatagaacagagatctttcttgcaggtcttatttctctatgtgttgattttaagtaacttctaagaactcataatttcctgatcccaaattttgtggtagaagttgtaacaagagttactgttttggcaagggacagaaacatattaaaaagcctgcacagatatgagtcatgcttttttgttctttcatgttatacttgcttttactttatctttcatggccaaatccactctgagttcccatctttccttaacataactgtcgctctctatcttatatattaagatataggattgggaggggtgggggagaaaggtaggtcaaagggtacaaagtttctgttagacaagaagactaagatctggtgatctgttgcacagcatggtgactatagttaataataatgtattgtatatttccaaattgctaaaagattagattttaaatgttcttaccccaaagaaatggtaagtttgtgaggtaatggatatgttaatcagcctgatttgttcattccaccatgtatatatgcactgaaatatcacattatgcaccataaatatgtataattattatttgtcaattaaaaataaaaattaggccaggcacagtggctcatgcctgtaatcccagcactttgggaggccgaggtgggcagatcacctgagatcaggggttcaagaccagcctggccaacatggagaaaacccaactctactaaaaatacaaaaattagccaggtgtggtggcgggcgcctgtagttccagctcgggaggctgagtccagagaattgcttgaacctgagaggcggaggttgcagtgagccgagattgagccaccacactccagcctgggtgacagaatgagactcagtctcaaaaaataaaaataaagtaaaaaataataaattaaaattaaaattaaaaaaatacagaatttcagagcttgaaaggaacttttaattgattcaagccacccctgttaaatatacagggtaggaaatagagagtatatatgactcattccatttgtttagttttttttttccctcttaccctaagaatttctcacattttcatcagcttggcatgagttgtatattgattcatgtgtttctaagtagtagggaaaatatcccaaacattggtttataaaatgcctttaaaatataggagatcaattaaaataaatacaggaagtcaacaaaggttttagaaaagtgatgcttctctctaggactctgtccttgccaggagccagtgctcaaggagaatcggagctttattttgtgacacaacaattttctttaactcctccttagaattcccaaccaaattggtaactgggagcaatacactcaatactcaaaaataactcatgaacatgtagtttccttttcatttttactgctgttaccttagttcaggacagtataattttctgcttttatcagtgcattaatctgtggcttttctgcctccatttatgcaagtcagagttgtaaacacaactattttactcgcttgcttaagagtctccctatttattataggataaaggccaggcttcctagcatgttagacaaaacttcctatgatctgacttctgcatacttattcagtcttatcttatgcccatccttaaaatttgtcctaattttcctccttagttaggaaaaaaactgaagatgcttaatatatctttcaaagctatgcaccataaagttggtgttttctgtttcagacttattatgttatttcccaccttatactctaaattaaaataatgaagaatgacttgtggttcctctaaatgccttgctcttcattgcctctcagtttttgcatgagtttctcctatggtgaatacattaggaatgttttggctacatttctcagaaaagtggctgatggtggcttaaacatcagcataaggtatcttattctcttacataacaggtttggtgataggtggttcaaactttggcttagaaactcagtgtagttttcaatcaaggagattagattgacatttctgcaattttctagccttactctgaaggtcacaaaatgactctggcagtttcaggaattaagtcaacaggccagcatcctagtctgaaaagaatgatcataaacataggctttctcttcatgattctgtgtcagtttgcacggggggcaaaaaaagtccttaggtagaatatgttggccttggaagagaggctgagaaagggaaatagattaggatccatcagaatttatcccttggggctggatatattgctatgccacacaaaatcaaggtcatattagctttgaaattgtggagaatggctcctgtgtaggcaactaacagagtctgctatactcagcatagaataccattccttcttgttgactttcttgtaatttttatttcttgagacagggtctcactctattgcccaggctggggtacaatagcacaatcatagctcactaaagccttgaactcctgggctcaagtgatccttccacctcaacctgagtagctgggcctacaggcacacaccgccatattcaactaattttttagttttgtagagatagggtctcactatgttaaccaggcttggctttcattttttaatacgaagactcatttgttttgtagcccatttcctctgagagcctttctttgatcctgcctttattccctgctaatctgggttggcagtctagcctacatacattctcatatcatagaatttatgatgctccaatcatctgttgtgtttttttttttcctcctgtgtcttcatctggcagtgagttccttaatgacaagagattgttccttttctctctgtgactcccagtgcttgccgtaggatagataatttaaggatgcttatttgatgactgacaatgagggaggaagctgagccaagcctcctttatgacatttttctccacaatgagaaaacttttggaaaaaacaaagcaaatctagaatcctctgttcaactctatcctactgatctcactttctttctcagtctcttcctacaaggtgccctttcctctgaagggaggaaagtgtaccaatcatctataccctgacccacattattcacaatagtcatgtgccatttcttactttccctgcgacatttgcatttctttagggcattttaaactcagaacctaacacaatactgaatccgtaatatatagtcggtaaagcttgacatatttttggagtatttcttttgaatacatattatatattccagaactctatagctagggatgtgggtaggattaatacttgctttgttctcattagccagtgaagttctttggttgtttgagattgtggagttttcctaaatgaaggctagaataatttctcatttctattatttttttcaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccaggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgataaccaactgaatatatgaggactgcatgtaattcaaccacatggttgtttgctgtacagtcctttgcaaatattaaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgatatggtttggatatttgttgtgcccaaatttcatgctgaaatgtaatccctagtgttggaggtgaggcctggtgggagttgtttgggtcatgggggtggaccctcatggcttggtactgtcctcatgagagtatgatagtgagtgagttctcaagagatatgactgtttaaaagtgtgtggcacctcctccccatcctcacactctttcttgcctcctctctcgccatgtgagatgcctcctcgctgttcacctgctgccatgattgtaaacttcctgaggcctccccagaagccaagtagatgcaagcattatgcttctgtaaagcctgcaggaccatgatccaattaaatctcttttctttataaattacccagtctcaggtatttctttatagcaacacaagaacaacctaacatgaatgattcaccattttcccaagtttcttgttttggccaagattctggcaataatccatatttgaaatcaaagtatctggtatcaattcatacttgaagtcacttgaagtgccaggcatcaaaccatacttattataaaatcatgtgaagt

SEQ ID NO: 11985 - DNA, 25260 bp, Human
agctaattctgtatgtttagtagagatggggttttgccacgttggacaggctgatctcaaactcctgacctcaaatgatccacccaccttggcctcccaaagtgctgggattacaggcgtgagccaccatgctccgcctaggctagcatttatcaaatagcattttaaatatgctttgggaagctggacccagtgactcacgtctgcaatcccagcactgtgggaggccgaggaaggaggatcaattgagtccaggtgttcaagaccaacctgggcaacataggaagaccctgtctctaccaaaaaaaaaaaaaaaaaaatgtcagcgaggcatggtggccctcgcctgtggtctcagctacacaggaggctgaggcagaaggatcacttgagcaaggccctgtaccaaaaaataagtaaaagtaaaaaataaatatttttttttcgtctgaatgttctactaaactggaagctcagccagtcacagtggctcatgcctgtaatcccagcactttgtgaggatcccttgagaccaggagttcaagaccagcctggacaacatagtgagatcccctctccacatgaataaataaactgggccgggtgcggtggctcacgcctgtaatcccagtactttgggaggccgaggcaggtggatcacgaggtcaggagttcaagaccagcctgaccaacatggtgaaaccccatctccactaaaaataaaaaaattagctgggtgtgatggcggacgactataatcccagctactcggaaggctgagacagaaaattgcttgaacccgggaggcggagattgtagtgagccgagatcacaccactgtactccagcctgggcaaaagagcgagactccgtctcaaaaaaaaaaaggccaggcgtggtggctcacgcctgtaatcccagcactttgagaggccaaggcgggcagatcacgaggtcaggagttccagaccagcctgaccaacatgataaaaccccgtctctactaaaattacaaaaattagctgggcgtggtggcacccgcctgtaatcccagctactcaggaggctgaggcagaagaaccgcttgaacccgggaggcggaggttgcagtgagcggagatcacaccactgcactccagcctgagtcacagagcgagactccgtctcaataaataaacaaactggaagctctttgaaaccaaaaccacgtatgtcttcagctttaggtacagagtcttgcacaaaatagacatctttttatttatttactttagagacggggtctcgtttagacatggggtctccatatgttgcccaggctggagtgcagtggctattcacaggtgcgatcatatcatagctgacggcagcctcaaattcctggggtcaagtgatcctcccgcttcagcctcccaaatacttgggactactagatactcgagaaaaggcaagaatgtggtctgaatgctgggaaagcagttcatctggtaaagagaggaggggattccaggtgaggaacaggtgtgtgcaaagaccggaagccatccttaagaaaggcgtggttggagcacagcgtaggagccagagggcaaaggtgctgggcaggagaggcgggaggacagagatggcgcaggagtgcggttccacagggtcaggttcctaacacgctggccagagcagggagccgacctccaaactctcagggaagagaaccaggttgcccaccggcggcacctcgcacctcgccctgaccacaagcacgtgcgcccaacccgcctcgcaccccggcccgggtagggggctcaggggactcccggggcactcaggagggacgccccgggcggggcgcgcaggcgcgctgaggccgtgagccccaaggggcgggcgggtgcgcgcgctttctcgcgcacgcgcgcacggagggggcgacggccgctgtgacgctgcggcggcggcgggcgggcggcggcgcgtgaggcgcgcgatccccggtgtcttgggagcagtgccccggcccccgccgctcccgccgccgccatgtcgggccggtcggtccgggcggagacccgcagccgggccaaggacgacatcaagaaggtgatggcggccatcgagaaagtgcggaaatggtgaggggccggagcttagggggctggcgggggtcgcggatccaggccctgaggagcgtgggactggcgggtcaggtgggagccgaccggccggcgctgggggaggggggtgcgggagaaggcgggaggagggcgccgctggcgtcggcgtgaggtcagagggcgcgccggccgcggccaatcagcggtcctcccggctcgcgggcccgcccacctgctgcggctgctgccgcgcgccgcctgggaggggattccggcttccggcccggactggagctgcctggcctcggtgcccgcgcccggcccagcccggggcccgccctcccctcttcctgggcagtggccccgcctgcgtttccaggcttcctcttgataatagcgagtagccctggagtggtgtcagcccgccaggctgagcgctctgcgtattcaggcgttgaagttgggtgagtttctgggttagtccatctgtcaagggagcaagcctggtgtcatccagagggatacccctccctttcccccagtaaccggcccctgcgccgcgagcttggtaggcattttctcttgctgccccggcggctgtcaggagagtcctttgcaaactatgtaccagcctccctctaatttccctgcttctgctcttgttcattccccagtccgttcatcatttgcactgtgtgattttatttttctcacttccaagtagcagagtggtctttttaaagtgcacatccttacttgggaggctgtggtgggaggattgctgggacccaggagttggaggctgcagtgagctatgatcgtgccacggcactccagcctgggctacggagagagaccccgtgtctaaaatgttcatggaagatgccgattgagcccctgtttagtatccggaactccgatacatactatatcggtgtgtatcggagtcatcacattaaactttcacagccaacttcgtcagctcttttgtatagccaattactactaataatttaaaaacccaggtctggctaggtgaggtggctcaggcatgtaatcccagcactttgggaggctgaggtgggcggatcgcttgaggccaggagtttgagaccagcctgggcaacatagtgagaccccgtctctacagaaaataaaagttcaagtagatgttacctcccgccaggaagctttccttaactcctcccatccctttacctcctttaaggtcgttggtacgttggactttatttgtgtgtttatctgtccatttccccacaagagggaagttccttctcttttttatgtctgagggcttcatatatagttgggtttcagtataaatattagtttaacatactcatggttttcctcgtccacctttaatcctccgaggttttggtgaaacctaagaacaggtacacctttctcttctccccatttttgacccccccgcccctagcaggctaggctgaagggccatcccctgtcacctggaactctgtaccagcctccctgtaaactctctgcttctgctcttgctcattccccagtctgttcatttgcactgagtgattttatttttctctcttccgagtagcggagtgacctttttaaagtgcacagccttatttggaaggctgtggtgggaggatcgctggagcccaggagttgaggctgcagtgaactatgatcatgccatggcactccagcctgggcaacacagtgagaccccatctgtaaaaaaatatataaaatgtgcatcttatcctagcacccctagtaatgcttcagtggttcccttcttgcttttaggataaatactgaagaaggccctccttcctgcctcacttggctggctctttcccaggatgcccgctgtcttaccaatgaagtcactctgctcttcctgccgcctggcattcttcttcctctctcctctcctccctcttgccgagttaactcctagctcagctcaaaagttgcttccttaggtttaccacttgagattcccaatctagatcaagtctccttcatagacctttccacagttgtattagatggactcataagacatttcctatatttgatttctttttttttgagacagagtcttgctctgtcacccacgttggagtgcaatggtgcgatcttggctcacggcaacctctgcttcccgggttcaagcaattctgcctcagcctcccgagtagctgattataagtgtacaccaccacacccagctaattttttgtatttttgtggagaccgggtttcaccatgttggccaagctggtcttgaactcctgaattccaagtggtcctcccaccatgacctcccaaagtgctggaattacagatgtgagccactgtgcctggcctcctgtatttgactaattaacctacaaaaatggcaatttgatatggttgaacctgatgattaagtgactaatcttgaattgagctattcatgtctgtttccagatataagacagggtctgtgagggcagggactgtggatcttgttccctgcatcaccagggcctagcacagcctgttgtatactaattggttgaataaatgagaaaatggagtggtctgttcaggaattaattttagttattttctaagactttaattcgctccttctgttacatcacagtctctttacactcccagtatgtcatctgttttttttttttttttttgagacccagtcttgcctgtcacccaggctggagtgcagtggcgtggtcttggctcactgcagtgtccgcctctggggttcaagcagttcttccgcctcagcctcctgagtagtcgggactacaggtgtgcgccaccatgcccggctaatttttgtatttttagtgaggacaggatttcaccatattgcccaggctggtctcgaactcctgggctcaagtgatccacccacctcagccttctaaagtgctggggttgcaggtgtgagccaccgtgcccggccctattatgtcatcatttgctgaacagcatcaacaactacaacagcagttgctttttttttgctttttcgtgacttcatatttggacttgactctttgagaagttggctcagatctgtgacaaagcagttccctgcatttgacccttgttcctactgacagcaagtacctcttaaggtattggtggaccttaaaataagcaaatttgttctctgcctgcacgcttagggaataaccttcttggaatgaaggagaggctgggcacggtggctcacacctgtaatcccagcacttcgagaggctgaggcaagaggatcgcttgagcccaggagttcaagatcaacctgggcaacatggtgaaaccctatccttactaaaaatacaaaaaattaactgggcgtggtggcctgtagtcccagctacttgggaggctgagatgggagattcacctgagcctgggattttgaggccgcaaggagtggtgatcacgccactgcactccagcctgggtgacggagaccctatctcaaaaaaaaaaaaaaaaaaagtctcctttgttctatctcctccacacatttgtttgcagacctcgaaggcactctgtgggtaagctcagaacagtggcattctaatctggtgtagatagttgggggtccttagtcatttagagagtgaccttgtgcaaggcttatccctttgcttatttcgtgagcgtagtggactgataaactctgccatttttacccctttggaacacagcaagagacaggatttctacaaagctttgaacttcaaagttgaaatttaaaaatttctttagactagttttctttctttttttttttgagacggaatctcgctctgtcacccaggctggagtgcattggcgcaatctcggctcactgcaacctctgcctctcaggttcaagcaattctcctgcctcagcctcctgagtagctgggactacaggtgcgtgccaccacacccagctaattttttgtatttttagtagagacagggtttcaccgtattagctaggatggtctcgatctcttgacctcgtgatccgcccactttggcctcccaaagtgctgggattacaggtgtgagccagcgcgcctggcctagttttctttttctttatgcagtcttagtaacccagaaagggaaaggttcctaacatttcacacccaccaggccataccccccagcagcaggtgtctctcctgagattgtttgccccttggaagggtctttaaatggacacaggaggccaggtgtggtggctcatgcctgtaatcccagcattttgggaggccaaggtgggcagactgcttgagaccaagagttcaagaccagcgcgggcaacaaagagagaccccccacccccaccccaccaccccaaccatctctacaaaaaataaaaatttggctgggcgtggtggtgtgcgcctctagtcccagctactcaggaggctgaggtggaaggattgcttgagcccaggaggtcaaggctgcagtgagttatgattgtgccacttcactccagcctgggaggcagaacgagaccctgtctcactaaaacaaacaaagaaaaggaatgtagtaatagaactcatatatttggtaaagagaaaagcactcaaagtaactcgcatgcaagtaaaaaagaatatggtgctgtgtgtgctaccttccagccttatgtcccacatccttttttttttctttctttcttttgagacagggtctctgttgcccaggctggagtgtggtggcgtgatctcagtttactgcaacctctgccacctgggctcaagggatcctcccaccttagcctccggagtagctgggattacaggcacacgccaccacgcccagctactttttgttttttttttgtagcgacagagtttcaccatgttggccgggatggtctcgaactcctgacctcaagcgatctgcccacctcagtctcccaaagtgttgggtttacaggcgtgagccgctgcgcctggcctgtattttttttttagagatgaggtctcgctaaattgcccaggctgttctcaacctcctaggcttgagtgatcctcctgcctcagcctctcaaagtgctgggatttcaggtgtgagctaccataccccaccaagaggaagttcagaaggattccagattgaaggaatgatctgctgagtagtagaaaaacacaagtgatgaacagaaaacacattgcattgttttatccgttctaagaagtgtctttcttttagggagaagaagtgggtgactgtgggtgacacgtccctgaggatatttaagtgggttcctgtgacagacagcaaggaggtaagtgtggaagaaaatcaaaagataccattttctttatttctttatttgattgcctctttttttttttttttgggacggagtctcgctgtgtcacccaggctggagtgcagtggcatgatcttggctcactgcaacctccacctcctgggttcaagcagttctctgcctcagcctcccaagtagctggggttacaggcatctgccaccacacccagctgatttttgtatttttagtagagacggggtttcaccatgttggtcaggctggtcttgaactcctgacctcgtgacccacctgcctcagcctcccaaagtgctgggattacaggcgtgagccactgcacccggcctaattgccttttaattaaaggaatttatttgcccagaattgagtggaaaatacttcaaggtaccctgttattggtccatgcaaggcctctctttattattttcctactttattcctttcccttaacccaagcctcttttccagggcttgacaaactacagccctggcgtattccttaggtttgtcagtatagttctattagaacataactggctgggcgtggtggctcacgcctgtaatcccagcactttgggaggccaaggtgggcggatcacttgaggtcgggagttcgagaccagcctggccaacatagtgcaacccctgtctctactaaaaatacaaaaaaagtagctaggcctgctggcaggcacctgtaatcccagctactcaggaggctgaggcaaggagaatcgcttgaacctgtaaggcagaggttgcagtgagccaagatcccgccactgcactccagcctgggcaacagtgtgacacaccatctcgaaaataagcaaacaaacaaaaaaaaccaaacacataagtatgcccactgatttccttattgtctgtggtgcttttgaattacagtggcagattgagtggttgccataaggccaaatggcccgtaaaacctaaaatatttatcatctgaccctttaagaaaaagtttgctgatacttgctcttatgcgattagtcccccactgtattgtgtgtatcatatgtatatacatctttctaattctggtgtagacctttgtgcttcatctttgttggatgtatttggatacctgtatattctttaaaaatacatagcattgtttcatatgtgtatttttgtgtttaaacaaaacttaaatatgtgggccgggcgtggtggctcacgcctgtaatcccagcactttgggaggccgagacgggcggatcacgaggtcaggagatcgagaccatcctggctaacatggtgaaaccccgtctctactaaaagtacaaaaaattagccgggcatggtggtgggcgcctgtagtcccagctactcgggaggctgaggcaggagaatggtgtgaacccaggaggcggagcttgcagtgagccgagatcgcaccactgcactccagcctgggcgacagagtgagactccatctcaaaaaaaccaaacaaacaaacaaaaaaaaaacaaaaaaaaaatatgtacagtattttgccagaacctctttgtattctctgtggttcaactttggttttttaatttggggttttttgcttttttgtttttttgagacggactctcgctctgtcgccaggctggagtgcaatggtgcaatttcagctcactacaacctctgcctcccaggttcaagcaattctcctgcctcagcctcctgagcagctgggattacaggcgcctgccaccacgcctggctaatttttctattttaagtagagacgggtttcaccatgttggccaggttggtcccaaactcctgacctcaagtaatccgcctgccttggcctcccaaagtgctgggatgacaggcatgaaccaccgtgcctggcccaaccttgttttgagaaccctccatgtatctgtaaatataaatagaattattacctttgactcatgcattgcattttcttatttgcagtgagtacctttatctacatattttctgggtgataaatacccagattgtttccaactttattttttctaattgttttttaaattttcaaatataaaacacatacagagaagtatataaaacataaatgtacagtgtatgaataaatataaagctaacactcttgtgagaaccactctgcaaaacacagctttgccaagaccccagcagacctctctgcagctcttcccatcctcttcctcctgtccctctaaaggtaatgactctcctacttttgcttttcttaccacttgtctagtcattcataaacagtttttcctttattattatttttgagattttttttccagagacaaaatctcactatgtcaccgaagctggagtgcagtgtcatgatctcagctcactggagccttgacctcccaggctcaagcaatcctcccacctcagcctcctgagaagctgggaccacaggcatatgccatcatgcccagctaattttttttctttcttttttttgtttgttttggagagatgggagtttgctatgtcaacctaggctgataggtctcaaattcctgggatcaaatgatcttcccacctcggcctcccaaagtggtgggattttaggcatgagccatcgtacccacgctttttccttttttagagatggtggggggtctcattgttgcccaggctggatttgaacttttgggctcaagggatcttatctcagcctcccaaatagctgggattacaggcatgtgccactgcaccagcctctaacattttgagtgttatggaaacagcatgataaagtatctattttcgtgtgtcttgtttcttttgctcagcattatgtttgtaaaatgcatccatgttgtccttggagttacccattcctttccattgctctctctgctgtattttgctgcatattcatcacatggctaagtgtagtttatttttctggttctcctgtagatattgaggttgtccacagttagggccaataggaacaatgcccctgtgagcattcttgttcagaatccacatcaacatgtacatgagttttcctaggatatattcttggaagggaagtggctgggtcttagggtatgtatgttttgacctatattagctgatgctaaactatttgctgaaatggtagttgtaccaatttatattcccaccagaaacaggagttttgttttttggagttttttttgtttgtttgtttgtttttttgagacggaatttcgcttctcttgactaggctggagtgcagtggcgcaatctcggctcactgcagcctctgcctcctggtttcaagcgattctcctgcctcagcctcccaagtagctgggattacaggcatgcgccaccacatctggctaattttgtatttttagtagagactagggttctccatgttggtcaggctggtcttcaactcccgatctcaggtgatccgcccgcctcggcttgccaaagtgttgggattacaggcgtgagccactgtgcccggcctgctcctttttttattattattattattttgtaagacacggtttcaatctgtcgcccaggctggaatgcagtgatgtaatctcggtttacttctacttttgtctcctgggctccagtgatcctcccacctcagcctcctgagtagctgggactacagtcacatgccaccacatccagctaatttttgttgttgttgtttccttattttgttttgttttttcgagacagagtctcactctgttgctcagtctggagtacagtggtgcgatctaagctcactgcaacctctgcctcccgggttcaagcaattctcctgcctcagcctccagagtagttgggattacaggcacacaccaccaggcccggctaatttctgtatttttagtagagacagggttttaccatgttggccaggatggtcttgatctcctgagctcgtgttctgcccacctccgccttccgaagtgctgggattacaggcgtgagccactgcgcccaggctcgcctaaaatttcatgcacctacatttttttttttgagacagggtgtcactctgaggctggagtgcagtgacgtaatcttggctcactgcagcctccgcctcctgggtgcaagcagttctggtgcctagcctcccagtagctgaaactacaggtgcatgctgccacacccagcctaatttttgtattttttggtagagacggggtttcatgatgttggccaggctggtgttgaactcctgacctcaagtgatttgcccatctaggcctcccaaagtgctggggtaacaggtgtgaaccactgtgctcagcctcatgcaccgacttcttactgttttctcctacatttgtttttctttttgctagaatacatccttcaagagttttgtcaaagagagcttctgtggggaaaactttctgaaaatatctttgtttcactttcatgttgaaaattgatgattttacctgtatatgaaattctaggttcaaaattattttctttcagcactttgaagctattactgaattgtacatccagtgtcgctgttaagaaatgtgatgttattcccatgcttgagtctttgtaggtgatctacttggcttcctggaaactttagcatttcttctatatttgatctcctaggaattccctcaaaatatcctgtaatatttcttttcctttttttttgagactgtctcactccatagctcatgctggagtacagtggtgcaatgatggttcactgtagcctcaaattcctgagctcaagaaatagttatgtctccacctcccaagtaacggggactacaggcacgtgccaccacgcctggcaaacttttaaattatttgtagagacagggtcttgctgtatttcccaggctggtctcaaactcctgggctcaagcgatccttctgtcttggcctcccaaagtgctgggatcacaggtgtgagccactgcacccacgcagctgcttgcttgcttgcttttttttttgagatggagttttgctcttgttgcccaggctggagtgcaatggcacaatctcagctcaccgcaacctccacctaccaggttcaagtgattcttctgcctcagcctcgcgagtagcgcttgcctcaccatgcccagctacttttgtatttttagtagagatggggtttctccgtgttgtcaggctggtcttgaactcctgaccttaggtgatccgcccgccttggcctcccaaagtgctgggattacaggcgtgagccaccacgcctggccaactgctttatttcttaacttttctctcattcatttcatttcttgtctttcctggtgcattctgagtttctcaacgcagtttttgctcattaatcttttatttagctgtatgtatttcaattaacctcattcacttaatttttatttgagcaattgtatttttcataacaaattgcctcaattggttcttcctcaaaacgactttttttttttttgagacagagtctcgctgtgtcacccaggctggagtgcagtggcatgatctcatctcactgcagcctccactttgcaggttcaaatgattctactgcctcagcctcctgagtagctgggattacaggcatgtgccaccatgcccagctaatttttttctatttttagtagagacaggtttcaccatattggctaggctggtctcgaactcctgacctcaagtgatctgcctaccttggcctcccaaaaagtgctgtgattacaggctgtgagtcactgcccctggctaaaacaacttttcaatattatccttatctttctgagcaaatccatgtttaatttcagttattctgctccttctggtacagactgttctgtttatcagggtgcctgtgttcctccaatctctggtgagttttatgcgtgcactcaccttttattcccttgggactctcaattgcattggctggtaatgtgtaactacgaggaggacggaagcctgatccgtagtttttctttcttttttttttttttttttgagatggagtctcgctctgtcacccaggctcgagtgcagtggcacgatcttggctcactgcaagctctgcctcctgggttcacgccattctcctgcctcagcctcccaagtagctgggactacaggcacccgccaccacgctcagctaatttttttgtatttttagtggaggcgggtgaaaaccgtgttagccaggatggtctcaatctcctgacctcgtgatcggcccacctcggcctcccacagtgctgggattacaggcgtgagccaccgcgcccggccagttttcctttctgtaaatgaatttaggaggttgaggttagcctcagggttcagcctctcccttttgctctctgctgtcctctctggctccagggaacctcctagcaccaactgtatggactctgcctttatctgagagcagccatcccaagaagttctaggatgccaaactcatggagttgatggggcgtggttctggagcaactgtttattcccccatccagcctggctctggccattacccacaggggtcaaaggtcaagcagttaaatctcttgggcattgtgtatagacaggagtagatgctgctagaaaaccccctttccttggccgagtgcgatggctcacgcctgtaatcccagcactttgggaggctgaggcgggcggattgagaccatcctggagccaggagatcgagaccatcctggctaacatggtgaaaccccatctctactaaaaaatacaaaaaattagctgggcatggtagtgggcgcctgtagtcccagctactcgggaggctgaggcaagagaatggcgtgaacctgggaggtggagcttgcagtgagccgagattgtgccatggcactccagcctgggtgacagagcaagactctgtctcaaaaaacaaacaaaaaattgagttattaacaaaaattacgttactaatataatgcatctaccggaaatgtataaaaagtgtgaactggtaaatttgaggctactcagatttaaacttttggcttttgggatgctctcattttcatatgcttggatttactctgggcttttttttttttgagttagggtctaactgtgttgcccaggttggagtgcacagtcatagctcactgcagcctcaaactttcaggctcaagcgatcctcccacctcagccttctcagtagctgggaccaccagcctatgccaccatacatggctcattttttatttttttgtagagatggggtcttactatgttgcccaggctggtctcaaactcctgggctcaagggatcctcccacctccgcctcctcaagtgctgggattacaggcatgagccactgtgcctggcccttgggctttcttgttgcaagctggtgcttacctgcccactgtggttgccctgcacttataacctacatctttcttgaaacaaatgttataggtaaaaataaacatggggtgatcattttgttttttgggtttttttgtttgtttctttttgagatggagtttcgctctttcgcccaggctgttatgaagtggcagaatcttggctcactgcaacttccaccccccaggttcaagcgattctcctgtctcagcctccagagtagctgggattacaggcacatgccaccatgccaggctcatttttgtatttttatttatttatttatttatttattttattttttgttttattttatgtttttttagatggagtctcgcactgtagcccaggctggagtgcagtagtgccatcttggttcactgcaacctccacctcaagcaattctcctgcctcagcctcccaagtagctgggattacaggcacatgccaccacactcggctgatttttgtatttttagtagagatagggtttcacaatgttggccaggctgatcttgaactcctgacctcaggtgatccatgcgtcttggcctcccaaagtgctgggattacaggcgtgaaccagtgcgcccggctggggtggtcgttttgaatggatgaggatgacggatcaggaatagagccagcctgggcccatttgtcctgtcactgtctgtgttacatgaggttccttcttctctcactttttccccactctgctactgaaacaggaatctttctcaaatgagtgttttgtatttcttgcccattcgtatagagaagggttgcctggcgcaatttgatcagggcaggagagggatactatgggatgttctagtcgaagtgtatgtatctgcctgttgcttatgattcacagtattcctgctggaagggttcatttttctgaggcttgaggagaagttgcttgtccaggattctgttcttccttgggtccttggattctcacgctgctgtcgtttttcctgttcagtcctaatccagacctctgtggtctgtcacatagcaccctcctccctctctgtgagtctcctgcttggctctgtcatattcctctttttttccttttctagaaagaaaagtcaaaatcgaacagttcagcagcccgagaacctaatggctttccttctgatgcctcagccaattcctctctccttcttgaattccagggtgagttgcatctctgtgtcttccttgcaggagaatgaaaacttggatgaatgcattaataagaagaattggccaggtgcagtgactcacacctgtaacctcagcactttgggagtctgaggcgggcagatcacctgaggtcaggagttcaagacgagcctggccaatatggtgaaacccagtctctactaaaaatacaaaaagttagctgagcgtggtggcgcgtgcctgtaatcccagctactcgggggtctgagacaggagaatcgcttaaacccaggaggtggaggttgcggtgagccgagattgcgccactgcactccagcctgggctgcagagtgagactccgtctcaaaaaaaaaaaaaaagaattctgtgtatcaattcagtgcctgctgtttcgctggtattttgcgaggcacttgacctaaatcttttcatttaaacttcacgataactctgcaagataggtaatggtattctcattttccagttaaggaaactgaggctcagagaggttaagttacgtgtctaaagttacataacttgtaagtgacagactccatgtcaggtcctggttgtccgaatcagaagcttttttttagattgtacttcattttttattttttattttttgtagagacagagtctggctatgttgtccaggctggttgtgaactcctggcctcaagcagtcccccagccttgacctcccaaggtacaagcatgagccactgcacctggcctagactgtatgttttatcatagtcgcttagagtaggctacccaaagccgaagcttctgcttacccactgttaggacatgttctgcctcctaaaccaatcccgccggatcatcaccgtagtcatgatactgccttttacacctacctgctaggtactgtctacgaagcacttttactttactttctcatttttacccatgtatcagcctgtgatataaaccaggcagttattatcatccctatttaaggaaactgatgctcagggaggaacagtgttttgtctaagctcaaaagtgacagttttattcatttggtgacaaaatgctacttccattttagtgtgggtattaaaggtctttataggagtcaagactagcatgagtttatgactttctcttcaaaaccagattggagctaacccagcgtgtagttattccttccccacctctttcccaggccccaccaaggtcaaccatgtgctgttggaaagggaacaccaacgtgtgttcagtagtcagaaggctctgggagacatatgaggctccatttcctcagtctggccaccatctcctccttttcatttagtaaacacttaatgaactcccactgtatgcaggtaccgtgcgttgcactggggagtcaaggacaagtgagccacagagcctgtccacagaggctcatgggaggaagcacgtgtgcgaaatgataaatgcaggcgtgcacaggctatcacaggagagtaagagagggtgggcatttccacctatgcgagccagggaggtagggctccgcggaagaagtgatgtcggggctgtgttgggaggtctgaggctttccaggacaagagaaggcagcctagccaaggaacagctgggcagaagcacccatgcatgacgaagctcttgggttagggtccagtctgcctggagctgaggatgcttgtaggagaacagtaggcactgaggccagagatcagaaaggacttcctatgttgcgataaggccagctcctgcctctcctaagaagtactgggtatggctgggcgtggtggctcatgcctgtaatcccagcactttgggaggctgaggcaggtggattacctgaggtcaggagttcgagaccagcctgaccaacatggtgaaaccccgtctctaataaaaatacaaaattacccaggcgtggtggcgcaagcctgtaatcccagctactcaagaggctgaggcaggagaatcagttgaacccaggaggcagaggttgtggtgagctgagatagcaccattgcactccagcctgggcaacaagagcgaaactcggtctcaaaaaaaaaaaaaaaaaaagtactgggtatgacatttctcccttaggcagcagtggagcgtcgaagggtttagaaaggtctctctggcagtggtttgcagttcagtttaaggtacgtgagactggaggcagggcagtgaggtatgtggctgttgcaggaggccaggctggagatgatgaggcttgaactgaagcagtaggagaggaaggaatgagcacaaatgataccagagcaggagggggaaacactttggtgactggctactgtaggtgcagcggaggaatgcattggtgactcttactttttttctttttttttaattttaatttttattttttgagacggagtctcgccatgtcacccaggctacagtgcaatggcacgatctcagctcactgcaacctccacctcccgggttcaagcgattttcctgcctcagcctcccaagtaactgggattacaggcgcgtgctatcatgcccggctaatttttgtattttcagtagagacggggtttcaccatgttggccaggctggtctcaaacttctgacctcaagtgatccgcccaccttggcctcccaaagtgctgggattacaggcgtgagccactgcactcggcctggtaactcttttttttttttttttttttttttttgagacagagtctcgctctgttgctcaggctggagtgcaatggcgcgatctcggctcactgcaagctctgccttctaggttcatgccattcttctgcctcagcctcctgagtagctggaactacaggtgcccaccaccacagccggctaattttttgtaattttagtagagacggggtttcaccgtgttagccaggatggtctcgatgtcctgaccttgtgatctgcccacctcggcctcccaaagtgctgggattacaggcgtgagccaccgtgcctggcctcggcctggtaactcttaagttttgcaccttgatggtgactttaagccttcaggcagaactcccaggtgctaatccgtcagtccggcagccgaagcctgagctcaccaccttcagacaccaccagcctccttcagatgcccaaggatgcctgacaaatgtcattttctacacatcttatgatgtgagaaggattgagaagtactgaccagagacacagctacatccctcccttccacaagctgcaatcagtggataataaagaagagtttaataagcatatcctgaccttcctaaagtgtaatgttgcataaacataaagattctggctgcctctggtgcttagaatctatgtcgtgtaggccgggcacaatgattattatactcagttgtatccttggctgcctaaagtgatgccaggcccttggctctgtccagagttcctcttgaggaaaatgaccacgctcagctgctgcctttgttctgtttggttttcagacgaaaacagcaaccagagttccgtgtctgacgtctatcagcttaaggtggacagcagcaccaactcaagccccagcccccagcagagtgagtccctgagcccagcacacacctccgacttccgcacggatgactcccagcccccaacgctgggccaggagatcctggagggtgagtcgtggttggccgaggatgagtttcctagaagggccttgctttctgctcttgttgtgtctcgtctttagagtaacaggctcgagagagcacctcagagccaggcagcaccaagccctttctcgatagcttaggaatgattatagtttcccctttcacagagggaagggagaaaacaagcattagagttgcgtgccaggctgtgtggaaggaacttgagtatttgacgcctgctataattctctcaaaaatcctgtgaggtggcagctattgtcttcttttacagatgaggaaaatggacattcaaagcttagaaaggttaaattgggctgggcatggtggctcacacctgtaatcccagcactttgggaggtcgaggtgagcgggtcacttgaggccaggagttcaagaccagcctgaccaacatggcaaaaccgtctctactaaaaacataaaaaatttagttgggcgtggtggcatgtgcctgtaatcccagctactccggaggctgaggcagaagaatcacttgaacccaagaagcagaggttacagtgagctgagatcacaccagtgtattcttgcctgggcaacagagtgagactccatctcaaaaaaaaaagacctggcgcggtggctcacacctgtaatcccagcactttgggaggccgaagtgggtggatcacctgaggtcaagagttagagaccagcctgaccaacatggtgaaaccccatctctactaaaaatacaaaaattagccaggcatggtggcgcaagcctgtaatcccagctactcgggaggctgaggcaggagaatcacttaaacccaggaggcagaggttgcagtgagccaagatcgcaccagggcactccagcctggcgacagagctagacttcatctcaaaaaaaaacagagaaaggttaaatcgcttgtctgagatcacatagccagtctagtaactgttggaatgaatgtcactttaagtccttctattttcagcatttatgctgtctgcattacatgctaaatttttttcttttctttttttttttttttttttttttaaagagatagggtcttgctctgttgcccaggctagaatgcagtggctgaatcctagctcactgcagtcttgaactcctggggtcaagtgatcctcttgcctcagactccgtagtagtaggactgtaagcctttgccaccatgcctggctttcttttaattttctgtagaaatggagtctcactatgttgcccaggctggtcttgaactcctgggcttcaagtgatcctcccacctcagcctccagagtagctgggattataggtgtgagccaccatgcccgacccaggtttcttgttataatatggatatatagatgtgtcttaggcccttgttaccttctcctgtgctgtgacctgttaacagccaactacaaaatggaacttgtttctccatgggaaatgccaattgtagttaatatttattgtgttcttactatttggcatgtgctgttcttagctcctgtgttttattacttcatctcgtcctcatagcaactctcagaaaactgggagattgagttagagttgtgatgtttgggctagaggatgacaagatgagctgctttgtcggttccagatatctccagcccagcagagatggccctctgcagtctagccgtattttgcccttccaccattcttggctgtgacctggtccagctgggccctgaatgaatgtttgcttctcaggccagtattctcccctcctcaccaagccacctccacacagctctaaggaagctcccccaggtccaggcctcaggggagccctgccctcaggccgaccctactgccttttcagagccctccctgccctcctcggaagttgctgatgaacctcctaccctcaccaaggaagaaccagttccactagagacacaggtaagcaatcactttgagttttccagttttttgtttttttggtttaaggcagggtctcgctgttgcccagactagagtgcagtggtgcgatcctggctcactacaacctccactgcctcctgggttcaagcaattctcctgtttcagcctcctgagtagctgggattacaggcgcccactaccacacctggctaatttttgtatttttagtagagatggggtttcactatgttggccaggctagtctcgaactcctgagcccaagtgatccacccatctcagcctcccaatgtgctgggattataggtgtgagccactgtgcccggccaggcttcccagtttctaagtcaaaaaaccaggaaagactgtggatgtggggttggatctgcagcgccggaaatgagtcccagggttgtaggcaggggaggatgtttgatcatctgctggaaggagcagagtggacatcccattataattcgggtgggtgggaaggttctggttgggaggggtggccctggcattccatgctctgcctgctcctaggtcgttgaggaagaggaagactcaggtgccccgcccctgaagcgcttctgtgtggaccaacccacagtgccgcagacggcgtcagaaagctagcaccatcccggccctccgcctcctggccctgcctctatttattgcattctggttctggccgcgccgcgttgctggggtaagggcaagcactggggtcaagagcctgcacacatgagccttccgggctggaaggctggcgtaggacttggggctgtagcatcatcttcctgaccctggcacctgtgtctacttgctcccgagaagaggagcgctcatgtcttttttgcaccccaagttggctggagcatcggccaccccaagattcatctgtgacctccaggcagcagtctctgctccagaatctctggacggagctgctggcagcttctgcgagaagagagagatgtggaaggcaccttctagaagagagcgtgcctcaggttacttgaacttgaacggagactgtagactcccggactttcccctaggactgggggccctgtaggctgctgttggaggactgggtagagacattggagggaagggaagggcttttctccacacaagggcagagagtccgtctagatttcttgctgtcctgccagctctgcccatgcctgaggtggtcctacctctcacgggcaccctagctgctgacagccctttgtggccgccgtccccatcccctgccctcagcacacacatctgcacacacgcagctttgttctcacctctacctgtcattccagcatccctgcctcttgtcacaaactgccccagcaagaatttgaggttctgacaacagtacccatcccccacagtaccccttcagctcagtttctagaaagctcccttttctttgaaatctgcatgttgaattgaactttgtgattttattttttgtttcaaaaaagtttaagaaaatggaaatgggcaacagtgagtgaagacatattttagcactgaatagaatatttttaaaattaaactatttgaaatatgtcctgttggtatctgagtgcttccttcttgaaggttgcgggccggggtgggggtggtggctgagtgcttgtggggtcactgtgggctgggcctgcccatcctttcactcccacagtgtggacttcatgacagtgatttctagcctccctttgaagctgtcacgtagttcaaattatgcttctcgctgggcgtggtggctcatacttcttatcccagcactttgggaggccgaggcaggaggatcacttgaggctaggagtttgagaccagcctgggcaacacagcaagaccctatctctatctaaacaatatttttaaattaaaacataaaaaccaggccaggcgcagtggctcccgcctgtaatcttagcactttgggaggctgaggtgggtggatcatctgagctcaggagttcaagaccagcctgaccagcaaaatgagaccccatctctactaaaaatacaaaaattagccaggcatggtggcaggcgcctttagtcccagctacttgggaggctgagacgagcattgctcgaacctgggaggtggaggttgcagtgagccaagactgcgccactgcgctccagcctgggtgacggagcgagactccatctcaaaaaacaaaaccaaattccatccctgtgtacaccaaatgcagcccatggatgtgttttccacaggtccatgtagttcggagggattcatgagttctttttttccccccttgtggtaaaatacacgtaacataaaaggtttttgtttgtttgttttttgagacagagtctcactctgtcacccagcaggctggagtacagtggtgtgttctcaactcactgcaacctctgcctcccaagtagctgggattacagacgtgcaccaccacgtctgactaatttttgtaattttagtagaggtggggtttcaccatgttggccaggctggtttcgaaccccttaggctcccaaagtgctgggattacatgtgtgagccactgcacctggccaagagttacttttgtcaccattgtgaagtgtgcatttcagtggtactgagtactgagtacattcacagtgctgggcagtcctcacagtccagctccgaacttttttattatcccaaatggaaacctcatgtccagttagcatcattcaccatttcttcccctcccctcgggccctggcagccacagatctgtttatttcccggagtgattcccctcatttctcacaggggctccaggtgtcatggatgagactataatacaagttctactgttctatgttttgtttttgttttttttgagacggagtctcgctctgtcacccaggctggcagtggcgggatctcggctcaccgcaagctccgccacccgggttcacaccattctcctgcctcagcctcccgagtagctgggactacaggcgcctgccaccacgcccagctaattttttgtatttttagtagagacggggtttcactgtgttagccaggatggtctcgatctcctgacctcatgatctgcccgcctcggcctcccaaagtgctgtgattacaggcatgagccaccgcacccggcccctgttttatcttttcttacaaaatataaatagggctggggctgggcacggtggctcacgcctgtaatcccagctactcgggaggctgaggcaagagaatggtgtgaacccaggaggcggagcttgcggtgagctgagatcacgccactgcactccagcctgggcgacagagcaagactccatctcaaaatatatatatatatataaatatttttatatatatagggctgggcacagtggcctgtaatcccagcactttggaaggctaaggcaggaagattgcctgagcctgggagttaagacgagcctgggcaacatggcaagaccctgtctcattaacaaatacaaaaatgtaggccgggcgtggtggctcacacctgtaatcccagcactttgggaggctgaggcgggcggatcacgag

SEQ ID NO: 11986 - DNA, 17896 bp, Human
ttttttctgaaacggctttactgagagtggctgtgcttaccacacgatttgcgcattgagcacgtacaaggcaagggcttttatatggtctattcacagaactgtgcaaccatcactcagtcgattgtagaacattttcatcacctcaaaaagaaaacccatacctttaggtaccacccctctagcacccactgcccacaaatccgctttctgtccccacagatgagcctagtgtggacatttcaaatgaatggaaccagaggctctgcggccttttgcgactggctgctgtcactgagcggaatgtttccaaatgcttctctctccacccagactgctagtcaggcttcactgcctgtcccgctctctaccgacatatttctccacgaatgagttggcagtgggggagggaaagagggtgggacagagatgagaccaggctgccaagagtcggacgctgaggctgggcaaaaggtaaaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggttgaagaccctcagccctcgacgttgtcctctctccattggatgccgcctctctctagccacccctctctccctctctgccccttcgagctttttctctcaatatgcaattttctcttttggtcttccgcactcttggcccccagttctattgcagatctgtttctcactccatctaaactcttacccctgtgtctcaggagctgctcttgctgagggaagaaggggacactacgggacaggggggcagtgtcgtactaaggacctgggctctagccactggaggaactggactcatttgggccctcaggaagcggctgagtcttggtggggtaacccggttagcccccgtaagtgaccagcacagggctgagcccagaggaagtggccacccacagagtggttctcatgtccgaggggacctgcagggattgagcaagaagactgactcgctggatccttcgtctctgaatcagttcagggcaggcaagctggggagccccctgccccgtcctgccaccaccagccggatcgggccctctttttaagggaagaaagtctggagtggaagggagggcacagggcgccaggagcctacatgaagtccttccagaaatccacaacagctacctctctgatcctggagaaaccacctccttgcttaggcccaagcaggttcctggcaggctcaggaccaaattccaggggccactcatgggcctagcagcccaaggccgcctccccctcgtctttcttccatctctctttcctctgcctggcgagatgccagccagcacctcagtgtccccatctgggcagtggaaagtttgactctctgggtccttgtttgagtgagtgcgagtgtgtccgttcctttgctgtctgccccaggcgggggagggggggggaggtggtgggggcgagggggcgggggctcagctagtccagccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctgggttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccactcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaggggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatgggtgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggatccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcactgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaggcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcgtgtgtgtacatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcccctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggacaccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcggaggcgtgggggcctgcagacttgctgatgaggagacatttcatcgcctgattaagccaagtcctgtccgggatggggaggggggtagtggaagcagtgaagggagtggagtggaaggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaagggggcacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggctgggagcggcaaggcagtggtggcactgctggggctcaggaccgggcctgggtgctgcctcctgccctgcactctgctcacaagcatggactgacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagtgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatccgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgacagcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctttctgtgtgtgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcggtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtgcgctgctcctgtggcggcctggcctctccgtgcccctcctggcccttgggctccttgccctcagaagaggggccccgtcaccctcagaagaggggccccgtcaccctcaggtctgggctagcccggactagggaggtttcccctcccttctagacacttccatggccccagctgtcctgagacgcggctccagaatccaaccaggcctgaatggcacctgccctctcagcgtggagcgtttgccaagagcacgccgactgcagggcgccaggctagagcctggaaatctaagcggggcccggcctgcccagctccatggagtctagggttcacaacgaggcaccgccaaaacccagggggtgacacaggagggaaggggcccaatggagccagggcagggtgctgtgtgcacccacttgcactggcctggccttggctcccctgccagccccctggcaggtgacactgtgtgtaggcagagccgagcctgggctgcaaggcattcccacacacgcagcatccagagagaggatccaggtcagggccgggaaagcctgcatgctggggacacaggtcgtcctggaaaggacagcttggagggggacagtccccagagcaacgctaccgcctgtgactttccttcggccctgcacgaagagcctcagagcaggtggcgggacctggggcttccctgggcagcccaggctcccaacggaaatagagtgggcagggcccgcgtgaatggcagcctggcactgcgtgttggctcctcacacataactgcgtctttatggctggactggcactggcgcactggcatccccaggtttctcctttctgggataggaggtgccacacagtgtggtggcccagtgatagaaagtcaccatcagcatcacagcactattctgggccatgtgctctacggcccggcaatgtctgctgagctgggcaggcatggtgcaagggaactgggcaggggccgggagtcaaggcttcgggcaagtcccctcgctggctgggaggaggggcagccagcgccacggcctggcagagatggaaagatggggcttccgcccattcatctgtgagcgggtcttggggcattggctctgtgttcagtgggtccaacacagcccccgtgaatctgtccactcttcctgcctcgctcccatccttcctgtgcctcctttcctctctgtctgcctctcatttcatgcaccttcatcacacctgtcctctgcgtgtcccagctcagggatgcagtgtgggtggaggacaagctagtgggatgagtgtgatatgggtggtcagtgcagaggaaggcatcctgcaggctgcgtgcttagccc

SEQ ID NO: 11987 - DNA, 23218 bp, Human
atccacccgcctcggcctcccaaagtgctgggattacaggcgtgagccaccgcgcctggccttatttttttttaagatggagtctcactctgtcgccacactgaagtgcaatggtgcaatcttggctcattgcaacctctgcctcccgggttccagtgattctcctgcctcagcctccaagtagctgggactacaggcgcccacgaccacacctggctaattttttgtatttttagtagagacggggtttcaccatgttggccaggatggtctcaatctcttgacctcatgatccacccgcctcggcctcccaaagtgctgggattacaggcatgagccactgtgcccggcctatctagctgtaattttatatcctttaacacatctttccctgtccctcccttcctctacccttcccagcctctggtatgctctgttctactttttccttccatgagatcaactgtttttaggttccacatattagtaagaacatgtgatgtttaactttctgttcctagcccacttccattcatgttgccacatgtgacaggatttcattctcaagcccccaaaggcacctcactgggcctttgtttttttgttttgttttgtttttgcttttgtttttcaaacctctgggacagatggctccttctaaggcagcccatccccctggtggacagttctctccaatcttgacagaagtcctctggacaactcacgtcctctccctgggctcatcctgcaccgcatggagctgggcagcctggggacccgcagtgaacaggacctggggtgacttgaccttgaagcctggaggtcagagcccacatctgcccaggggtcagggccagctcacatcatgtagaccctggtcagcatccctggggcagcccttgacaaggctgcaggccttgtcttgccctccagggggagacattgcacacagacaacactcaggaaacattcccctggtcatgaacctggctttgctaaggaggtgaaggtagagcccactttccatcccttgctccaaaacacccttccaggccctcccatgtacctgctctgtcccttcctgggtcctctgaggaccctgttctgtgaggggtccctgtgcagctccccattccctcctggcaccacctgtggggaaggtgcggtgaccacaggacaatcagcctcgcagaggacagagaccacccaggatggtcagggagaacatggacaggccttgagcctcagctcaagggagggagggtccccctgaagtcttccccaaggacagtagagcccagagccacccacctccctctatcacagtcctctcttcccaggacacacaggacacctccccctccatatccgggagctgcagctccacctgagacccctggacttgggtctctgtccctgggttagaggccaggctggtgacactagagacagagggctggtccctccccagtcatcccccagtgagcccctttccatcccccagagccacctctgtcaccttcctgctgggtgtcttcctaccttcccagcacactgaagagcatggggagacctggcagctcactgtgttgcaaagaaaataattaccacatttggatatgccagggttctctgtgtgctgctgacagacccatagccaggacacaatagaggtcagtgctggagaggggggatcctcctcccctgatggggacagaggtctcatcagccttgattctcaaagtgtggtctgggaaaccaaaatgtagacagaaaggaaagagaaagtaaggacaaaggtaggaatgagaggagaggaaacagagcttcctggacaaaccccgccccagcacacatgatcagacaaagctctgggccccagggaggaggctcagcacagagagtggaaaacagcagaggtgacagagcagccgtgctcgaagcgttcctggagcccaagctctcctccacaggtgaagacagggccagcaggagacaccatggggcacctctcagccccacttcacagagtgcgtgtaccctggcaggggcttctgctcacaggtgaggggaggacaccctgggaaggggcggaaagagggcgcacagagaatggctagggtcctctggggaggatggagctctaagaggggacagagggcttctcttggagccaaataggagagaggacatgaaagggatagagatcataaaaggaaagtctcagtgatctgaaactgttagtgaataaacaatctcccattttttaccttttccaactgaatcatcaatgagcaataaatttcaaaaactgctgacaataatcacaatttaagtcagcgtgacaattaaggaaaacattttaaaaggggcattaaacagagccctgagccaccaacctcagatattggcaaataaaccccaggacatgaagagccctgggaatgctcactaactcatccacaggagtctgcagcctatcccaggcactggggtgcaaccaacatcacacaaatccctgccctcacggagctcacgctctcatgggtggggaagacagacaagcaaagagatctagaatgtgaggtcaggtgttgacaagagccctggagggaacagagcagaaaaaggtcagaaagggaatacccagggtctctaggggaggtgtcagggaaaggatctcccaagagcaccctgatgtgatcaagatctgagggcagtggggagggagccatgcggatccctggggaagggcattccagagaaatgacaaggtcagaggcactaagggaatgggagtcacactgctgaccttgacccagtaggacacacacacacacacacacacacacacacacacacacacacactccaaggtggaggggtgaagacacctgctcaggacccaaggccccatttttctaccctaatgcataggtcccaatattgactgatgctctctcctctctcctagcctcacttctaaccttctggaacccgcccaccactgcccagctcactactgaatccatgccattcaatgttgcagaggggaaggaggttcttctccttgtccacaatctgccccagcaactttttggctacagctggtacaaaggggaaagagtggatggcaaccgtcaaattgtaggatatgcaataggaactcaacaagctaccccagggcccgcaaacagcggtcgagagacaatataccccaatgcatccctgctgatccagaacgtcacccagaatgacacaggattctacaccctacaagtcataaagtcagatcttgtgaatgaagaagcaactggacagttccatgtataccgtgagtatttccccatgacctctgggtgttggggggttagttctacttcccacacatgggattgtcaggcctgggctgtgcctgtgtcctcctctgcattataccccatgttaaggtttgagcatctagtgcaggacacactatgggacagacatcaaaataccgaatgtcttactctggagtcctgatcctgcagacatttgcttcagaggaaggacaatctgatgtgggtaacttatcgaggggagaccagtctcaatctagccccccgggaccctcctggtgaacatgtccctaagaaagacccagtaggactcagtcagggtctggcctgaagggccttctgggatcctcacagacaagctcagccctgggaatcccctgctccaaaacactatcccaaggttctcaactcctggtgaccctgaggagcctgggccagggctagattgtggcctcctgggcagggctgactaggaacaagaatttgagctatccgagggctgtggctcctggagctggtaaccagccagggttcaggcactagagcctcatttgggcaaggatggagcctcatccttcaccttagtctcagcctggagaggacagatggacaagctccccaggccatcagccaactgccctgggggcttaggagatgccataggaagtttaccatccccaggaggaggaacagaggagacaggatgctcctgaaagctccttgtccaccagggatcaggctgagaggcactctcagggaatccaacaacaatagatgctgcggccgggagcggtggctcacgcctgtaatcccagtactttgggaggccgaggtggatggactatgaggtcaggagttcaagaccagcctgaccaacatggtgaaatgccgtctctactaaaaatacaaaaaaattagccgggcatggtggtgcgtgcctgtaatcccagctactcaggaggctgaggcaggagaattgcttgaacctgggaggcagaggttgcagtgagccaagatcacaccactgcaccctagcctgggtgacagagcgagactccatctcaaaaaaataaaataaaataagattgtttatttgggcagctcccctatgcagagctgaggtcaaataattataaatattttaaggttaattcacagaccacaagataagccaaaaccattaaccatttatactatttcactgaggggaaactgagccacatggcaataaatacagtcactatatcaaggtcacacagaccgtaactggaagatcagttacaggagatttgtcttcagccacagtcttaacctctcctctactccaggggccttatttggcatctgtggaccccaataccagagttggttcagttcctttcttcttaggcatctgcagcccagaggggagatcctggtctggggagtgagatcaaatggagaattaaccaagttttattctggaacttattcaacaattagagtcagtgtcagaaatgttcaggcctgggtcaggtgtggtggctcacacctgtaatcccagcactttgggatgccaaggtgggcggatcacttgaggtcaggagttcaagaccagcctggccaacatggtgaaaccccatctctactaaaaatacaaaaaaaattagtcgggcatggtggtgcgtgcctctaatcccagctacttgggatgctgaggtggtagaatcgcttgaacccaggaggcagaggttgcagtgagccaagatcatgtcactgtgctccagcctgggagacagagtgagactctatctcaaaaaaaaaaaaaaaaaatgttcaggcctatcccctcagacccacacctctgctccctggacttgaaatcctgtgtttcctgatgtgttggtgtcactcccacaggaggataaaggaaaggactttgctttctctcctcactcacaccctgcaccagccagggcccaatatgaaacacacactcagtagttctctcacgaatgaatgaatgattgaatgatccataacctctttagagactggatctggttgcagaatcctgggaggttcttgccatacctgctccccatccctccagagactgagacccatgttccatcccctgaccatctacccctaaagccaccccaagtaccatatttcatgtgactctggggctgctcggctgtgggaaggttttcagggctccctggtcttggttctgggacaccagaggctcctggttgctggggtctctaaggtcacttagcccccactgctcactgtcatgggcatctctgactctctctgctcctccatgtcctcattttcctctccttttatcccagctgaactgcacagtttcctccacccttaggcctttcccagacactccgtctaacaaggttgactgtcctgttcccttcccgctcacactgtggccaggcccacctcccaggcaataggaaaggcacagaaatgagcccagagcagccacccctgccaggtccatcataagccactgtccccacgtccctcagtgaggctgacatgtggaacaggccaggggacagggacgagcgactcctccatacactctctatactgactcaccaggggatcagaggcagaaggacaggtctgcagtccccaaagcccatgggctcatttcacccatttgactcctaactccatccctgttctgctgtgggctcacatcctctagtggttcctgggaccttccccaggtagagctagccaggcaggtgctgtctgatgggtttgctgcccattccacctacacctgtgtcctcatgatgacaccattgtcataaggtgggatctctcagacagggagatgcattagccactggtgtctcacttagactctgcccaatttggatgaatttggtcaaactctagttgtgtttcctgaggttgagagaaaaggaagaaagcatttcacatgactgttttgggttcctctttttacctgaatttccacaggaatttgtaacatagaactctttctaaatttactaacataacatacatcacttctcctcatatggcatcgtttctctcttaatgcaattgagaactctcagatatcctttctgacaagttctgtcttcctaacaggacccatgagtcccttctacccagggagtcactgatttcaaactgacttcagcatctttctttgatcataacatgatcctactggacttcagagcttggtttaagagtttatcacgctctctagagaatattcctcttattaattggtgttagatccagagtattaataacaattttcacaaatggaataatttaacttctcaaatttatatcccagatctaccaaacacacacggtccatgagggtcaggctttcagcaagttcatgctccttccgttccactagctggttattctgcatttgcaaaaaacccacatatttcagaaaagatccacagtgtcatcatctgctcttttcagggggaaaagggacattaaagaccaaagacaaggaacgtagatatgctgttaaatccaggcagcccctgcctgtcaccctcactcttttctagatcattccttggactctgctctatctttagggggtcactggctcaagtcagtcatcatcaaacacctgggaaaaactgccccaccttgtggttctgctgcctgacgactgagctaccttcaggcttgcccctggtgtcccctgttatttctgctgaaacatacagtcccaggccaggctgctcagtatcctcagggtttaaggacaataggaagtcccatcatcacccatctctaggatgtcctcagacagggaagctgcagagaaaacacacctagtggggcaaagtaggactgtgaagctggaagggacccagcacctgtatgttccaggtgaggacccacaggtgggtcaggcaggcatcagccagtcagggaaggaccagaagtgcctggggctgtgactcccagtcctcggtctgtccacgacccaacactgctgctcagttcacacttgagaaagtctgtgcttctctcacacagagcaggcggcctcacggtctctgagccctcagatcattgcacatctgtcttgtgaaacacacacttgccatgggcttttagggacttgggttggctgagaggtggggagatgccaactctgattgaaaaatgcccggacggaatcccagcactttgggaggccgaggcgggcagatcacgaggtcaggaggtcgagaccatcctggctaacagtgaccatcctggctaaaatacaaaaaactagccgggcatggtggcatgcacctgtagtcccagctactcaggaggctgaggcaggagaatcgcttgaacccgggaggaagaggttgcagtgagccaagatcgtgccactgcaccccagcctcagcaacaaagcgagactctgtctcaaaaaaaaaaagaaagaaagaaaaatgcccagccaggcacggtggctcaggcctgtaatcccagcactttgagaggccgaatcgggcggattgccagagctcaggagtttgagaccagcctgggcaacacggtgaaaccccgtcaggcatggtggcatgtgcctgtaatcccagctactcaggaagctgaggcaggagaattgcttgaatccaggaggtggaggttgcagtgagccgagatcgtgccattgcactccagcctgggtgacagagcgaggctccatctccaaaaaaaataaataaataagaaaagaaaaatgcctgtggaggaatcaaaggtgccacacagggcaatcttctctctgttttctgcatagcggagctgcccaagccctccatctccagcaacaactccaaccctgtggaggacaaggatgctgtggccttcacctgtgaacctgagactcaggacacaacctacctgtggtggataaacaatcagagcctcccggtcagtcccaggctgcagctgtccaatggcaacaggaccctcactctactcagtgtcacaaggaatgacacaggaccctatgagtgtgaaatacagaacccagtgagtgcgaaccgcagtgacccagtcaccttgaatgtcacctgtgagtatcttctgttcctctgtggcccaggctgccagcccaaatccacgcagccagaggccaggcctctcagtccctctcaggtctaaggacgcagacccttaaccctggacacccaggctggccatgacttcctttccccaggcaaacctgggcagccccagcctgaaccaagaataggaggggagaggctgctcctgtcctgggaggctcagggtccacagcctgtgatgggagaaacaggtgaatgtctcagacccagactcagtggacacaatggaggtttggttaggacttcagggttgtgacttagtagagaggaacactgtggcccttctccagaccagcagcttccccttccctctgatgacatcacctgtggctttattctctttgctccagatggcccggacacccccaccatttccccttcagacacctattaccgtccaggggcaaacctcagcctctcctgctatgcagcctctaacccacctgcacagtactcctggcttatcaatggaacattccagcaaagcacacaagagctctttatccctaacatcactgtgaataatagtggatcctatacctgccacgccaataactcagtcactggctgcaacaggaccacagtcaagacgatcatagtcactggtaagtaattcctggagcatcaacactaagatctggggtacaagctttctggttttcaaataggagcagagaagaaattttcttttgcagcctgtatccaacaggcacaaacaagtccaaattctcccctgaaccctctcaattcatctgtgcagactctcttccctttgtttttctgatttctcacagctgaccttaggtccagcctggaatgtggggagggggttctctcagccccagaaagccccgtgtagcaggaggggcttcacagagggggaagcagaaagggtcctcaaggtcaatttgcttctgtcactaacatgtccctttctgtaacttcttggccttcttttacctattccatgagatataaggaatatgtgaggttttaaaacagactcacaatagttttccctaaatgagagaaggaaatgcccttcatcagggatgagcagctcagactctgctccctgctctactcccggcttgcccggtgattggctctgccctgaccccatgtggggtaggacgcaggtgtgtgcagaaggtgtccaggtggcctgtcatgaatccagctaaatcaagatggcagtcaatggctgggcgctgtggttcatgcctgtgatcccagtactttggaaggccgaggtgagaggatcacctgaggtcaggagttcgagaccagcctgaccaacatggcaaaactccatctctactaaaaatacaaaaaaaaaaatttagccaggcatggttgcacatgccactaggcatgccactagggaggctgaggcacaagaatcacttgaacctgggaggcagaggttgcaatgagccgagatggcaccactgcactccagcctggacaacacagagagactctgtctcaaaaactaaataaataaataaataaaggcagtcaacacctgagcctcccctgggtcaggctgcctccctgagcttgtcctggctctgaagtcaccagctgtatgaggctgtgggcacagcacatgggatagcacagagcacagcgagtgacccacacttggagaaatcgggagattcagccacaggggctctgcattggagagaatgggcaatgccaaacagcgtgtatttgtagagaaggtaagaatatcagccttttgttaacactgtgcctactctaggaatctccttcaccgtgatattctatccacagaccaggaagtaaaactcctctttacagtgggaaatccttcggattggaactccagatagtaaggtcatgaagactggatggggcatcatcattccctaaaaaattatttaatgaaaaaaaacactaccttcccttttgtatgtaaagtgacagtcacaggaaggatgcctgatcacagctccaggaaagggtcagtgggaggccaggcacagtggctcacgcctgtaatcccagcactttgggaggctgaggcgggtggatcatgaggtcaggagatcaagaccatcctggctaacatggtgaaaccccgtctctactaaaaatacaaaaaattagctgggcatggtggcacatgcctttagtcccagctactcgggaggctgaggcaggagaatggcttgaacccgggaggcagagcttgcagtgagctgagatcatgccactgcattccggcctgggtgacagagcgagactccgtctgaaaaaaaaaaaaaaaaagtcagtgggaaaaacattctacctgatgatgaggttgctcggtctgtgcgctgagaagaagattccaagtggagatatagagatatccagagggtcactctgagacgatctggggtcaggagggaggtgcagccctctccttacaattcatcacctgaacaaagacactcgaccttctgcagagggtcagggctatcccctggttggtgacctttgcacagctcactgtgggacctgagagctggctaaaatctcagggaaaggagcatagccctaggccccaggccccaaccctattctcagtaggttatctcagatactctgcttgtccacagagctaagtccagtagtagcaaagccccaaatcaaagccagcaagaccacagtcacaggagataaggactctgtgaacctgacctgctccacaaatgacactggaatctccatccgttggttcttcaaaaaccagagtctcccgtcctcggagaggatgaagctgtcccagggcaacaccaccctcagcataaaccctgtcaagagggaggatgctgggacgtattggtgtgaggtcttcaacccaatcagtaagaaccaaagcgaccccatcatgctgaacgtaaactgtaagtgactcctcaccccttcctatatgtccctctaggattactctgtcaatggtgtgcaaaatggataaaactcacaggaggcagaatatcaatgaagagaccattatagcaaacagaattgcaaagtggttaagagctcagctcaggccgggcacagtggctcacgcctgtaatcccagcagtttgggaggccaaggcgggcggatcacgagggcaggagatcgagaccatcctggctaatatggtgaaaccccgtgtctactaaaaatacaaaaaaaaattagccgggcatggtggcgggcgcctgtagtcccagctactcgggaggctgaggcgggagaatggcgtgaacctgggaggcggagctttcagtgagccgagatggtgccactgcactccagtctaggcaacagagcaagactctgtctcaaaaaaaaaaaaaaaaaaagagctcaggctctgaatcaaatatacatatacttagttggttttttttggttggttgggtttttttgtttgttttgttgttttgagacagggtctcactctgtcacccaggctggagtgctgtggtgtgatcaaagctcactcccgcctcaatcccctgggttcaagcaatcctgccacctcagcctccagagtagctgggactacaggttgcagcaggatgcctggctaagtttttaagttttttttgtagagttggggtttcactgtgttgcccaggctggtctcaatctcctggtctcagcctcggcctcccaaagtgctgggattacaggaatgagccactctgcccaccccgtatttaactattctaagtacctctcatacagatggaagcatgcaatatttgtccttttgtgtctggcttacttcatttagcacaatgtcttcaagctccatctatgttgtagaatgtatcagaatttcattccttttggagactgaataatattatgctgtgtagatagatacatcacattttgcttatccactcatccatctatggacagttaggttgcttccaccttttggctattatgaataatgctattacaaacatgggtatacaaatatctgttcaaatccctgctttcagttcttttaaatagatactcagaagtggaattgctggatcaaatggtaatcctgtttaattttgaagaaccatcataccattttccacagtggctataccatttcacattcccaccagcaatgcactagagttccaatttctctacatcttcaaaaacatttgttgctttctggttttgttttgttttttataatggccatcctaatggttataaggtggtatatcattggagttttgatttgcacttccctaatgattagcaatatttagcatcttttcatgtgcttatttgccatttatcttctttggagaaatgtttattcaagtcctttgcccatgttttaattaggttgtttggggatttttggttgagttgcagtagttctttatatattttggatattaatcccttatcagatatatgattctcaaatattttctcccattctataagaagtcttttcacttttgtgataatgtgctttgatacacaaaagcttttaattttcattaagtccaatttctctacttcttctttcgttgcctatgcttttagtgtcatagccaagaaatcattgccaaattcaatgttccaaagttttcactctatcttccaagagctttatagttttagctcttacatttaggtcttttatgcattttgaattaatttttatatatggtgttacataaaggttcaatttcattcttttgcatggatatccagtttcttcaatgccatttgttgaaaagactatcctttccccactgaatgatcttggcacccttgtcaaaaaacatttggctatgtatgcaaacatttctttctgggctctatattttattccactggtttctatttctttttgccagtaccatactgttttgattactgtagcttttggattttgtttgtttgttttattgttgttgtttgggtttttttgttttgttttgtttttttgcttttctttgtagagatggcgtttcaccatgttgccaaggctggtctcaaactcctgagctcaagcaatccacccgcctccacctcccaaagtgctaagattacaggtgtgatgattaccatagctttgtaaaaaattttgaaaccaggaagtgtgagcccttcaactttgttctttttcaagattgctttggctatccatggtcccttcagagtctatataaattttagaatgaatttttctatttctgcaaaaaatattactggaattttgatagagattgcactgaatctgtagatcactttgggtagtactgtcatcttaacaatattaagtcttctaatccatgaaaatggggtgtcttttcaatttatgtcttatttaatttcttttggcaatgttttgtattttcagggtacaaatctttcacctctttggttaagtttatttctaagtatttttaaagctcttataaatagaatttttttcttaattttcctttgaattgttattagtatacaaaaatacaactgatttttgcatgtggattttgtatcctgccactttgctaaatttattattctaacagtttttttgtggaatctctagggttttctatatataagttagtgtattctgcaaacaggtataattttacttctttccaatctagatgctttttttttcttgcctaattgttctgtctaggtcttccaatactacattgaatagaaatggcaaaagcaggcatccttgtcttgttcttgatcttaaaggaaaagttttcaatctttcaccattgactatgatggtagctgggggttttcacatgtagcatttattatgttgagaatttccttctattcctagtttcagtgttttttagcatgaaagaatgttgaattttgtcaaatgcttttatcgactcattttcattactggttataggtctattcagattttctatttattcatgattctatcatggcaggttttgtgtttctaggaatttgttcatttcatccaggttatccaatttgttggcattcaattactcatagtactcttataatccttattatttctgcagaattagtagtaatgttttactttcatttctgactttagtaatttgaatcttctttctttcttagtcaatctaattaacagttgtcaattatagtgatcttttttgaagaacaacttttttttttcggtttgagacaggttctcactctgtcaccgaggctgatcatggctcaccacagcctcaacttcccgggttcaagcaatcctcctgcttcagcctcctgggtagctgaaactacagacaagcactaccacctccggctaatttttgtaattttttgtagagacagggtttcaccatcttgcccagctggtctcaaattcctgagctcaagtgatacacctgcctcagcctcccaaattgctgggattacagtcatacaccactgtacctggcctacagttataaatttctttcttgcacaagattcttaactactctgagcctcggattcctcaaccgaaaattgcactgtgaatgcctgctccatagtattgcacgggtttggggtttttgttttgtttttgagacagggtgtcactctgtcacccagactggagtgcagtggtgcaaacacagctcactgcagcctcaacctcctgggctcaagcaattccctcaccttagcctcctaagtagtacatactaccacatctggctaatttatttttatttttgttttcagagagacagaatctcaccatgttacccaggctggactcgaactcctgggctcaagcaatcctcccatctgtttcccaaagtgctgagattacaggtgtgagccaccacgcctggccccatagtgttattttaaagatttaatgtaataataaaccttcagcaaaacaccacacacagaggaaatgtttcataaatgttagctgctattactactactattatcattagccttgaaatcaggtagtcctagggtcaaatctcagatccacctctcactagccatctgactttaggtaagccttttaccactctaagcttccattttttcatgtttaaaatggaaataatgtctacctgacagcactattttatggatcaaataagatacatgtaaagcatttagcagcacagggcctggcacacaggaagtactccacaaaagtagctaacatagcattagtcaccagcctgagttgactggtgagggttaagccccaaatagttgcaacagatataaacaagaaataggctagacacagtggctcacacctgtaatcccaacatttgggaggccgaggctggaggatctcttgagcccaggaatccaagaccagcctaggcaatatagtggaaccctatctctacaaaaattatttttttttaattagccaggtgggtgggcgtggtggctcacgcctgtaatcccaacactttgggaggttgaggcaggcgggtcacctgaggtcgggagttcaagaccagcctgaccaggatggagaaaccccgtctctactaaaaatacaaaattagccaggcgtggtggcgcatgcctgtaatcccagcaattcaggaggctgaggtaggagaatcgcttgaacctgggaggcagaggttgcagtgagccgagatcacgccattgcactctagcctaggcaacaagagcaaaactcggtctcaaaaaaaaaaaaaagaaagaaaaaaattagccaggtgtggtggcatgtgcttatagtctcagctactgaggagactgaggtgggaggatcacttgatcccaagaggctacaatgagccatgattgtgccactgcactccagcctgggtgatagagtgagaacctgcctcaaaaaaaaaaaaaaaaaaaaagaagaagaagaaatagatgcaaaaggtattatttatatattatatatatatatatatatatatatatggagggagaagcattatacaagaaacccactgggacatggctatgatcaaatatgggaaagggggaaaaaaggaggtaaagcaaagtctcaagcctggtatgttagtttccatctactgagatacagtgaagatgggattaaacatacgagataatttattggggaaaatgcctgtgagggaaagtaaggcgagagtgagaggaacctcagaccatgatgcagatctgattcctgtggaagagaaagagaggaaggaagttttagattgaagtgcagtttttgtttgtttgttttttgagacagagtctcactctgttgcccaggcttgagtgcagtagtgtgatctcggctcactgaaacctctgccccccgggttcaagcgattctcctgcctcagcctctcaagtagctgggattataggcacctgccaccgcacccagctaaattttgtatttttagtagagatagggtttcaccatcttggccaggctggtcttgaactcctgacctcgtgatccaccctgcctcagcctcccaaagttctgggattacaggcgtcagccaccgcgcccggcctgcagtgcagttctaagagcatttctgcaaggctgacagggagtcctccagccattcacacttcagaataaaacagtcacacaaaactgggctagctttcatacccctgctgggagcctgtgggaagccagttctctatgcaaaagaggtggtgaattcagaatgcaccaactgccacaactgagacactgagaaaaagatgcaaccacgaaaaaggtggaaagttctaatcacatacaaaatagcaatcagcctttctcatatttcaaagccttaaaaatggctgagcgcagaaaagccagggtggaattggcagaagagagatcatcaacctagaaacatggtgactggggttgggcgcagtggctcacgcctataatccaagcactttgggaggccgaggcaggcggatcatgaggtcaggagttcaagaccagtctgaccaatatggtgaaaccccgtctctactaaaaaaatacagaaattagccaggtgtggtggcacgtgcctgtagtccagcctgaggcaggagaatcgcttgaacctgggaggcggaggttgcagtgagccaagatcatgctactgcactccagcctgagagacagagcaagactctgtctcaaaaaaaaaaaagaaaagaaaaaaagaaacatggtgattgaaaaaaaaaaattgcaaggatatagttagctaatcaccttccagcaaccttcccacaacgaaactgtattccttgaaggaacaattagaaactacttcattctgagagttgtttcccagcccccattgtaaaataatttcactttcatttcttctcctcttttctctccatgacagataatgctctaccacaagaaaatggcctctcacctggggccattgctggcattgtgattggagtagtggccctggttgctctgatagcagtagccctggcatgttttctgcatttcgggaagaccggcaggtatgatggcctttcctcttgttctgtttcctccaaggctgactgccatgcttgggagagggaaagaattctttgcctgtctctgggcctggatctcatactcctcccactaaactcctgcttctcggcactaattcccacaggtttcctcttccctggtcttcgtgctccctgtctcccattatctcttggacatgggtattccaatccccatctaatctagaggaagagactcaagtatgttcctctgtcccctagtcagggaaagcaaggtctaagaaggaaaacaaatgaaaaaatgaaagaagcagcaggagaaagcaagtcatgtgctctgttgaccacattggaagaggagggagaaatagcataggaagagaacctaagagaaagcaaaaacaaccaaagtcctcttgaacaataaatagagaaaaaaaaaaaagtatctaccccggaaaacaaaatgggaaaggttttaaggatagaagtaggcacagaagcagctgataaagaatgaaatgaaatgtgaacatccagcaaacaggaaaagagtaaacactagaagggattgtagttagactgaagaacgaggccctcagaagaaaggcagtatgaacatcaaggactctaaggaattacctgctcacagtgtccttcctaacttacggaacaaagatcctgtgcttgggaatagcagtcacagtttctgatatttatttagggcaagcgaccagcgtgatctcacagagcacaaaccctcagtctccaaccacagtaagtaaagccacttaccccagtgagaactggtatgttccaccacgtgccctcccctggcagggaatcctggattcccaaaccactccctcccttctgaattttcacagaaaggatctctatttcccaaccctaaggtggcataggtcttcccacccttcctagccacaggagtcccctgagacacatctgaggagagaggctcactctgcctaggccaggcaggcctgaggaagatcccatgtttccaggagccatttcctcagccttactccttccgcctcctgcctctattacggatgtgggcactctcccttggtgagactttccttatcttgtgggtgctgtgggtgctacaagtctcaatgcccctccttgccactggagcatgttgctgagaaacacatctgggcaaaaatcaaggccttgtgaactggtagaactcttcacaagtggattgtggcctcctgtggttctgcccctgccccctctctggtactaacatgctgggtctggaccatacactctgagggaagtaaattccttaactgatccttaaactccccaccctccaactgccacctccttcagctagaatcacctgaagtcagctttgcatttccatggatcgctaactcttcttttgcttctccagctcaggaccactccaatgacccacctaacaaggtaagcatagccggttttcatgggcttattttctcatggaaatgattctgtgtagaattgattattcatgaagacacaatgtaacatcaagtttgggttaatgttcctcagtgcaacaacaaagacgtatttgtaatcactcccatgagtctactttgcagcaagaacatgcattttggaattattcccatcctgtgtctgaatactggatgtgactcttagtagctctgtgacccttgtcaagtaacttaacctctttgatcatcagctttgtcatctgtaaaatgggcattctgcctacttcaaagagaagttgaagggattaaacgagataacctacaaagagcacccagcacaatggcctaaaaaaggaaggcactgaatcattctcactcccctaccttcagtctgatcctgctcttattgtcaaaaggataatttcaattttaatagatctgagatcctgttttttaataataattttatagaatttttcattttatggccaggcacagtggctcatgcctgtaatcccagcactttgggaggccaaggcaggtgaaacacaaggtcaggagatcgagaccattctggctaacatggtgaaaccccagctctactaaaaatacaaaaaaattagccagctgtggtggcgggcgcctgtagtcccagctacttgggaggctgaggcaggagaatggcgtgaacccaggaggtggagtttgcagtgagccaagattgcgccattgcgctccagcctgggcgacagagggaaactctgtctcaaaaaaaaaagaagttttcattttaccttttcaatagagcaaacatacatactgaaaagtgctaaatcataattatactttcacaatgtatgaactttcacaagttgaacacacccaggtaagcagcacccaaatcatgaaatactacatgacctccccttaaaaagagacccttccagccaggtgcagtggctcacacctgtaatcccagcactctgggaggccaaggcaggtggatcactagaagtcaggagttctaaaccagcctggccaacatagtgaaaccttgttctactaaaaatacaaaaaattagccgggcgtggtagtggatgcctgtaatcccagctacttgggaggctgagacaggagcatcgcttgaacccgggaggcagagcttgcagtgagccgagatcgtgccattgcactccagcctgggcgacagagcgagactccgtcgcaaaaaaaaaaaactctaccagtcacttccctccaaaggaggagtaaccactatcctgacttctaatgctccagattagtattgcttggttttgttcctatctaaaggagaaataaaacatatccttatatgtggcttcttcaacattgctttgtgagactcatccatattgtatgtatttgtggtttgctggttctcattgctgcattatcctatcccattgcatatataccataatttctctcttctaatgatcattcatcaggaggtcagcaagcagagaatgggtaacaacaaaagcccttctccagagctaaaatttcaaaatggtaacagcttgtggtgctgaatcacaccaggcaaggtgaggccctgccctgtgtcactgacttaactgatcattatttgtgcttttcagatgaatgaagttacttattctaccctgaactttgaagcccagcaacccacacaaccaacttcagcctccccatccctaacagccacagaaataatttattcagaagtaaaaaagcagtaatgaaacctgtcctgctcactgcagtgctgatgtatttcaagtctctcaccctcatcactaggagattcctttcccctgtaggggtagaggggtggggacagaaacaactttctcctactcttccttcctaataggcatctccaggctgcctggtcactgcccctctctcagtgtcaatagatgaaagtacattgggagtctgtaggaaacccaaccttcttgtcattgaaatttggcaaagctgactttgggaaagagggaccagaacttcccctcccttccccttttcccaacctggacttgttttaaacttgcctgttcagagcactcattccttcccacccccagtcctgtcctatcactctaattcggatttgccatagccttgaggttatgtccttttccattaagtacatgtgccaggaaacaagagagagagaaagtaaaggcagtaatgccttctcctatttctccaaagccttgtgtgaactcaccaaacacaagaaaatcaaatatataaccaatagtgaaatgccacacctttgtccactgtcagggttgtctacctgtaggatcagggtctaagcaccttggtgcttagctagaataccacctaatccttctggcaagcctgtcttcagagaacccactagaagcaactaggaaaatcacttgccaaaatccaaggcaattcctgatggaaaatgcaaaagcacatatatgttttaatatctttatgggctctgttcaaggcagtgctgagagggaggggttatagcttcaggagggaaccagcttctgataaacacaatctgctaggaacttgggaaaggaatcagagagctgcccttcagcgattatttaaattattgttaaagaatacacaatttggggtattgggatttttctccttttctctgagacattccaccattttaatttttgtaactgcttatttatgtgaaaagggttatttttacttagcttagctatgtcagccaatccgattgccttaggtgaaagaaaccaccgaaatccctcaggtcccttggtcaggagcctctcaagattttttttgtcagaggctccaaatagaaaataagaaaaggttttcttcattcatggctagagctagatttaactcagtttctaggcacctcagaccaatcatcaactaccattctattccatgtttgcacctgtgcattttctgtttgcccccattcactttgtcaggaaaccttggcctctgctaaggtgtatttggtccttgagaagtgggagcaccctacagggacactatcactcatgctggtggcattgtttacagctagaaagctgcactggtgctaatgccccttggggaaatggggctgtgaggaggaggattataacttaggcctagcctcttttaacagcctctgaaatttatcttttcttctatggggtctataaatgtatcttataataaaaaggaaggacaggaggaagacaggcaaatgtacttctcacccagtcttctacacagatggaatctctttggggctaagagaaaggttttattctatattgcttacctgatctcatgttaggcctaagaggctttctccaggaggattagcttggagttctctatactcaggtacctctttcagggttttctaaccctgacacggactgtgcatactttccctcatccatgctgtgctgtgttatttaatttttcctggctaagatcatgtctgaattatgtatgaaaattattctatgtttttataataaaaataatatatcagacatcgacatgctgcctcatggttgatactaccttggacaatgtttttctctacaggcagaataaacaaattgttcaatggggagtcagagtaaaactcttttttttttttttttgagacagagtctcactgtgtcgcccaggctggagtg

SEQ ID NO: 11988 - DNA, 74177 bp, Human
  misc_feature (1)...(74177): n = A,T,C or G
atgtcttatcacagatcacataagggccagcacacctccctgcaaactctcacatcccctcccactctaaccttgggtagacagaccatgtattttctttgtaggatgctgggtttcctgctctccactacattctctataccctcaagtccaagtatataaaagttgtccaaacgtcagctatttaggccctattgaaaaaatgttagaggcggttcaggcagcgtcacaacatcctggttcagtaaaagactcagcctagggatctgtctctgagagtctgtaggagtcttagtcacgaatcatgttcaaagccttctccttggcagcttcccccagtgacccctgatagaattattgcctccgcctctggtctagcactgtgccccgttgaggcctctgtggctacatctactacgctccactgcagtgatctgcttatcaggccccttctccaagctccttaggctgagactctcagaggaggatggagtgtagctgcgttggtatccccagcctccagcaggtgcttagcacagagcaggtgttcagaaaaacagtgctgcattaattgaattgaaataggaagactaagttacctcatctcaaatcagtcactttttaaatcagaagctcgcagagtttggaactcatgtttcatgtttggatccatgtagtaggtatcaggaagtgaatgtaagagtaaattaacaggagctgccatggactgagcaggcccagggttctggacattgttgtgagccctctgctaccacgtggagaagatcagctttgggacttaaagcaattagccacattcacatcagcttccaggtatttggagtttattatgtgctaaatactgtaatagatactttttatgcatgaatccatttattctcacaaaaccccttggggaagtgaaacagattatttccatagtgtcttaaaaccccagaactctgcgttgctgcgtctattgacatgaacacctgtcaaacctgcaactcatagctcagtattgtctcagtccaatccaaggaaatgaactccttgagaaagctgacattctggaccatggggtagaagctaccctgtctgcctcccacacccactctcaaggatccaagactatgaagggagaagagagagcccaccgagtgacttcctcttataagccaatatcaagacactagtggaaaggaaccagctgaccagtggctcactgtgtctggctggaccagcaagactctgacgtcatcacagaagccttcttggtcccattggtcctttgactgctgtgtacaggatgccacccaccactccagacaccactcaccactctagatgttgggatccttctcccgttacctccattattcttgttctctactcctctgagttttcatagccaagcaaatttccaccattgaagaggctctgagatccaagtcaactaactactggctagggtactgtaaaacacatgggaaattagcttttaccaaacaccaattctatgcccaccattcatacccattctaccatttaatgctgatagtatcctgtgagctagctattattagcatcatttaaagacaaagcaaaaccagtgaggctgaaagaacggctgccctggtgcacacagatggcacatggcagagcccaagccctctccatgagatctgcagcgtttgtccacacggcagggcaaattaccttgtagagtcagcatggaggtttgctaactctgccggacttggtgcagaaaaaataccagccgtgctgttaaaccaaaaccccaggagaaaactttctggtgacagaagggcattgtgacccacgttgcccagggccagggacagggcagctgctcatggtccttcctcacgagttttcctggagcagagggatacccccaaacccagggagcccacaggagcttcagaagggctcggctggagggcggggcccctgttgcacttgctcactggggactggggaggctctgatcgcagaccgggggtgctgccacctctgtctgctgccggcagaaagccacaagccatgaaaactgattgagatgagaagaattcatctgggactggcttttgctttaggatggtgttggaagttgctcgttgtcgctaggagcctgctccactgtaagggtgtcgggatctgaagagctatggtgaaacaccactgaagcattgccaaggtgaggccctgcgtcttccgggttctttatcgtcttcctttaaattgtgcaaatggtgctgtaaggcctgtagtggggcaagcaagcaaggacattgctgtgggtgccacagacggaggaagaggcatgaatggatcgctgcctcagctatgaatagattgctccatggtttgtgcatttccagttttgagaatttttaatttataaaaggtcatccatccagggtagattctgctttttggaaaaggcagtgaatgtgccacagaggagagaagggacgtgggatgtagagagggggttgagcgggcacacacaggccactgctgcgctcccggcgagtcactcggcctcttgataggaggtgatattgactgtgcagagctgacagaggttagtggtcacaggcggggagcatctggctcaaggcaaatgactgttgctttcgttttatttgtttgtttctgaatgaagttgttccatttttcaggcattcaggaatggggtaactgaatagatgtaatgatgatcttcttgtttaagagatctatttcaccaggaaacaccaactgtgaaaaggaaagcatagttgatcacatattttgaaaggatttgtgtaaattgtaaggttttgacaacgtttccatttatctggtaatgcgggtggatgaagttcaccctcatccacccacattaccaaggaactaaggaattgtgcgtttgcagtaacagagaagaaattgctgtgatatgtgcatatcctcctccctcgggagagtgggacttaattcccctcaccttgagtgaggtttggactaagagtatggaaagggagaaatagtagctctgtagaggagaaacctgcagatgccagcttcaccaagggaccaagcttagcatcaccgggaataagctgggctgctattgtgaactgccacgacagtgcggttcttcccgccaactcataaccccagtcaaatcatgagaaaacatcagacaaatccaaactggggaagattccacaacatatttcaccttcaaaaatgtcaaggtcatgaaaaacaaagaaagacaggcaaagcgtcacagatcagaggagacatgatggtcaggacacccaaacccagaattcgcatcctgtattggatcctaaagcaacaccgcaaaggtcattagtggaaaaataggtgaaattttaacaagacctggggtctcgctaatattgtggtaacaattactccttagttctggcaaatgtaccatggttacgtaaggtgttcacattagaagaacctggtgaaggaaatatggaaattctctgtgctatcccttgtaatttttctccaaatctaaaattactgcaaaataaagagttaaaaaaaattagactcattcttcctcagagcaggagtagccaaatcctgagcattcttgggaaaactggcgttcatggcctggtgatcacaccttctctttgaacattctggaatatagcaggccttttgaatttttgaccatccatcattctctctcccaacccctacctgattccagaatagctctgtatttgcctctcttcatagtatttctcatggatgattatattgttgttgttggtgtccaatgggttttgtgggggttgtttttcgtttatgttttttgtttttcagagatggggtcttgctctgttgcccaggctggagtgcagtggcaagagatcatcgctcactgcagcactgacctcctgggctcaagcgatcctcccaactcagcctcctgagtagctgggaccacaggtacgccactgtatctggctaattttttaatcttattttttgaagagatggggtctcgctttgttgcctgggctgatctccaacccctggcttcaagccatcctcccactttggcctcccacagtgctgggattgcaggcatgagtcactgtgactggcccagcatgcatttttgagcctttgctctgtggcaggggctgcaggatggaatacaccctcatctgcccagcgaagctcactgcactggtgcaggctcctggcaccccaagcacaggcccagctacccagacctgactcctctccaggaaggaagcagaaagccaggaatggagagaatgaggacccaggcccctgggggagtacagaattccagccaggaatctgccgtcctctgggctcaaccaccccacagaatctggtcagccaagtggctgtgagctgggctcgacagcccttcctcgagagtaaactgtggcctctaggatgtagagaggggactcaaagggccagatcccatttgagtgaggattctgaccttgtgagcccacctgcagcctggggtctgcagccttggggactggccaccggtggccagcatcctggcttgcagggttcacgtgtatagagaggtaacagcaagacagagaaacctggcccctcttgcaggcccagcagagcaggtgagccctactcaaaggtgatgctgcgcctgattagagaaaagcttccaaagcaggtgaggaggaagaaaaaatgatgaagccgcaggaagacagcacgtagatggaaatctcaacatactgagatggaaatcaatcacaaaactcttacaggaaaatcacagctaaaagttggtgattacatgtgggcctgcagtgcctttcctgtcacatctgctaccccactgccagcctgctgctaccccacagcagccctcccatttgtggaatgttccctggcgtgctcctgcttgcctgaatcccttccccaccttcccacctaggcaacttgcatttgctctgacgtccagggcaggtgcgaatgtctcctcccagtcacagtgcccaagcccatttgtgtgtccccagcaaccaccagcacacacccagggctctggtttgcaggcctgccaggttctctggaccaaagctcctgaggacaaggacatgccctacatgtgcctccaggtcccagcacccagcgcagtgcctggcccaccaggggtatctggtaaagtggttcttgagttaaagacacaagggcaaaaccttaaatgaaaatcaaggttaagacatgaggatgaaagcttgaaagaggaaaagcaaagataattgaatgatcatccctaatcgtggtgcaccccagtgccatcagcatgctggggttttgacaggacccttggaagaaagagaagaggcatctgaggcctctggcacattccacttcctgtaagacagtgtggtatagatgaaagcattggggcttcctgccagccaggtcagtctggctctgcacctgccagctgggagtgtgaagtgggagcagttgcacccactctcaagcacagacatgagaactgaacagaaccacggaatgggggtccagagcccaagacatagacgaggctcctccttgtccactgtggggcttgtgcaaccccttcatcaaagcgctggtgctttccacattgtaatcaaggaagttttctcacgttccttctcatcacaactagctgctggcctttttgcacactttggcacctaggatgctgaacctggaccagtgggaggcaaacaagacacacctgggatgcaaaatgtaaggaggctcccatgctcaggtcgttcaagtgcaggaaaagtttgtgtatgtgtgaaacgcacaatgccatgtggtgtctataagggcatttgaggttctgtgcttaatggatgaagtgggttctgagcattgagtctgtggattcctgatgagtttcctggtgctctgagctccgtgaacttgtaaacaagcttttgtgtaggtgggtacttacagtttttgtcagattcccaaaggggtctgtgaaccccaaaatatttggaatcatacagtcaaatatctaggaagaatactttaattttctctctcagcgtgttgtggatatgaggaagtggaaaggacttggacatagaagtcagacaaagcagccacatctgagtggtctcgtcctgcagtgtagtggttagacggctggccttgtcaaccagagggctccagtgcaaggttcagccctggcaatgtgagcaagtcactgtgtgccttcctgagatgataatagtttgaccccactgtatacgagcagccttacctgtctcgggtaggttaattatatcctctcagtcttatttcttcattcattgataatagcacatcacaggattaacagaattaaattacaaagccctaatttttaggtgagttgaagctgaggagcacacaacttttcttacagggtgcactcaattctcaatgtcagaaccaccagggggtccttgtacttcaaaaagacacatcttacatgacaacttctttgatttacttttatgcccaatattcattttgaaacctcacaaaggagagcatggtgttgttgtttctcaaaagagaaagtaaatttagtaagattgagagccatgaacctagacacagtcacagggcacataagatttcggtcaatcacagactacatatatgatggtggtctcataagatgaagacactgtattttgcctgtacctgttctatgtttagagacacaaatattcaccactgtgttactactgcctgcagtatttagtacagtcgcaggctgtgtaggtgtgtagcctagaagcaaccggctatgccacagagcctaggggtggagtaggctctaccatctaagttttgtatacgatgttcgcagaacaacaaaatcacctaatgacacatttttcagaacagatccctgtagtgaagcaatacgtaactatattttgggaacttcccctgtatccagatagtcagtccaagagctgtgtgtttggatctcacagtgcttgagatcctgagagaatctcatttcctgagtcagatgtgggcattctttcttggcatgggtacactgccgtggcttgtgctgaaggctgcataagaaacagaggttggaaactcacagtggaatttattgctgagatgacgttaagctgttcgcattccacccaggacctccacaggagaagcccagagaggatgactctcagactccagatccaggaaatccatgcctctctggagcaatggatgtcttacagacactgtgactcttcaaactgattattttcttctttgtgcttggactccaggacacttagaacccaatttgcatctaaccactagcagtttggtgacagcatgtcacagtttgtatttctgtgcaccagctttatacacatttttttttctgccctaacttaccctttggtctaatttctttatctgtttttctatcctgttgtattgtatgtatttttataagcggtctcaaatcttttctggaaacactaggaaatgaatatataaacaaatacaagcaggacagcatttctgaaagagcctgatatacagtgagggtgctcactaaggattagttccctatctgtgtacaaaacagaaaaattcactgagggagccaacctgcagtcaaatgtccagctgtgagtctattacagttatagaaatagcttatttttacacatattccaccttagattgatttggggggtgtttgtttttgttgttgttgtttgagacaaggtctcactctgttgcccaggctggagtgcaatggtttgatctcagctcactacatcctccgcctcccgggttcaagcaactctcccacctcagcctcccgagtagctaggactacaggtgtgcaccaccacgccctgctaatttttgtatttttttgatagagacagggtttcatcatgttggccaggctggtctcaaactctggacctcaagtgatctgcctgccttggcctcccaaagtgttgggattacaagcataaaccactgcacctggcctgtttttttgttttgttttattttgtttttgtttgtttgagatagggtctcgctctgcctcccaggctggagtgcagtggtgtaatcatggctcactgcagcctccacttccccagctcaggcaatcctcccacctcagcctcccaagtagttgggaccacaggtgtgcaccaccacgcctggctaattttggtttttgtagagatgggtttttaccatgttgtctaggctggtctcaacctcctgagctcaagcaatctgcctgcctcagcctcccaaagtgctgggattacaggcatgagtgaccatgcctggctctaccttttatgttaaagtttatataaattatttcattttaagattcttttattcctgccatttctgtggtgcaattggatttttacataaagttaaataatactttttattttggccaggcgtggtggctcacacctgtaatcccagcactttgggaggccaaggtgggaggattgcttgaggtcaggggttcgagaccagcctggccaacatggtgaaaccccatctctaccaaaaatacaaaaattagctgggcatggtggcaggcacctgtaatcccagctactcagaaggctgaggcaggagaattgcttgaacccaggagatctcagcagtgagctgagactgccgctgcactccagcttggacgacagagtgaaaaaaattaaaaattaaatgatacttttaattttatttactattttatttgaataaataaaaggatcctttaaaaagtattacacacgaaaatagggtcaaaagtcatagcccattttcttgattttatttggtgctttatgggaaaggctaaactctctctctttttttttttttaacacattagcatggaaaggaatcatttctactttgtggtgtctgtctgtctgtctatctgatgggctctctggcacctgccagcacactgggggaagtgtgaggtcaagataggcatcttgtagatgaagagcatggcgtgctggtaaacgtttaacaaccagctttccaggaaacaaatgtattgtatacatacataagtttatagtaacatgtactgatataaaggatgcatagcacttaatttacaaataataacaaaatatgcaatagtctctgtcctaaataccgcagaggtgattgagtctcatagaaagctctcgtgactttgcactgtcatatccgtagccaagcattggttgcagcagatgagcaagtgtggtgttggcacaaacactgaaatgttcattcatgttaaggagcagatcaaagtgaaacaacaaagagttggggcaggctgcagccttagtgccatgagcggcttctttgttgaactggataatagtttttcaatattcagaaaagtttcctcaatgttttgtgctactcacagtgttctagctacagacaagatgctcttttaagcatagaaaatccatgaaacaaatcactgccgacctgtagcatttgcctgttcctgttgtataaatactcccaccagggccaatttcaagttgccaacatgacttgcgtgaacatgggttcgagatgcgcagcagcacagcacgatagagtacttccgccttatagacacagtcagttaaagaacctcaaagcatagctattattaagatgcagtaaaaataatcaggaagtgatgaggtttaagtatttataacctttgttttaatagaatccatttagttgtatcttgtataattcaactttaattttttatcattttaattttatatagtttttttttctttttctttcttttttatttttctttgagaaggagtcttactctgttgcccaggctgcagtgcagtggcacgatctctggtcactgcaacttccacctcctgggtttaagggattctcctgcctcatcctcccaattagctgggattacaggcacccgccaccatgcctggctaatttttgtattttaagtagagttagccaggctggtcttgaactcctgacctcaagtgatctgcccacttcggcctcccaaactgctgggattacagacatgagccaccacgcccggcccgtatagtttttataccttaatcttgcataatgatttgaataattcagctcacaaaattcctgagaatttaacaaccggctctagcataccggcacaagctggcccccagtgcatcactgacggggaggccgagtgtcttgaggccacactgcagatcagggtcctgcctgcagccaagtggggacaagtggagaataacttgcctcctgggctctcctgagtcccgagcctgacagcggaggcccaggtgggtgaccctgctttgtgctcggtggcaggggaaggggggtgggcctgtgggcctggatggagaacctgtccccatggctgtcatgtccctacaccagctgctgccagccactgtggggttcgcaagtccccactcgcaaaacggctactgttttccacaaccatgggatacaaggatgtccccttgggctccttctcatctctactctctgctggcctctttgcacagattgatacctgggatgctgagccaggaccagagggaggtaaagacacacctggggtgcaaaactgaaggaggccctgatgcttgaggttgttcaagtgcagagaatgtttgtgtatgtgtgaagcacacaaccacacgtagcatctaaaaggacatttgatgttctgcacttaatagattaagctggttctgaccttctagcccctgggcttctgatgagtctcctggtagcctgtcagctcctgatcttggatgggagcttgtgtgtaggtgggcactcttctgcaaagtgcgtttatggcttttatctggtttcctctgatcagaaagatctgggggtgctggcacacccagacgactagtaactcccaaagggagaggtgcagctttgtcacctgcccctgtgtcaggtgggacgtgagatgctctatttttttctgctccatcctgtgcccaagccttatacagggtgacccttttcagagaggcctttgccaccaggtcagtgtgagcatgtggctgggtgatttcctgccgtggaccagggatctgtgtgctgtctgaagtaagcaagggtgctctttcttggcaaggtctgagggctgagacttgcaaggagacacctgctctcttggtcaccagactggaggttcctatgtgcaggtgtggaggatggaagaggtcactctgtcctctttcttgcctgggcctcacctctgctgaggctgctggctgccctgggctcgcagtgaaaggggccatcttccaccctcccctgctggtcaagtgcatctttccaggttccggcactccacgttgccacccagacaagtgtcctgtgggaactagcaagtgggaatcaaaactacccccagagaggctcctggccgggagatgaagggatctaccctggggctaaagtctccccagcctttcttggagcttaggtcctggctttagaaagatcccattcacatccaggcacagtggcacacacctgtaatctcagtactttgggaggccgaggcaggcggatcacttgaggtcaggagtttgagactggtctggccaacatggcgaaactgtctctactcaaaatgcaaaaattagctgggtgtggtggtgtgcgactgtaatcccagctactcaggaggctgaggtaggagaattgcttgaacccaaggaggcaaaggttgcagtgagctgagatcgcaccattgcactccagcttgagcaacagagcgagattccatctcaaaataaagaaaggaagggaggaaggaaggaaggaaggaagaaagaaaagaaaagaaaagaaaagaaaagaaaaaaaaaagaaaagatcccattcacctgcacaaaagccacacccctttgtggccaaggaaagggccacagaagaagaagtaggcccttcagaagggggagaagtaggcgccttcagaagctggttatccgtgtgtaatgccatcacagggacgtgcgtttaagatcttttatcagtcttcgtagctaaatacttttagttaattgcaggcgggaggggctactagctcaggctacatggagcatgtgctcaaaaactgtctccaatatggtgacttgctgtttgaggacggtctaagcgactgaggagtgtgccccctgtccccacccttgagatgaggcctgataagggtgctggcatatttagtgttgggcaccctggtgctctccagcatgtggtgtttggcctaagtggcccatgtggactttgtttcaaggattttacgacaagaaacaccaaaatgaggacatctctgtggccatgtttcaggcaagggggtaatggatacagagcatatgtacacacaaacacacatgcacagagacacgtacagacacatacatgcacacagacacatagatacagacacatacacataagaatacacacagaaacacacagacacccacacatatacacacatgcacagacatgtagaaatacctagacacagaggaacacacaaagatacacaggcacacatacaggtacatctacatgcttatcaaaaacaacagcaaaaccacctaccatgacaaatactattgcagcaaaactgaacaaataaattctgtgccataaagtttcctaaacctcatctattttgtagaaatctagtcacttgagtatcatccttcacaaagttctttctattctttctactgtacaaagttttctgttgtcaaatagcaagagatctctgttttctacttggaatgggcctggagaagggagacagcacccgctccctccaccccttgtccctgagcacagcatggtgacctgccaagccagagggtgacctggacactcataactcaatgcagggccaactgtagcctctggccggtgtccctgagtgagggcaaagttgtaataacacttgttctctcctttctccaatttgctcccaagctccattgctttcgttcaggccctcccccttctagactgggcagttccgcatccttggagctcatttctctgtcttcagaatctgatgctccaattcatcccatgtgtggctgccaaggtctttctaaaactcaaatgtggccctatcaccgcacagggtaaagccaccataaactcctctgtgtttgagaacaagggccaagtctcccattgaggcctccagggagtggacagtctgggtctcctttcttctccaagcacgctgggcccatctgtcctgtccctgaggactccctggcacacatgacacttcagagcttttgccaactccactccctgcctgaaatgcccatctccttcagagagcttctatgtatccttggaggtccagtcctaatgtccctgcctccgataagacctctccccatcttcctctcgccctgctcctgtccccgccaggcatgacaaatctcttcccacagtgggcccaacagggaggcagatggtagaacaggttttgggccaggtgccaggtgcacgtggctcttcatcctggttccccaccgcacacctggagagctgagtgcttttcctgaggtcacgcagaaggttaccagcctggctctggagctgtctctttgccacatcgtggggtgtctttaaggtgaccttgaatgtgcttgaagctgttttatgtcctatttgcagacctaggggaggacaatgccagggctttttgccttcccaaggtcacagcctgaagacactcagaaagatgtagttggctcatttatcattttttagaaaaaaagaaaacaacagaatgtgctgaatccttgtaactgttggccatggcactagtttcatggaaggtggaagggcaggttaggcttcttatgagggcgttcctggcctctggaggggtgtgggtgggctcaggtgaatgactgacagactggatttacgtatgttgagtgtgaatctcagtccacagcttggtgtgcaaaaacagaaaagctatctggtaatagctacatctctgttggggagaggaaactgacctctcaattcagggtcttcatacctttctccagggtggggtctaagttctgggagcctcatgagtctcaggaattctggggtggcctatttggtctttgtcatcagtccatgcagggggctgctagaatgtcatgtcagcctctgaccctggccaagccccctctcagagattccaggccacatcccaggttgagggatgcatcctcccactctggggccccccaggtgggactctcagggaggccacttgagacgcggttgcccaaactgactcaacaagatctctcagtcacgggctgaaagatctgcatcacgggctgaaagcaggaaagttcttttgtctctctttctgctttcctgtgacaatgggtgcagaaccatcgtgaatggttcaggtgcgggtagggaaaataacaaataggaggaagaacaatctcagaaaggcaggtagcctgtcccatctgctgacagagcagtgtgtaagcatcactgagcttgtgacattgatgttttttccaacatgcagtataaatgtacactgtgattttacaaggccaggagccaagtaacaacacccttggcagaggaagagtgaagtggggaaggaaactgaagcgggctagggaggaaggacagcttgacaactagttagaattggaaggacgatggactaggattgtaaaagaataaggcagaatgtcctaccttcccaccttggcaaaccctgcccctgggagtggtcctggatttgcagtggccctggcctggaccaccatgtagatgtcactaatggatcctcccaggggacgggcctgtcatggccctcaagaaaggcagggatgaccaccccaactgcaggggaagacaccacccaccctgagggcttttgggagcttttaaaagaaggcaagtcacgctttaaaagaactttgaagagacaggagcttagtggacccagtggagataaaaggtccaggtaaggagtggccaagcacttggaatttagaagaggcgaatcagaaagtcccaatggaccagcttgggggtttgggggttactgggtccatgtcaacatacagctcagtgggtgccaaagatcagccaggcctagggtgcagatgacagtgaggcaggatggtgacctggattaggactggagggggaacctgaggccaggagagcagggaagagattgctaaagacagtcaccccatggcaagctagttttctccccgagccagcatttctacacgtgagcactggccttgctgtctggctgggtgacttcctctctctggggttcagggcccagcactgctaatcgggggtagagtcaacggccttccagtgcaccctttggtggctctgtgtggcacatcaggcacactggtcaagtagggggtcatcaccaggccttgggtgcttctcaaacctaaagtcatgtggtcctcacaacagccccgtgatgtcatcaggaacctgcccactggcccagggctgggaaggactagagccaaagtgcaggctcaggactgtttgaccccaaagccagtgctctgaaccctccatctgtcttcattaaccaccgcctctgccactactgtaaggcaagagaagcgtgtcacggcgcgaaggctaagcacatgctgggaaatcacccgtggcttgcagacacatgcacagctactgggggtagatcaagagccaagaacgggtgagctcaagctgtgctcacatggggcgcgtgctaggtgactgtaggcctcagaaaacctgggatccagaacagctttcctccgctagggggctctggcacaagtttgcctgaagacatggccccatggcgaagccatcatgtgtgggaccttccttggccccctcttggtgagccacattcctgtccacgcagtagctccagcccccacccgtggcttttcacttcttccttgctttccacttctgaccaccctataccagaaggtacttcatgtcagtcctctcccgcattccctctgccttcgggtctcctggaattggaactgtcactagtcaatcattacttacggggatgtgcagaaagccagacactgtgctgggcctcgggcggcagaaataagacagccactgtagtgtcagctgtgtgcacccatctctccttctgacccaaacgcaactgtgatgggggccggtcctgccctttggggccatcagacaagggagcaactgacatttgcagaggccagaggagccgtggtggaggggttttctcagggctcgagggaggtgcctgcccatccactgagagctttgggaaggaaatgctgggcgccttttgtgcctcctactcatcaattccccccagctgcaggcaagggaggtcgttagcagcccagcctgtggggagcaagcaggccatgagctgcatgcagctggcactgctattacttaggaggcatcacaacaatgactcaggtgctgaccataacccttaaccaggtcacagtggctgcctaactgttgaagctgctacccctcctttaggttacaccgcacgaaaagttggcaatcctctctctcggtggctgctgtgggagcagctaacctcacagcacccgaagggatgtcatcgggaccccagctcggtttccagcatcagctgatgccagcaagaagccagccaggcctggggcttggcagcccagggactttaccatccaccatccacagggctgttgccctggacaggtcattgatatctgactcacagccaattcatggatgacgtgaatccaaaaatcagaggcccacgtggatttagacatggaaatgcctcaccagcttccatgagccagtctctgtgcggcagacttgaactgcacgggggctgataggaagcagggtgggcgctgggatgtgactgtgcccttgccagtgtttccagtctcccagctcgggttctgtggttgtctaagcctgggggtgctctgccgggtctgtggcgacccggctgccttttcagcctaatcaccagagaagccacagaaagagctggaccacttagaggggcagtctggccacagccacttggaagaacaggctgattttgtacagatgtgtcattttctcctgacttttaaactgtaaacattatataataccctagaaaattttgaaaatagatataaaccatcaataacactggcaacctaacacttttacctaagagctacccattttgatttatctgatgcgcagttttcattgctggaatcataaagacatagcaccttagattcttctcttttctttttctttctttttattataacataagcatctttcccactgctacttttgatcacttttgaggactcaaaatgatcatttttgggcctgcataatatttcactgtgtgaactctatcaccatttcaatcaggtgtttcgtttgcttccatatttttgtatcaccatagcaggtgatgattgaaaaaataaatgcagcttgcaaagtcattctgaattacatcgtggagctggagagtgttctttcctaatcccttcaaggaattacgatgatatggggagatgaaacattcatttgggggctggcgtggggtaagctttaaattgcgtttaaagtcagtgtgatagtgacttgagtttttcatctcttttctccagctccttgacggccatatttgctggccagggttactggtgtggtctttggccagagagcagactttcctctctgtgaaatgaaatgactcataaggaaacaaaccccaaggctttgggtacatttgtcccatcatctaaaccagggtttctaatcagaagtccatgaatgattgtggggctttgtcgggggagaggtcctgaagctgagcacaaaatttggcatgtttgtgataagtgtattttatagggatagtgtctgtagttccatcaggttctcaacgggggctgtggccccaaaaatgttttttaaaaaacccagctttctctctctgtctctttccccctttctgggaatccgagattgaaatgaaagaaatcgaaagatctttgcctacatacagaggtccagtaatgggatggggaatatattatccccgggatagcgccactgtactccagccaggatgacagagactccatctcaaataaataaataaataaataaataaataaataaataaatacataaataaagtgcctctttgttaaggcagttgcttctatttctacttttttaaccaaagctaattgctaatgtgttaaagtacgagattctgccttgattatggccgtccgtggttcttaactaaaggaaatgctttggcattttaaaacacatggatccccgtaagctttgcatttctcaccagggagtcagactgacacacaaatatttgtggttagttaattgttctttcctgctacaaacactcaccataggaggtgagctgtatttaccaaactgaaatgttactatttgaggctgaaggagccaaagaaaccttgaaattcaagagaccaaacccaaaagttccacccaacggagtgggagacttcagctcattgaattcctgaatacagctcggccttttgtcttcacacagcaatgagaacacatggacacaggaaggggaacatcacacaccggggcctgttgtggggtggggagagcggggagggatagcattaggagatatacctaatgctaaatgaccagttaatgggtgcagcacaccaacatggcacatgtatacatatgtaacaaacctgtatgttgtgcacatgtaccctaaaacttaaagtattaaaaaaaaaaatcagtttctgttaacaacaaactctggcaccagtcagcgggtttgacttcctaaaaaagtttgatttgctttctctcttagaaattctgtcttaaatttccttaaacgcaagtgtgtatacctggagcaaagaacatggggtgtaattcaatttctcttctcctttcttcctctgggaatctctgctaggtttcccacttattattgttgaaaactggcagtctttaaaggggatggacttcctgaaatacggcaaacagtcatgcaacaaaaaggagaaaattatattttcattttgggcgtcttagatgtagtgcaacattcaacatgagatcaatgtgccctcttgaccccaaagtattggctaatgatccataatcaatatttaggataacactggttgggagtatgaatgacatctttccaccattgtcttggtaaatgaaactatttactctttctggcagtggatgctgtcgggaggtggaaaagtaagcattttcttacgtttgggttttctgtgattgtttgattatttaatttattcgttcaaagaagagaaagatttactgcatgtctacaatgtatcaagtggtaagatggggcctgaaaatacaaagataaacaaccaaacaaacaaaatggcttttccttgaagagctcaggaggagtctggtttagaaggcagacacgcaagttctatgctactggtctgtaagaagcgctgtgggatcagaagaagggatgacttaatgggtacagagttggtgatgtgtggatgacctcgtgaacgaagactagttcttcaagcagacccgtggaggacaccacagaaaactgtgttgtttgtttagctcttttccagaacttgttatgatctcttaacaaggtctagccaatatcattataagcacgtaaaattcctcatcctaaaccccaccctgaaatcactctgacgacatgtcagccatctgacacagatgtggatagtctgaaagcccaacagttctaatcatttaggttcaatttggtctcaacagagatttttacatgggacttcatgttttacaaattattttagtattatcaatttgatcctttaaggcaggcagaaaacatatttccaccctctactttatagataaagccattgaggctcagagagattttaaaattttactgcaaattacacaggcttctggttttgtttgtttgtttgtttgtttgagacagagtcttgctctgtcacccaggctggagtgcagtggcacaatctcggctcaccgcaacctccccctcctgggttcaagtgattctgctgtctcagcctcttgagtagctgggactacaggcgccacccaccaccatgcccagctaattattgtatttttagtagagatggggtttcactgtgttggccaggctggactcaaactcctgacctcaagtgatctgcccgcttcggcctcccagactgctgggattataggcgtgagccaccgcggctggtcagattattcaattttaaggtcttacgggccacataacatgattgcctttctaaaagaattatttattcatggaagtctgaagcaagagtctcttgaagttcttttttgtccttgataaaatatttacttttcttgttttatcctcctacgagatccctactgtccatgcccacggcctagattggtctctggccttgagccttacagagcatgctgggtcccagggcttgtcctcaatgcaccacacgcagttggctcatgaactaggacctctgtgtcttgaagtgggagtggatggtaggaagggggagatggaaaagcaggggtacaaggctgatgctggcagcaatgaagaccttggtgattcgtggaccatagtggagactgagagggagtggagaggcgaagagaaaccagagcatcattcctgatggagccctgtgttacccccaggctcctttagggcatgagagtgccagggctggaccatctccaggctgcacactttttctctgcagctgtgagcagagcccaggctgtctgtccctcagcatcccctaaatctgcgatgcaatcatagcccctgaatgttagggctggaggcaactcagagatcatccacccacagccctcgctgcacagagacagaagcaatgagatgaagtgactcgtacaagattgcaccttgggctgcaaaattcataccaagtgatccagggaggcctttgaggcattgcattcccaaagtgccttctaaatagttagccagagttatagagtggtgctcagaacaggttgtggacgtttattgaattccatgtgatttaagtgtggttggcgggcagtccacaccaccgccgcgcactgcatgagaaccctgtgtgaagggggcttggggtaatggagcagctgggcccgacccaggtggattcagagtctcccatcactcggagaagcctgcaccttggaaataattcaactccttggtctgacttttgcaagggaaatgtttggggcattttataggtctccatggctgtggtgttttatgacattgaacccaataaaactcgtaatgacacaggatctgccaaggggatcggaccttcccttctggcacaaggaaccattctgttttggtatcccaggaaatgagtggaggaaaatccttgttatttcaagtgaacagggtctgggcaaggtctctgtccctggtcaccttgaccatgtgctacctgtcactgagtctaacggttgctccaattcagctgaaagacaggactcagcaaatagagccttgatctgtccacagggtactcctgtccactgttccagcaaatgtgagaaaacccacttgtcctttgcgagagagaggcaatgctgtcttagtcccatcctaaaggcagaaggacgctaaacaagggtgtttgcgggctacaggcaagagccccgcaatggcctccccgagggatctgaggcccagcaggccatcccaggtctcagaagccttgtaagagcacagtggaggacccttcttgcacgctgagctctgagcagtgaggggaacagctgggagagaggctggggtacaagtgacacagtgcagagatgctgctcccagccgaagctgccactgtgggccttctccatccacccagcccctgtaattgcactgcccccacctctgggctcgagtagcccgtgagcctgctttctggacccatcctggcaagttgctggtggatatacctatgcagcagggcaactacaggcttaggagggctccattccagccctggctgagcatcagaatgggggtgagaggtaaaaaatacagattcctggccctgtttcatactttctgtatcatatgcaggagcccaagaagctattacagtcccagatcatttctgatccaacccaccagtcagcaatacctgctcaaatctaggagtcactgacctcagccccctccccttcctggggagctcccactccagggttgaggcacgcacatgactttcacctcttctggagtcctcccctccacattccccaacaagctgctgctctgagattcttcccctagtctctccacacaggccagcagtcactgcaaacgcccagttgcaatgcaccaagaactttcagggttttgccccgttttgctggttggtgccaggagatggaagctctcgagtggggtgtgctgtcccctgggctgggtggaggtggccacagcagagaaggaagatgggtcctggaagtacaggcggtctgggcttacatcctccctgtgccactcccggctgagggacctcgagcaagcttgacctccgtcagtcttcatttctttacctgtagagtggaggtctggaagccggcctcctgggatgctttgaggatgaccaggagctgagaggtagtgccaggggtcagccatgtcagtggctccacctgagtcctcagggcctgggggagtgtctgggacgaagtaagcagccggcgcacaggggtcctccctgctcccctttaattgcttgcgtctctctggggcattcttttactgtctttggcttcttcctttgctgcagccctcatctggatgcctgcctctatttcccccttccttccattttctttaactgcattatttttctgtctttagaggccagtcacttacctccttaattttcaaagttttgtcttttctaatattgtatcagtgcttaaaatgcaattttccccgccactgtagtgcctcatgtcatatgtgctgcgctgcatgcggggatggcccagaacagcttcctgcagtctgtgttcttcagaacagtggcttcaaacaggaaatcaaacagggaattgctttagttgttcatgaaatcaagtgggctcctgctggcattttaaaaacaaaatcatatagaatagagaatacccaggggcattgcctgtaggaaaggctttgggaggcttttgtatcctggtgtggggatgggtgtgcactcgcgtgcctgggatgtcaggcactgtagatggaacaaaagttcatgcccagatgaactgataagcagatcgtggcctgtacattccatggaataccactcagcctttgaaaggaaggaaattccttcacatactgctacatggatgaaccacgaagacatgacgctaagaggagagagtcagacacaaaggagaaacactgcaattccatttaaatgagtccctggagtagtcccattcagagaacagaaagtagaacgggggtgcgagagcctgacgtctttctcactgacagccacagtaacaaagaacagaaagcccgacagacactgtcgtggatgctcttagaccacaccgcacagtggagacttcacagaccccgagtcctgcacttggtgggtgggtctcacgaccgcccttcccccttgcggtgcaaagaaagttcaccgccctattgctgtctctcccagaggatctttctgacctactcaaggaacatttattaataatctattgagagaaagacaatctagtaggtcttatgcattttctatcttctcccatttttccatgaacgatatctgttatagcagccctgttaaactaactccccgacccagcccccagcccctgacacctgttactctaccatctgtgtcgatgaattgggctactttagggacttcatttaggtggaatcatacagtgtttgtccttttgtgtctggccaatttcacttagcacaatgccttcaaggctcacccatgttgtagcatgtgccagaatttccttcctttgtaagactggattccattgtacatatagcccacactgggcttatccatccatctgtccatggacactggctgctgccacattttagccactgagcaacactgctgtggacacaagtgtacaaatacctgctcaagtccctgctttctgtcattctggatacacacccagaactggcattgctggatcatatggtaattctatgtttaatttgtcgaggagactccatacaggactttgaattttactctgaatgagagggtgacactggggagttctgagtagggaagcgatgtgatgggacctaacatttttatagggtcacagtgggctgcctttgggaataggcaggtgggaggacagggaagaggagagcagggaggagttgctgtgtgtatcctggaaagaatgaaggtggcttagacccggctctcggccaaggcagagagatgtccattcctggctgcctgtggacgggagagccaacagaaatcggggttgcatgtggatttgtatgtgcagaatacgagagaaagagcatgaggaagagaagatggagctgccattcacagcgatggaaattgaccaggaactcacctctggccattttaagtctgagacatttactagaagtccaagtggccacagcacttggtgacattgtcagctggtcctctgacttctaccagccactttccctggcccctttttggcttgagcctcccagctgccaagcacgcctggatgttccagatgttttcaggttcccagagcccttgctgtagcagctcaagccttcctccccggcctcatctgctttccccgtgatgtttgagagcttttctcaggtgtgtgggaggaaacagcatgttgggggccaggagacagccacccagaccttgacaaggcaggggacggcttcagctcccgaagaccctcttgcgttcccagccaagccagaggcttacaggctgctgaacgcacctgaggcagcacccatggtgcagccctggtgctgcaggccaagctcttggtcctgtcacagggagaaagtctatgccccgacagcttgaacctgagtcaagggtcacctttcagagctgaaattgacttcttggaaagccagagaaatgcattttcccatagcattgagggcaccccagccctgtgcccactgagggagggaagggggcttctagaggcatcatcagagcaagatgtgagctggctttgctttgacctcactgtcagggcctgccccagatgccagcactcagagctcactctgcagaagagggaaccgaggctgggaggggcgagagagtgtgcagggtacgcagtgggtgaataagtgagtcaggtagagagcccagttctcctgggccccaggtgtgccagcagcctgcacagagtggccttggcttggcggtctttccccacaaagcatggactctcagaatcagaccccagctgagacgaagcaccagatggattgctttttagacggtgcatcctgttagagcttaggcttcccagagtgaatacgcactttcgtgtgagtttttgcaatgcattcacttttttagaaaacttccctgtagatgcccgctagatactgggttctgattctgaacacagacaccccactgtaggtggattggtggggggcagaagattttaatctttgggaggattgaggggtgtctctctcccttgcacctctgaaggtcactgtcacgctgttgctggcatctcagcatttccatccacttctctatttccactaacaatgccctagctctgccatggccacctctcaccgatctcctgcggtggcctcccatctagtgtcctgcttcacccgcaccccacaatctcctccacacaacagctgcagtgatccctttaaaggtaagtcagctcctccttaaaaccatacaatggtccaacacggcatttggaaagaaatcccaacccttccccagctggtctctgggccctgccctcctctcaccatccctggctgctctgctccaagtgcagggagcctctttctgctctgggaatctgccaagcctgtgcacttttagagccgtctctctgctctgccctctgtgctttgcaaagcctctccttgccactgaagactccagcatacgtcgcactttctgggagaggtctttctcttatctaaatacccctgggcctgtgcgatgattctgtcccgtcatcctgtttgaatttctttgtggcacttacctctcctagaaatcagtggccgtttactttgctagtctgccatctgccttcccctctgctctcctccctgcatcaactagaatatgggctccacggagcaggagctgccagctgtggcctccagcatgttgcaagatctgtctcaaaagttcttgttcaggggataatggattcctcaaaggaaggaatcagaccctctctgggactcccctgggtgctagaggacctcgctaccttcatgtggggctgctgggagccaacactgtcacagcgtttctggacagcaatttggctgtctagaccagaagctccgaaacagttccacggtattgaaccaaagcaatttttcttctgagagcctaaactgagggaaaaattctaaaatgtaggcaataattcatacacaaatattagatgaagctatatacatacatccacatgtagtagggaaatgtcaaaagtggtatttactattagcttgaatgacattaaaaaggtttatggtacagtattaagtaatatgaaacatacaaaagtttatgtacagcatcgtaacagttcatgcttatttagaggacttgtgccagtcaccacatcgagaactttatttacattttctaattctctgaacaaccgtgtgaggtagttattatctcaattgtattgactgagaaaatgagacatgaacagatcaaggaagctgacaaatatggcgtagtttgtaaactgtaatgtgaggatttgaatccagagcctctcactccaagcactccatttaaactctactgtatgctgatttgagtttcataaacaacttgaaaatgtgcatatcccttgccgcccccactatcagaaagactaagaagaaatacaccaaaatattcacagagattgcctctgggtattggggttctgggaaacgttttctttataatttcctgtatttaaatatttttctgtaaagagcacacatcattttcatgtaaagttttgaattttatcaaaagattagtagtcacacacaaaccacagataactttggctaattaatatagagtcaaaaatacttctataaaacaagctatttcaatcaaacatgatgtttaatatgattaaggagggctcattccactgtgaaaagacaacttagcattaagaaccacatagccaggcacggtggctcacaagtgtaatcccagcactttgggaggctaaggtaggaggatcgcttgagcccaggacttcgagaccagtgtggtcaacatggtgaaaacctccctctataaaatttacaagaactagccaggtgtggtggtgcatgcctgtagtcccagctacttgggaggttgaggtgggaggatcacttgtgcccagaagattgaggctgcagtgagccgtgatcatgccacacacttccagcctgggcaatggagcaagaccttgtctcaaaaaaaaaaaaaaaaaaaaaaaggaagaaagaaaaagaaagaaaagaaaaggaaaagaaaaaagaaaaaaggaaacataatcaaaggcatccctgtaaaagcttgttgtaacctaaagaaaaaggaaacttcctagatatcttctgcaagcctatagccagattcagaagtgagagacgcctgctaacattgagataatttaactttgttttgggaattcttgccagtgtaatacaacaagaaaaggtaatacaacatctacacatttcgaaaaaaggcataacagatgatctgtttgtctttcagggaaatctaagacaagtaattgaaaagctattagagctaataagagaactgaaatagacaaaaatcaatagctttctttttttcaacaataacattagcaatgccaattctccaaaaattgtatataaatttaaatttaatgccaataaaaatgaatgcaggaattcatagcttgtcaaaattatagccttaagttaaatcagaaaaatgaatgagaaagaataatgaagaaaatcttttaaaaaagaactgaaactgtatcattaaactggagtaattaatttatgtggttctatgcaggaaaagacagagtccagaaataggcccatgattatgtgggaattgagtaagtgataaggaaggcaattcaaatcagtaagaaaaatggcttttaaaaaatttattatctaatatttgatttgtcaagtcattaaataattatctataccctaaagatatcctgtattttttctaaaagatttaattttcacctttgatttacaattaataaaattttttcttgagacagagcctcactctgtcaccaaggctggagtgcaatggcaccattatggctcactgcagccttgacttcccaggctcaagcaatcctcccatctaagcctcccgagtagctgggactacaggcgtacatcaccatatccagctaattcttctaatttttgtagaggtgaggtcccactctgttgctcaggctggtctcgaattcctgggcttaagtggtacgcccaccttagcctcccaaagtgctgggattgcaggtgtgagccactgtacctggaccatatttatgtctttaatcaatttggattcaatagtcaagaatggttgagcagtaaggccacagttttatgtgaagaaaaaagttttctcagcctcatttatcgagtagctcataccgccctggagacgcacagtgcctccccggcatgtgcatgagggtccgtctgagactctccgttcacttcctgttctatttttacactccctggtccgttccatcttcattactgcagcttttagtaagtgtggacatctaggaggggactcctctctatcttggttttttttctcttcatagatatcttttctatttttgagccttttcttatgcataaaattttgaaaaccagcttgtaaagttcctcaaaaacaccctttggaatatagattggaaacacatttgatttttaagtaatttggagagaatatgcctcttaatgatgagtcctcctaatcatggtaaatccatctttccttctgtttaagcccttctttaacatcgttcagtaaagtttacgtctccatacaagtttgcacatattttattaggtccatttctaggtaaattatgtgtttagttggcattggaaatgagctataaaaaaaaactacatttttctaaatggtcaaaatatatgaataggccgtatacagaggcaaagaatccatataacccatgagcatctcaaatataatcaagggaaacaaattaaaacaaaaagatttaatttattacctattccactagtaaaactaatgtttgacaatacgagttttggtgagaatatggggaaaatgaaaactctcaggtattgctggtgggatgataaatgggttcgatcgctttggggagtgttttgggaacccatagtgccactgagggaacatagcccactgccctgtaagtccataggtaaattaaatatctaaattccctgtgttgttcagagaaactctcacatatgtgcaaaacagggaatgtatgaggttgcccatcccaatgcatttcatcattttgaaacagtgtcccttagaaaatgaatgaataaaaggaagtttattcacttaatagaaaaggatacagtaaaaaaaaaaaaagcactgggaatctgtgtattacaacaaacaaatctcaaaaacacatatttctgaaaaaaaaagcaagttgcaaaaaggttacatacattatgaagccatttttaaaagtctaaaacatacagagtagcaatatatattgtttataattgcttatacatgtcgtaaatgtccaaaatcatacatggttaacacctactaactccatgatcattattaattttggagagaaagagaggagaaaataatgaccaatctttagttgtatcttcatatctggaacataaaaagagagaggaaaaaaagagaaggaagaaagtgtaccaaaatatgaatatctgtttgatcttagcagtgtcacattattttctgtgtttttttatacatttaaaatattcatagctagtggtgaaaaaatttcttaaatagttgtatatttctatcatctaggagtgaggaagacatttgcaagtgtgaacgacacaggaaagattaataggaaagattaataaattgactaggtagaaatgatagcttttactgcataatacataccatgctgtaatacataatacaaacacaaagttcagttgggcatggtggctcacacctgtaatcccagcactttgagagaccaaggcaggaggatcacttgaagtcaggtgtttgagtacagcatggcgaacatggagataccccgtctctactaaaaagacaaaaattagcgagcatggtggtgggcgcctgtagtcccagttactagggaggctgaggcaggagaatcacttgaaccccggagaaggagattgcagtgagctgcgatggcgccactatacaccagcctggatggcagagcaagactccatctcaaaacaaacaaaaaaaattagtaagttaaaaagcataacctaaattaagaaaaatatttacatttatgacattaatgtaaaaattaaacatatttatcacataaagaggtcttccatatcattgagaaaatgataaataccttaatgtaaaaagtggtagaagacgtggatgatcaaatcataataagagaaacacaagtggctaataagtacatgataaaatcaatagaaaagtaaattaatactatgttgttcatcacttttcactgagcagattgacaaagttgtttttttttttttaatttgttataaaccattgtccagggactggagaaatggcttccttcatcacggtgagaatgtaaaccagtcttacctttataaacattaatttagcttcatagatcaagatctttaaaaatgtgcatattcttaaacaccataattccggttatggaaacatagcttaaaaatattggacaattgaatatttaccttacaacaatgtttactgtgggtttatttataacagccaaaagttgaaaataacttatttgaccattagtgattaaataaattaatggtaaatttgtacaatagcatgcagttattcatatggttcaaaattacatttatttatatataatttatactgtactgttcacagaaataaccaagttatgacacaatataaacagtttggcccatttttcaagactatatgtatatgtaacacctttgaaaatgcatacactgaacattcacaacgattttccattggtggtagggttgtaactgattttttttcctttgcgtagatgagaattttctaattttctacatgtgcagtacttgcttaataaaaaatgagattgaaaagtaaaagaccacttttttgtaagccagctcagaaaggatgaaaagaataataacccttgtttaagaaagtacagggaactacatacttccatactgctgtacgaaatgtctgaaggacaatttgccaaaatatatcggaagacttagaaaggttatgtatgctcttgagcgtgggaatcccacttgtgggatttttaacctcaacaaaaattaagggaagatatgaggaaagagaaagggcatgagcaaaggacatttttgcagcatgtttatgatcttgagaaaatggaaacagctggggtgtgcggcagaagaagtggggaaaatgacaacggttcattaaacctcacgatcagatgctgacagcccctcacaggttgctgcagacaaaacagggaacgacaggaaaaagatgaccgtgatacgctctgctaaaagcaggtcgcaaaacaggatgtagataatgatcccattttgcttttttacaaaaaaaaaaaaaggccatggaaaattacatatcacgaatgttcagagtggctgtctctggatgatggcattggagttaattttatctttcactctattttctgaatttcctatatcaaaagcaaattgatggtgtgaaggggaaagcatatttaatgtgattcctaaaaggctcagccctccctgcatggattgagcactgaaagaagagggttctgtcacctctttcgtcctgacccttgccttttctaatgttgctcagaggcacacagacgtatttgctttaagtaattgcttgtctgtttttaatatcacattttgaaaaggtatttagacaacatgagtttattactttctgtttaacccaaatccttcagaggtacttaaagcaaaatgtaaagtcctcttatccctttgtgaatttcagtccccagaagtctcactgttagtagtttgatttttaccaaaaatgtccaggtattttcttttcatctgcaaatgtgttaatagactcctttttttaaatttcacacaagcaggattatatcatacaaaacattctgcaatttactctttcatgtaacaataatgtatcctgggtatttttctttgccagttcagatctcttttatccttttactaatttatttacctatctattcatttgcttaacttgattttattattatacaagttatccatgaatattgttttcaaaaatttaaacagtcagaaaaggtataaactgaaaactcaaaagttcgccttccctgccaccactcatgtgccctcctcagaagcaaggaatggagcagcttttgtggggttttttgttttttctctgagacagagtctcattctgccgcccaggctggagtgcagtggcatgatctcggctcactgtaatctctgcctccctggttcaagcgattctcctgccttagcctcctgagtagctggaattacaggcacccaccaccatgtccggctgatttttgtatttttagcagagacagggtttcaccgtgttttcattagagacagggtttcaccatgttgcccaggctggtctcgaactcctatcctcaggtgatctgcccgcctcggcctcccaaagtgctgggattacaggtgtgagccaccgcacccagctgcagcttttgtttttaaacattcttttcattacagttacaacttcaagaaatactaatgccaatatctctgagctaaatacactgacagatgcagaatgcacttcatcatgctgtctcttttcttacctggctttcacctgcacactcccctctccatttcctagatttttatcagctgttttgtatcctagtgattggctttatgactttaaataatatatttaaatgtttacgtctcaattcattagctttaggcagtatctgaagttaacacctgctcacaaacactgctttcaaattcacatcctacttttttgttatactgttatttttacatattaaggcttatcatatatatattctggctggacttggtggctcatacttgtaatcccagcactttgggaggccaaggcgggtgggtcacctgaggtcaggagtttgagaccagcctgggcaaaatgatgaaaccccatctctaatacaaatacaaaaattagctgggcgttgtggcacatgcctgtcgtcccagctacttgggaggctaaggcaggaggatcacgtgaacctgggaggtggaggttgcagtgagctgagactgtgccagtgcactccaccctgggggacagagcaagactctgtctcaaaaaaacaaaaaattatattctgttgtgttcagtgcttatataattttactgtgtttcatcagtaggttagtactcaaaactttttcagttgaaaatcaggcactacaataatataactatgtaaattttgttctgtagaattaagtgggataattgaatacatagagaaggccatctgatactatgtcattaaaatttgccatttgagggagaatttcccaaatatcaaggttttatgaagcctctttcgttttcttttatgtgcttgggggtcacactcggctatccttatttcttataactcatgtcattcttatttgcagttttgttagaggacgtcctagtgtcgcttattctttcctgtacgtgcatgctcgcaaggggtctttcactgtccttaaggcttaatgtggacgtctagacagcaataagctttttctaccagcttacaaaactcaacacaccaaagactatacaaaactcaatacccttcaatggcttgcaatgctctttttaaaagtcacctctaagggggtgtaaataacattccacaaaattcacccatttggggcacaattatgcatttttgcaaatatatactcttgtataaagtccaccacaatcaaaatggacaacattttcaccaccccaataagtttcctttagccctttctgttcataccccttatgctacctccaaccactgatctactttctagaaccatagctttgccttatctagaatttttctttctttttttttttttagtggggaaggagtttaattgacataagcctagcccacacaggagaactgagttgtcactgaaattagtctccccaaaggtgtgaaggtcaggacttttatggacaatttggtgggcaggggaatagataatgggtgttgctgattgcttgtaaaagaaatcgtaggggtgtggaaaattgcccttgtgagtgagtactcctttgggtggggccacaggacaagttgagtcatgagttttgagtttgggtggggtccattggttgccagaatgcacaagtctgggtgtaaaaaaaaaaaaaaatctcaaaagaccaatcttaggttctgcaatagtgatgttatctacaggaccaaatgggggagtcagaaatcttgtgacctctggccacatgactcctgagcagtaagggattacagaaattatgcctacattttagcagaattcaggtccccccataatcctgttcttgtgggctttcttagtcttacaagggtgatttttgctccctgagcaaggagggggttagttttggggagggactattatcatccttgctttttctttgagacagagtctcactctgtcaccgaggctggagttcaatggcgtgatctcagctcactgcaatctctgcctcccaggctcaggtgatcctcccacctcagcctcccaagtcattggcactacaagcacatgcctccatgcctggctaatttttgtattttttgtagagatggagtcttgctgtgttgtccaggctggtctagaactcctgagctcaagtgatctcccaccttggcctcccaaagtgctggaattacaggcatgagccactgcacttgatgatcattcttgcttttaagttaaactataaactaaatttcttccaaagttactttggtttatggccagcaatgaccaaggagagcttggaggtcagaagcaagatggagtcagccatgtcagatttctcttactgtcataattttgcaaaggtagtttcaatccccctcacacacacttgggcttcagcacccctcaatcctgaggtgttagctacggagatgagaaaaggctaatgattgctctaacttcttcctgctgacagggggcatatttgggggaggggttgaccccagggtaaaaggagtggaagtgtcttgcagttgcctgtatgtattcaagtgcaacttgttggggtccaacatgtgtataacgaaaacattggtgctcttatccacagatttagtacagcatttaagaagaaaaataatgagccgtaaaaaggaacgagattatgtcctttgcatggaagtggatggaggtggaaggcattatcctcagcaaactaacgcaggaacataaaaccaaacactgtatgttctcaattataagtgggagctgaacggtgagaacatatggacacacagaggggaataacacacactggggcctattggggagcgggaaggagagcatcaggaaaaatagctaatggatgctggaccgaatacttaggtgatgggttgataggtgcagcaaaccaccatagcacacgtttacatatgtaacaaacctgcacattctgcacacgtaccccataacttaaaatttaaaataatagtaataataataattagccctaatataaggagtgaaagtgtaaatcgcccagtgggttcaccttgcccgctgcctagacaaagccaatttatcaagacagaggaattgcaaaagagaaagagtaattcacacagagccagctgtgtggaagaccggagtcttattattactcaaatcagcctccttgagcattcggcgatcagagtttttaagaataatttggtgggtggaggaagccagtgagtcgagagtgctgattggttgggtcagagatgaaatcacagggagtcaaagctgtcttcctgcgctgagtcaattcctgggtgggagccacagatcagatgagctggtttcttgatctgggtggtgccagctgatccatcaagtgccaggtctgcaaaatatctcaagcgctgatcttaggagcagtttggggggcgggagatcagaatattgtagcctccagctgcatgactcctaaatcataatttctaatcctgtggctaatttgttagtcctacaaaggcatctagttcccaggaatgaaggagggttcttctgggaatgcgctgttattgtcttcatttttaactacaaactataaattaacttcttcccaaaattagttcagcctatgcccaggaatgaccaaggacagcttggaggttagaagcaagatgcagttggttaggttagatctctttcactgtctcagttgtaattttgcagcggcagtttcaaaagtcctagcttcaggagtccctgtagaactgacctgaagcctcaaggaatccaggtgaataaccccaaaaatcaaccaaatatggggtcatcagcagaagctcaagaacaatggatgaggctggaatctaataacaggtgtgctgtagctgttttgaaacataatttttctctctccagtttatttttactaaagacaagaccaatttatttgcaaaataagcttgccttattatactttgcctaattatttacataaagtgcagcaagaataattattggccatataggctctttttttctaactggctttgctggaatttttttcataaggaatctcagattagaccttttaaaagtctcttgagcccagccaaggatttatttgtgcctgcagatacttgtatgaattgggtgaattcctttcttcttgaggtcccaacaaagcttggagttcctgggcctgtcagaaagtgacattctttatttgccacaggttgggaatcctgtacaggacaaggtaggaggccagttcctccaaggggctttcatcagctctgtaggtcagcctcgatttcttaaagcagtctgaaaatatgtcatttcagtcaaagccttggtaaaataagcagtgtctccaactgtgtcttgctacaaaagaaaacacattcttattgaacttactcaagtaactatattgccttatgttaaaaatagtcacagataatttccaaattctggagaaggcaggtaaagagaaagaaatatgctctaaattttgtttacaggagtatattttgctcaattgttaaaagttgtattctcagtagaagttttctttactctgaaaaacaaaacaaaaagaatcagcaacattttaagtgaaaagtcgaaaagatttttccagttactgaacgttttggttgtttccagctgggagctaattaatatgagtaacaatgctaagaacatatatgtcaagtctttctgtggtcatatgtttttatttctcttggataagcaacaagaagtgaaatatctgggtcacaggttaagaagctcccaaattgtttcctaaagttgtttcgtttcaccttaccatcagcctcaggtgagcattctagtttctccatatgcttgccaacacttggtatgatcggtcatctaattttagcatctgggtggttgtgtggtggcatttcactgtggttttagttgccattcccctaatgactgacgacaccgaacacctgttcatgggtttgtgtgctgctcagctgtcttctctgttcaactgtttgttaaattgaatttttggcttcttttatagagtttaaaagttaattatatattctcatatagatacatgtttttcaaaaatgtcctgcctgtctctggtttagctatttcttttcttaatggtgtttttaaagtgcagaagttcttaattttgaaaagtctaatttatcaatttttcttgtatactttatgatcttctattctaagggaataatctattctaagggaatagaaggtcacgtttgtatgcttctgactcatattctttatatcctttgtgacaccaaggtcacaaagatttccttctaggttttcttctaagaatataatgtacctctttaaagcagcttttaagattgtttttatttatcattggttttcaacaatacgattataatgtaccttggtgtggttttcttcatacttggggttgatattcttgagtcttcgggtctatagcttctatcaaatttggaatttccatttttggtttctttaagtttcatagtctttctggtagcccagttacgtgtcttctgactgcgtgctaatttctccccagtcactgatgctctgttgtttatgttcacctttttctccctgtgcttcactgtgggtactttcaattgcagtgtctccaagccctctgaccttccttctgcagcacccaatgtactattcatcccatctagagttttggttgtttgtttgtttgtttttgagacagagtctcgccctgttgcccaggctggagtgcagtggcaccatctcggctcactgcaaccacagcctctcgagttcaagtgattcttctgcatcagcctcccaagtagctgtgattacaggcacctgccaccaaacccagctagtttttgcatttttagtagagatggggtttcaccatgttggccaggctggtctcaaacccctgacctcaagtaattcacctgcttcggcctcccaaagtgctgggattacaggcatgagccaatgtacctggtcatgtttttttttccttttataaaaaattttaatatttatttatttatttatttatttgagacaaaatctcgctctgttgcccaggctagagtgcagtggtgtgatcttggctcaaagcaacctctgcctcccaggctcaagcaattctcctgcctcaggctcccaagtagctaggattacaggcacgcagcaccatgcccagctcattttttttttttttttgtatttttagcagagacagggtttcaccatgttggccaggctggtctcgaactcctgagctcaaatgatcctcctgcctcggcctcctgaagtgctgggattacaggcatgagccgccacttctggcctctcttttttcttaatttcagatattgtattttttttaatctctaggagacccatttaatttttttatgtcttcattttctctcttcattgtcttattgctttcagttatatatttgaaccagtttatatatttttgtcatttctgttttaaggcactagtctactaatatcaaaatgtgtgcaatttctgctcatgttcctctcaattaacttttctcctagttgagagtcatgtttttctgtttctttgcatgcctggcaattgttactggatgacaggcactatgagtgctgaatatgattagtgagcgctgaatattatcgtgtttctttagagagtgtcacacttgcatgtggcacactgttaagttacctgtggataaaattggtttttgaataacagttctgtgacttactgtaccttcagcaagcccttaagcctcaaggagcctgagtttcttcatctgtaaaatgggaaggtatatgtctgctgtcagggctacatataatacatgaaaagcatgcagtaaaatgcccagccttgagtcagaaggtgtactaggcactgtgccagcatcattagtattcatgtttttatgtgataggcaaatcctgcaaccgttttatgagttaattttaaatctctgcctctctagcaggacatctgtgtctctagatccactcagtaattacaatcaacccaagcatgttaaaggcctgagaccttttcttttctttttctttctttaacattttccaatctcatgtttgaaagcataaaagagaacctttcagtctaaatgttctcctgcaccctcaaacccgatggaggtgcttctcactgcacgctcccttcttacacattccacctctgggttctgccaaggaaacattggagaaacagctccaaaggattgaatgatgtccagggccttttaagagaggttcaagtcgtgaccagatgtgtatctgggtaagatacgtgtgaacctccgtgggaaagaccaagggtttgaagtcagagatgtggctcaaatctctcttctgtgcttcagtttcttccctgtctgccggaggaggaggaggaggaggagaaggaggaggagaggagtaggaggagggggaaggggaggtggaggagacggagggggagagggagggagatggggagggggaggatctatctagtttacagggtcctcatgaggctcatgtgggaaaatgctttgcaggctggaaagtaccacagaggtgtgagttattataaaaagggaagttatttccctctgtcaaaaagctatgcagaaatatactaatatgtaagaaatgtttgtatggaggacagaaataattcatttcatggagagacaagaggatcactggcagtaaaactgcaggcattatttatgggagactcaaaggagggaatgccccgtgttggcgggcctgcctttcaatccttgtcacaagtcatgatccagaagctcggccaattgaagaaagggtctccatgaagtggagctcatgacctgcctgcatcagcatcactgggggcattttttaaaaatgcagataccagcactgctggggctggggttgggagtctgcaaactcccctgctggttaaaatacaaactgaggtttcagaactattgtgccaaagaatcataactgactccattgggaagtaatgacccatgatttgatttctcatttaatttttcaaaatgcaaacaatgcaaaaagttaaaaattgaaaaataggttaaggcccatagtctcatcaatacaagacacaactgtagttggattaacattttggcatattgctaacatattttaataatcactactgtgagagttttttaaaacataaatttacatggtgttccccccccaaaaaaattcactcacataaaggaattttatccgtccccagaattacctaatgaatttcaagcttctctgttagcagaatcaaatgtaggtgactcgataaacaagtgtctgtctttgacttaacacagctttataaaaatgccttcttccttccttcctgaaggtctgctcagcaccctcaaactttttaccacctgaaaatcttttctatcaattttaccacaatggggggaggtgaatttccacaaaagatcttttcactttaaaaaattgaaatggccacataatttctcctcctaactgtgccgaagtacctaaaagtcacaggttggcattgctaggtcagccttttgcaggggccacacgtgcccaaggcccttacacacccagccaggtgttacagagcagcctctcaccatcaggctctgtgctagtgctgggaaaagattctgctggcatttaaaagtattgcacaaggaggccagatgcagcggctcatgcctgtatccaacccagaactttgggaggctgaagtgggaggattgcttgagtccaggcattcaagaccagcctgggcaacatgatgaaatcccacctctacataaaattgtttaaaaaattagccaggcatggcagcacgtgcctgtggtcctagctactcgggaggttgaggtgggaggatcacttgagcccaggagttcaaggctgcagtgagccatgatcacgcctctgcactccagtctgggtgacaagagacagacagatgaatgaaagaaagaaagaaagaaggaaagaaagaaagaaagagagagaaagaaagaaaaagaaaagaaggaaaggaaagaaagaaagaagaaagaaagaaagaaagaaagaaagaaagaaagaaagaaagaaagaaagaaagaaagaaagagaaggaaaagggaagggaaggaaggaaaggaaaggaagggatatattgcacaaagcattagctgtgaatgactgtagcacacactctacaatccagcaatggaaaagctttgttttctgaacgtgttttctatcttcatgtgtttggaaaaacacctatttctgaaatactacccaaccctgttgggagtatgcctggtatttttttctagtgttcccagtttctcatcctttgctctttcaactcccaactaacaagtgtggaaggactgatggaatcagagcacgcccattttgtaaccactaatgggacttttaaatgtcggtgaggaacttgtcaatggaggaatagggatgcctgagcctcgacctatcttagcatcactaaaatggtgcaggtaaacactgtgagcctcctggtaggatgcaacatggagcacagatcacctcctcgacagcatctctaccaagaggggctgagcttgaatctaatggagcctacagaggtaactctatgtgtaagaaggacgagagggaagagcaagtgatgaaccatcacaaggacgcaaaatccaaaatggagaacattctataggactggcctttacaaatcaaaggcttgaaactaaccaaagtcagagcagaagggactcctgtttaaaggaaacctaagacgttgagttatatacgaaccttgtttgaatcctgagtaggacaaactaagcaagaagctatttttaagtcaattgttaaaatgtgattatgaattgggttcaatggctggatggttagatgataccatggaaatattgctagttttgttagatgtgatgaagtaacattggggttatgtgagcaaatgtctccatgctttagaaacaaatgcaaaatatggggtggtgaaatgacttgcttcactacattgatttcatgttgtttccaagtttcattcatttagaggaaataaaacgatatgatgtaaaatactgcaacccagaaaacaattttaaagataattattgaatgtgggtgatgagtgtagaagagttctattattattaatattattattttatttatttttttgagacagtctcactctgtcaactaggctggagtgcagtggcaggatcttggctcactgcaacctccacctcctggtttcaagcgattctcccacctcaacctcccaagtagctgggattacaggcatgcgcctggctaatttttataggcacgtgcctggctaatttttgtatttgtggtagagacggggtttcaccatgttggccaggttggtctcaaacccctgacctcaaatgatctcccacctcaacctcgcaagtgctgggattacaggcatgaaccactgtgcctggccaatattcttgactttagtatattttggaaggtttcataaaaaatagttttcatctaaaaaaatctgttgtagccatccttctcaggtctggctagcgttttctcccaggtggaagtaatttctttttgctgagctcacaaaacactttacccaggcctctctttggtacagaatcatgcccactctgaactgatggaatcgggtgcatgcctttcctccttattttcctgtgagagtgggctccatccttgtttcatgcctgtaccttccgctatgcctgacatagttcatggttgacagcaactgaatgtctgtggctgaatgaatagaagaacctcgttgctaggaactgttatcggggctgtttcaggttcacatgtggagaggtcagtattagggcaaaggtgaggaagcctcatttcagtggtgttgtcctgagttgagacatgaaacatgaattttaactcaaattctttggccccttctttaattcagagccataggccaatcaccgtactttcttcatttacaagatgagtatagcattggtggtttgtactgggagaatttggaattctggatgttggtgagatgctccatatgggatctcatgccggcagctagcatggcattgtgatcgcgacacccagggtgagtcccagctttgccagtaggtacccctgttctacctggatgctacccacctatgtctggcaggtcaaatcagaaaggcaaagcctccagcacataacatggcaaggcttccagatacaaaatagcaaaactattttgccacaggggagatgatagggaatctgaactgtcccctccaagggacacagagcctcaggcagggccacaggtgcacctgttttgtgcagagggctcaagcagccctggagacagtaacaccctccagctgccagctctgccaccttcagcatgaccttaccaagccacctcgcctcgccttcttcagtggtaaaatgaggataactgtaaccaatttatcaaggctaacatgtattagaaaaaaagaaaaactcgttatccgtcaagtgcttttcaaccatgtcatgctagccaagtgcaaataaggggtttctagtttctctatttttagttgatgcctccaccacaccccttgtttgactgaagctgtgtttcaggctttgagcatctcccaaagcaaacattgactgccctgctctggtgaaagtctgcattagagggcctagctggtttcaaataaacaaacaactcccctttcccacttcccctcctcttgctgactcccccgactagacacacatgcacacggtgcacatgcatgctctctcacacatgcatatacacgtgcacacatagacacacacacacatatatacacacacatattcaagcacatacacacatgtgtattcacacgcatgctctcgctctcacacacacacaagtgcacataagtgtgtatgcttcctctcccactctctcacaaacatacacagactcacacccttcccacaatgcagcaaagccatctggagccccagccagtgtgtgatgcgttttgcctctgtctggacttctgcacttcctggcttcacccaacctgaaactgctgggtgcagcccgagcaccagtgacagccctggttgtcccatggcctcttgaggaacccaggtctccagtcaaagccactggagtagggggacccatagagacctgaggtactcatgagacccatggaaaatcatctgcacacacactgctaaggagtcaaaggacagaagtgtaagtagtgggtcatttaatcttaggaattttactttctgtccggttctttgttcaataaattgaacaaccaatgttcaattatgttgtctcagtggacacaggtgtttgccaggaagcttaaagtcaatggcaatatggctggccagactaagaaagacaagagggctggtcacctgggcagatgcggaagtatgagtccaagtctggggaatatactaggagctgctgaccactggcccttcgttgagtcagggaggctgagagaggccacgaaaggcctgaggttcaggcagccctggctggccacttaacggtcattgtcaagaactgcaggctggccctggctccaggccttatgctcctctgttgctgggcaaatcactcaaatcctccttttatttttctgcttgtatcaataatatatgcttagtattaaagaatttaagaaatatatacaattaaaagaaagaaagtcaaagtcacatgaagtcttataatccaaaatccatttagaaaatactttggggggacctgctttgcattagcacacacaccgttttttaagtccgctggttttttttttgttttgttttgccttacaccacacctctgttttgtactctcccttcctctaacaataaccacagtaaacaacttggtgttcatcctccccagcctctttctgtgtaatatgcaaacatatctacacgcctgaatagaggtttcttttcatttggtgtttgcaaatatgggattccctcatgcacctctttgggtcttacttttctcgtgtaacaacatggtaccgaaattcctcttgacctcactggtgaagatccagcacattttttttagtagttgtgtgagagatttatagagtgtagatttattcaacaagtctttaattgctgggcagttacattgttgttttctgtttgggattttttttcgggggaggggattgtttttccaactattactacaacaaacattttcatctctcacatgtgtctatataatgatgttttattaacctgagatagtccagagtgggactgaaaatcaaaaggtatgtgtgcttttttattttaacagaatttaaaagattgccctttaaaagaatttaaaagattgcttcttccaataatatttcatgttttgtctaataaatatttattaagcccacactctgtgccagacattggtttagcaatttggattcagcaatgaataaaacaaagattccagctctcacagaagattaatcctagaaatggagcgtgaaggaacaaatgaaacaataattataacaaacattttactatttgggtttgtgttgcactaacttcctatttcttatctttacacatttttctattgaatgaattatatgctgcaatatacttcctgtcaaaagtttatgagctttgtatatattatgaatagacatttatctgatgctttgcaatctcttacccaatctattgcttatctacgaacttcatgagtagtttcttataccatctaatatttttaatgtttatgaatttgtactttttttgttctctcttcgcttctgggtattttatctttgttagtagttgtctccaaactctgggttatatacacagtttcttacatttcttttaattacatttttgttttttatttttttcagtcatacacctagaatttattttttaatatcatgtgaggtaggggttcaattgtattttccttaaggtaaatagtcattttcctaataccatttattaaaataaactatccactttctactgaattaaaatgctatctttttcacatacgcgattcctgtatttaccaaaatctgtttgtatgttttttattctgctctgatgattgttgtctacttttattattccaatttcatgcggttttgattacaatcttctatttcataattataaagctaggttaagacttaatttagtcatgtaaagcttcagatgattttatgcaattacaaattataattttaattaaaagaacattccatttatattaggaacaagaaaaacatcacaatcaaaaaagagaacagagtataataattacaagacaatgctacataaaactatggcaacagattggaaaatgtagatgaaattaaagatctataaaccatataagtcatcaaaatggcacaaagaggagaaaaaatgggaatagatcattcctatagaagaaattggaaatgtctttaaagatttactatttgaaagggccccagacacagatggcttcacaactgagttctatttagcctgtgaggaacagataaccccactgttatgaaaccactcaagaagatagaaaaaaaaaaaaagagagctcctcaatatctgttacaaagccagcgcaccttaatgctaatgcctcatagacaaatctcccttgggaatatagattctcattctaaataaaatattagcaaatagggccgagtgtgatggctgacacctgcaatcccagtactttgggaggctgagatgggcaggtcacttgagctctggagtttgagaccagcctgcatgacatggcaaaaccctgtctctaccaaaaaataaaaaatttagtagggcatggtagcacatgcctgtcatcccagctactcgagaggctgaggtgggaggatcaccttagcctgggaggcagaggttgcagtgagccaagattaggtcgtgggactccagcgtaggcaacagagtgagacactgtctcaaaacaaaataattagcaaataagaatccatccatgtgccaaatagactaatatgctgtaatcaaatagtatttttccaggaatgtacagatgtttcaataacagaaaatttaccaacataatttattacattgacaaattaaaggtgaacatacatcatattgatcgatattgtataggcacctgctaaaattcagtagccagccgcaatacaaacccatcgtctctctctctcttttttttttttcgagatggagtctcactctgttgcccaggctggagtgcaatggcatgatcttggctcactacaacctccgcctcctgggttcaagtgattcttttgcctcagcctcctgagtagctgggattacaggcctgcaccaccacacctggctaatttttgtatttttactagagatggagattcactgtgttagccaggctggtctcgaactcctgacctcaagggatctgcccgcctcggccttccaaagtgctgggattacaggtgtgagccaccgtgcccagccaaacccataatctcttatccaaacttctgaaaccctaaatctctgaaaactgaagtgatacttgtaaccctggcactataattcacttagtggtaaagctgatctgagctcacataaagaaatacttagatataaaaagtgttggtctttaaaactgtgaattattatgtgttctgtatgtaaggcatacttgaaaaaacatacttgtgaatttttcgcttctgtggcttgctgtcctatatcgaaatttgttatagtgttttctttttcaaggtgggtttgaggagcaatgacatgaggaatgtgctttcagctctctggaagaaatgcatgactgtgtttcacttaatcgaagacgccactgataggaaggctagcatttaattatgtatcactaaaagagaaaaaaaatgctgctactagttatactgcaaagcatcctccattgtgagacacctcccagttcagagatattgaaaagtgaaaaaaggtccatcttagaattgatgaaatatggtgtgtacatccaaaggaaatcaccactaacaacacgcccttctgacacgcgtggggacttgggtgcttcctctctatgatgtctgcatctcgaggaagagcccgatgtaagtgcaggagtgcagtggtctcaggtcagactggactccagagctggctctcacgggccagttgtttgaccctgagcaaactccttaacatataaatagcagcccctggaatgaggatggtgacaacatggtggtgttgatggtgtcaaaagggcctgtcccacatctgccatcctaaaattctttaccaaagaaaaaaacctgaccacatcttcccccctttaaggagacccctgatattactgtgaggccgcagctaggcctcgatgcctgtgctatcaatctgtcctaaatgtatatagtgtctcacccaaaaatctgagagggagagaacgttagtcatcttctaacaaagcccctgctgtttaccaaagagctaatgggtcggagagaaaatgtcactttcccaagtgacacagccagagacaaaatgaaaactaaacccagagccccagacacattggtgggctctttctagaacaccacgtggcctcccgctcaggctcctgtcacctgaggaccgggatccaccccagtggtttccagcggttatctccagccagaggatttctgtgtcctaaatgcagtgctttctgctgtatgggcccccgaaaaaagatggacacccatttagctcacccacccgcttctacccacgttctgactttgaggtctttgctgcacccacttccaccccacctttctaaccagcctcccggaaggggccagggatcccctctgtgcagaagatctgaggccccgctctctcatgtcctctgtctgctgtgtgtctccgacaggatggggctggtaagtagcaaaaagccggacaaggaaaagccgatcaaagagaaggacaagggccaatggagccccctgaaggtcagcgcccaagacaaggacgccccgccactgccgcccctggtgagtgattgcccacccccaccaagagcagattacttacttctcctatgccttaatgtccaagtttgtaaaatgggtatagcaaaagtgccttcctgatagggatgtaacgatctgcaatgtataagcaggtgtgccatgcaatataacacgcacaggacccggcctggttagctcccaataattcttagccagagctcatttctcgagggcagccttgaaaagaaaaagaaatgtaaaaaggtcagcttggggagagggtgtcgtaaggaaggatccgggtatctagctgcagctactacctctcttctccccagcagctcctggagacccttgtcccctatgtggcattgctgctggcattccaaagagcctgctttcctgggataagcatcatgaaacaggagggtgcctgtcctcacctcccgagcaggctcttaagttttcctggaatcccatgggcattttaaatgaggaaaactttccaaaggaaaaaaaaagtgaaatttcaagtgaaaaggtcttattgctggggaatgcattttcctagtcatgcagtttgatttgtttataaaacacttagctccttttgatggctacagcatgtctgaagatgcatttttttttttttttgagacagagtctcgctctgctgcccaggctggagtgcagtggtgggaccttggctcactgcaacctctgcctcctggattcaagtgattctcgtacctcagccttctgagtagctggaatcacaggcacacatgccaccacacctggctaatttttacatttttagtagagacagagtttcaccatgttggctagattggtcttgaactcctgacctcaggtgatccacctgccttggcctcccaaagtggtgggattacaggtttgagcatccgtgccgggcctgaagatacatttttagatgattctttgtgctctctccactccctgaccagtgacccccttttggtttggggcagttgggagccttgccgcgaccccctctcctgtgctgtccacatgtccacgtggtcatctctttatcctaacagggacctgatggggagacggggattactaatcccacttcctagatgaacccaggcatcttacctatctctgtcccagtttagcgccggtctcagcgcacaaccacaagatgtttattgaataaataattgatcaaatggggaaacttggacttagactgattgagtaatttccccaaaattatatgataataagtagtagcacctggaatttttttcacttaaaagagtcacataatatgtatatggaaaaaattataattactcattattccactatgtagagtcaccagagttgcctcgagacccttcttccgtgtgttcatttcatgtgttcctatttttaagagaaacatacatgcacatcattttgcaaaatgctacttcaaaattgtgttcaataaatatggaattaagaaaagaatatttgtaacatatgtcaggttgaaagaatacaccaaaacgcacacttgtatagccacctcccaacttcagacaagaaagagactcgttcctttgaatctccctcctccctcccctgtttgtacccttcaccccaggccccaatacccagaatctgtttatcattccttagctttgctttttaatattatcacatatgtattacccctaaacgatatttagtttcattattcatgttgtaaactttaaatcaactacatcaaacagcgcatatgcttctgagactggggttgtggctccgtgttacgcatgtgaaacatatcgacgttgatgcacgtggctattgctcattaattttattgcctgagtatactgtaatttgtttattcttctgtcatgagggttagttccacgttttaaaattgtttatgtatcggtcgggcatgatggctcacgcctgtaatcccagcactttgggaggccgaggtgggaggatcacttgaggccaggagttcaagatcagcctggccaacatggcgaaaacctgtatctactaaaaatacaaaaattagctgggcgtgatggcgggcacctgtaatctcagctacttgggaggctgaggcacgagaattgcttgaactgaggaggcggaggttgcagtgatccgagattacgccactgcactccagcctgggcaacagagcgagactccatctcaaaaaaaaattgtttatgtattatgatttttgctaggagccctcttgtacacattcccttgtacactcttgtacacatacacagaagtttctctacaggatatatacctacaaatatgtttgtcgagttttggggaaatatgctttttaaatattttttcttgtcaacaaatacccgtttgcagtttgatcttgtaatggtagagccaggatgttaagcccaagtggttgggctttccctcattgtccacagctgtctcatatccacattggggcatcccccagcgcggtcagggcaaaggcagcagagggcgggggtctgtctgagggtagtgctggtccctgggtacagaatgtccctgagcagcccccacaggcagctgcctctcctccttcagtaggtccctggagataccctggctgcccggctcagcagtctcaacccccaggccccacccacgcagcagggactgaaataactcaagtgtgtgttttctacccaaggttgtcttcaaccaccttactcctccaccgcccgatgaacacctggatgaaggtaagaagggtggtttgggaagctgaggctccacagccctctcccctaggtggcagctttgtggagttggaaaaaggttgagtcaggagcagcttgagggctggagaagagaaaacggggaagctgagagaggccccggctctgtgcctcttggggcgtctcttcaggaaccaagaacaagtttcttcagtatgcctgagcctgggtgggacttttaaaacatgaaagactttacaaactgtaaacaagaacaaaaacaagagtcccagggaagacacacagcatcatcaaacccaagttttaaaatatgctaactctcaaacgcaaagggctgggccagtggctccaggcccttgcctccagcccctgtccgctctatgtggagggcaccttcttgtttcccgctcccagtcacttcgagagtcccgctgctgaccacctaaccacccacgcccctccctggtccccagactccacttggttttttttgagacagagtctcgctcttgtcacccaggctgcagtgcagtgacccaacctcagctcactgcaacctccacctcccgggttcaagagattctcctgcctcagcctcccaagtagctgggattacaggtgcacacaaccacaccgggctaatttttatgtttttactagtgagggggtttcaccatgttggccagattggtcttgaactcctgacctcaggtgatctgcccgcctcagcctctcaaagtgctgggattacaggcgtgagccactgtgcgtggcccctagactccacttctgctctggtgggctggcctgctgggtactgtagggaatgagctcagcctttctgggccagaggctccacccctggggactcccaagagggtggcctccttcaaagtgacttcccacagcctcctcatcatccatgtccacacagcatggggaagggatgcctcggccagccgggccccacccattaacctgctcatatgatgtgtactgggcattcagcacacagagcccagctctgtcccaggaatggcgaaggggtgacaacaggtagatgcgaccccttccctggaaaagctcagaatctgtcacacttgtgagcagaacctgaatcttaaaacttcagggaaccactgtcacccattctgaccctcgctttcctgctgagaagaggtgaccagcccgaggtcacaacactcagctcagtgacagagcggagccaccccacccggggaagctaagtgctctccaggtgaccttcatcaggtgggtcctgtggctcccagagctgtgcagagagcctgcgtcacagcagggctcacttgaagatggtgctccaagctcctgagccctcttcctgccttccatccagggcccgccagcaaggtggggggcccggcagggtcactggcagccatagacagtgtggctggggctctggacacagacagtggagaggccagggctccagctgccacgtggcaagaccacccctactggggatagaggcaggcggggcagaggaagaaaaggataagaggaggcttatgggcctccgagggcaggtgtagaataagaagatgagggctcccagcactatgtccgaatgtgggcctgaggccaccagcagcccggcagtggctgcctccctgtggctgacctctggccatcagcttcctcacacacgccttgtccaggtcatagggcttcttagtgggtccacaacggaggacaggatgggctctggggggcagcccatccctggtggggtcacagggctgggggtgggggcctgtgctgggtgagaacatcatttccatcatgggcaagcagaagcctgtcctccttggtagccaggctcaccccagccccaccttcccgcttgtgggcctgagtggtggtcatctctcccttgttcattttagacaagcatttcgtggtggctctgtatgactacaccgctatgaatgatcgggacctgcagatgctgaagggggagaagctacaggtcctgaaggggtgaggttccaggacaccatcccctgtccctgcaggacccccctcccccacatctctcctttctccacccaccacatcctccatggctgaccctggaagtcttctccatcgccctgcccccagccctggccccagcattttcttgaacttggcccttttgtcttcctctccaaaatctttccggtgaagtaatttccattcacaacctcctgctcatccttcaaagtccacgttccatgccaccgcctccatgcagccctcctgactcttttgggcatgtggaccttgtcctttatgcaggctggtctggctgttccgtgaaagccttgcatttaagccagttgtgtccatatttgtctccttttcaagacaggagcccacactgatgacacacaccaatcccgctttagctcatttcccatgtccttctcagaaactccttctaggtcagctctctctcagtggccaggcttgtcctgtggagctctgagggtctgatttggttcttgaagttctccaaaggccctgagccaagctcacgaaggtcctgactgctgattctatacagtccacgccaaccgtgtttttctcaagcctgtccccagtccctcaccaagctctgaacacgtcccattcatcaagaggaaggctgctggctggatccttgtgccctcttggctggtcaggctgtgtagataagctcttccccctagaacttgcccagatagccactgtaccactgagcagtgggcacaagccccttcctgcctgccgtactctctacccctgcggattctctgccctccagggagagatgactttgaggaggcctgagagctgcccagtgacgggcctacaggggccatgatctcatctctgtttcccctgctcccattagaactggagactggtggctggccaggtcactcgtcacaggaagagaaggctatgtgcccagtaactttgtggcccgagtggagagcctggaaatggaaaggtaggtgggcacgggaacccccctcgagccaagatgcagtcactgtttctgctccctgggctgttaggcagggcagggccagagtgggactgaccagggagcctgcaggcactagcaaagaggggacaggaaatgagctctgctgggaaaggcctctctgctggctccagacgacattcagaccgctgtgtgacactgagcaagccgctcttcccagctaaacaagagcggtccttctcctggctcccctggatggaaccggccccagcgtctgatggcctcgaaggctaccagggaggcactatgaccagcatcccctcccctacagcctccatgggcaggactcagggctcagccctcgggggctcccaggagggtggcgttgttcagaactgattaatactcccaatcttctaatcccccagcccccatcttctcccatgtccccatggcactgggaatttcggactcggccagccagagcccccacgaatctgctcacagggactagctctgcctgaggactgaggcccagcaacgagtcttctctggacactgtgggccccgcttctttccctggaacagtgtggggaaccgtggggctgtcctgcacagaacaaccccataccgaaggggacatactggggtccctgctcagagagtctcggcagtttgcctaattcagatctcagactgcaaggaggaggcacgtgcctgtgatacgcagctgtgctttggagagagtgatcaggggcatttttccaaagcaaaattaacaaaggtcaaccaactagtgttcttgtttcgttctaggaaaacagtgagtccagggctgacaggaagcggaactggaagggcagcggggcagagggcactgactccatcacggtgtgaggagcagcagctcagggccgactgggaccagaaatgctagatttttatttcttggggacaggcagtgcaggagggaggctgtgtgggaatactccgaggagcagggtcgctctgagtttcacctgttcctgccgttttccaggtggttctttagatcacagggtcggaaggaggctgagaggcagcttcttgctccaatcaacaaggccggctcctttcttatcagagagagtgaaaccaacaaaggtaggcttggtggctttgcctgccttccttgccctgctcctcccgggaaggcgcctccagaggcctggccctggagtgagaggggaaggggtgactgccaggagaaccagcagcttccgggcttgtgtccctcccaattcaggccctgcccgggagttgacatgggggctgtccacacagtcctccctgtcccggctggaaaccacctgggcacaggaagccgggtggacaggggtggtcccacgccagactggccctgctgcccagtcagcaggaacaccgaggccagtgggggccagggaagggggaaccctgagcccttaaccaccagcctctttggaatcaaggattagggggagctcaaagaatccttcaagatcatctcagccagaggctgcaggtagcatatgttaggaagtggcctgtgccgtgatgtaagagaagagggtggtaattgtggggagcccatgccagtctagacactcatgagttcaaatccactgactgagcaaaacagctgccatcaccctcaggggttttctctctttctctgtcatttggctttctttccttcttaatttttttggtgtaaaatataaaacacatataaagcttgcatgaagtatgaatgtgtaattctaaatcatatagggtaataataaacaaatccctgtgtaatgacagccaagagaaagagcatcccagaccaccaggagccccctcactcccccacttgggctccttcctgattcaacccccaccctcaagagctacctgctgtcctgacttggatggaaatccttccttgctcttctctgtggtttcgccaccatgtcttgtctgttttttcagcttgatgtagatagaatcactgtttttgtttctgtgtgtcttgcttctgtcactcagcagtgtttgtgggattctatgttagtttcctgggctgccgtaacaaagtggcacagactgggtggcttccaccacagaagcttattatctcacagctctggaggctggaagtccacgaccaaagtgtcagcagcgttggctcctcccgggagctctctccttggcttgccgatggccgtcttctctgtgtcctcacgtggccgtccctccatgcatgtctgtgtcctaatctcttcttgtaaggacacctgtcagtttggattagggcccacccatatgacctcattttaacttaatcacccctttaaaggctctgtctccacatatagccacattctcaggaccgagggttaggactttaacatatgaattgggagcgcacatgattcaaccagtaacagattcattcatgtggttgaggatggtgagcctgttcatgttcattgctatacagaatcccgggtgtgaccattccagagtcaagttagccattctcatgttgtgggcattgagttgtttccagtttggggctgttaatgcatgtgttgcaccgaaccctattatggtccctggtgctcactggccactagcttttcgtctgtaagatactaatccacttgacagatgaggaaagggagcccctgaaacaggaagtgacttgctgggggccaacagtaagcatcagagcccaaagcaccagtgaccacatcatctaagaggctgagaggcttcccaagctctacaacgtggcaagctagggtgacccaggggcttcccaggcagtatgaagaatgctttgctcatcaggaagctgtccacagggaccaggtacagccttgtagccaattttaactggagaggagatggtgacagtgacatcagaggaggaaagggagagagagtgtctggaatatgagtctggttccctgtggttggggcgatgagaatggacagagttgtcacctggtgggagcacccttgggctgtccattggttccatctgtggctcaagaacagcagccagagtggaaacccagagtatgaaaagctgtcatagcaccctgtgattctctggggacatcatgaggccttggtgccccacaaaggggcaggaccaggttggggagcaggaagggtgcattggaaagctggggtgctctgtgcaggatttcttggaatatgccaatgaatgcatatacatacatatacatacacatagatatatgcattttatatttatattcatattggatattgtcactatttcatttttgtggcagagcacctctgtacaagaaataatttgggaatcactggagatgacataagtgttttattgttgttccaggacatttcaaacatacacagaagtagagaaaatagtttagtggaacccctggtacccaacagccagcttcaacaattatcaactgagccagtcttgtttcatctgtatctcccgctccacccctgttctttcgaagtaaatcccaaacatcatgtcatgtcaccctggaaatgatatttcaaccattgcctattgctaaggtgaaagcctccccaccccctgcccaatctggtgtggaggaagaaggggttctctatgagtctggcatcttttcctgtccatgtccaccccaggaagccagtccaagctgggaataggccatatgggaccagggctgcaggactgttcaaccatcatcaccaccacacgcccatacacatgcacacatgaacacacatgcacatatgcacaaatgcacacatatacacacatgtgcatacacaggcatgtgtgcacacatacacatgcaaacacatacacatgtccacgcatgcacatatacacacacatgcacacatatacatgtgcacatatgcacagatgcaatgaacacgtgtgcaacacatgtacacaccttacacgtacatatgcacacacacacacaactccaaagcaagacccctctgcttctccgagccacagcagtgaatgcaagacagggatggaagcaggggagtgagttctacccttcgtggcctccggggtgtccttgagcctctcaagcctcagtttactggtgtctatgtgaggatagactagtttcacagctcaaaggcaggcggtccttcagtgctgagaaatcttcatctcagagccaggccctgcctgcccagggcagtccagacataccacagaggcaggggatccaggttttgtgaaactgaagctgataggatctgaggtcgtctttacaaaggacaccaaattgtcagaagccatcagggacggggcctcagagcagccaggcaagtgaggggtctaaagcaccagcttgggaagcgtcactgcgtggagagcgggctcctgggctcatcgcccgaggcacccgacacaagtgcagcctacaaaatggagagaaaagcccttgatgaatgaactccctaaggccaggctcgggttccttagagactgggggcacagctgcacccgggcagggtcggggagacagtttgcagcctctgggctgaggctggggtgggggtgtggaggggctgtggcaacagcatggcgtacgcctctgggtgtccttttgcaagtaggtgatgagagaggcacattggctgagggaaactggaggatggaagggggttgaggcaggggaactgacaggagaggaaagagccttaagtcaaacaggaccgcggaaaaccaagcgtccacaacgagaacgaggggtccgtgcctgacccctggcggggaggcgtggtactgctcgtggtaggcgcggactcggggaaccgggagccccccagcctgccgcgaactctgctgggccccagcgtcctcatctcccaaataatgggtaaggggcggggtaaggtcatggtacccaagtagctggacagacgcattttataaaaacatcaagttcatggaaaagcgtttcttacctggaaattcttacctcctaaattgtccttaacccttgacatctgctaccacttgcctgcgggaaaacattaacctagaagacaaaataacaggtgtatgtaacaggcagcaaatgactttgaacagagcccctgggcatagcttattacggtgtccgccatggacatgggtacttgcagctgtgaatggctatctgcttgtaggagtaagagataccctctttagccagaaaataaagcccctagtcactccaacgagactagatttctcaatagtccatgacaaagggtccccgagtgaccagatgcccaagtggggacctacatgattgctgagaaactgtgctgcctgccgcagggctctgtgattccctggctgagttttgcaggatagtggggggatgccaaggtcagagtcagatggaacttacaggggaggcttccaaaagcatggaggttgagatgcagggaaaggaaacttgtggagggagtgctgataatgaagaacagaattggggaacttttttcaaagctttaaaatgaggcccaaatcccagtcccgttttttgtctttgtgccttacttctcgtgtgtgtcttcatgaaccctccaggtgccttctccctgtctgtgaaggatgtcaccacccagggggagctgatcaagcactataagatccgctgcctggatgaagggggctactacatctccccccggatcaccttcccctcgctccaggccctggtgcagcactattctagtaagagggggcgtgcaatgggggcagggacttgtgccaagagcccctggatctctcgctaagattcccaattgtgtgagtcattggtgccaccttgggggatggaaagattatcccaaagttaggcctaaggaggtagcaactctgagcaccgggaattggtggccctaattccctctcctggctcagcagggaaccccttagagagtagcaagcattttcagtcttagagtgagcaggtcgattttagagatagcatgccctgctttgcgcaaacgaagagaaagagttgagtgtgtgtgcatgtgcaggcgtgtgcacacacccatgcagggggtggggtggctggggagtggagggccagctaggaatgatacagctcccaaggtagagcctggctgctctggtaacccccagccctgtcttttcttccctaatgcagagaagggggatggtctatgccagaggctgaccctgccctgtgtgcgcccggccccgcagaatccctgggcccaggatgaatgggagatcccccggcagtctctcaggctggtcaggaaactcgggtctggacaattcggcgaagtctggatgggtgagtgtgtgcacacgtgggagcatttctccccccattccacctgcgccgcatcctgagtccaggttcagcattttcatagcgtgtcatccctcccccagaagtcttgagagggagcgaggacagaggcgaggacactcattttacagaggaggaagtggaggtgcagagccgcgttgtaacagctgggaccgcttatggtggtggcagagcaggaacagaatccagctcacccagccccgaagtcgctccctccttcgttctctgcctgaagctggctttgacaatgagctgcagcggcgcgttaactccccttagcttttcatcacccagatggaaacaggaggttaaacgtgatgagccatgatgttccagagcctgagtgcacaccgagggcagccgtgggactttggccaagtcactgaagctccaggcctggtgtcctcacatttccatcgctgctgacacctgcccccttccccccccgcccaccaggatataaaactcgtgttccgttttatccctggattggtccatgagtcctcccttacctggggctggtccatgagtgctcccttacctggggctgatgcccacggtgcttttggcaggagctgtacccaggtccctgccaaggcccatgtcctctagaaaagcaagtagagttgtcttttgcccttcaggggacttcatggagtacagggagagtgtggagatacagatagtttaaggagtgggacaggatcgccatggggcttcagaaggagggaaggagacccccatgcgtcatcctcctgcccagtgtaccccaggctgtgtgcttatttccaccaaggagttattgtgtgatagaagagactcattatgtaggggaggggtgggggaaggacacaggttccgtgcaggacagaaggacacaggcccagggtgtggggcaaataggtgaaatgccccccaggcagggtacattcctccactgcctgaggccccatatagaagggacctggaacgcaaggtacgcaccacacaaccatggcctccggaactgcatgttccagctctggcacctggaatggggtggcacctgggcacttaccccgattttggttaagggatcacctccgagcaagctctctgtcttctgattggcttcttcactcccccgggctcaggttactacaaaaacaacatgaaggtggccattaagacgctgaaggagggaaccatgtctccagaagccttcctgggtgaggccaacgtgatgaaggctctgcagcacgagcggctggtccgactctacgcagtggtcaccaaggagcccatctacattgtcaccgagtacatggccagaggtggtgccccccgcagagccgcatcctcagagcgaggcgggagggccgggcttagcaggaggaggagggtccgctgcggtgggttcaccaggccagggggtcctgcagatctagggcatggcacggtgtggggacagggagggatggagggagggggagggacagagggagggtgagaaacaggagggtgaagtggttctgacagagccatgttctcagcccaggagcagttcagacagcatttctggagtgcatcttctgtgcctagcactctttgatgcctgctgggagggacagagcattgcaaagtcagacgaacaccaggccaggcatgcagggacagtactagatccaggtctcctgcctcctggtcatgcaaccatttacaactgtgtgaatattttacaaggatggccagagaggttgggcttgatggcctctgaggtccacggcgtggccaagttctcatgccactttctcaccctcctatgaccctgaccgcacactgctcctataggatcctaacatgcccatgttgatatagctccctaacaactgtcaccaaggggcccccggtcggaggctgtgctgggggtgcctctagcctgcccctagggcaagcatccatccctcccagctttctgattccagggggagctgcatttgtcccctgcaccaaacctgggggacagttctctccattctggtgctttcttgctgatgcctggtcctcagaggcagagggtgtctgccagcagggatcaagggagcgaggccaacacggggggaaagacaagaaggggcatgaaacttcgagtcagaactggggtcccactcgcagctcccggctgggtgacttcagacaggtccctgcacctggctgaaacctaacttctgggcaactgctggtatattggctgcctcccggggtgctgagactggcattttgtaaagtggaaggcactcggcagcagtaggtagatccttcctgatgcaccgagagatctgagggtgcaaactcccacttcccgcgcccatggggagccactcacaccagagagaggctggcaccaccaggggcgggtcactttgcagaagggcacttgcaacttctcttttcttaggatgcctgctggatttcctgaagacagatgaagggagcagattgtcactcccaaggctgattgacatgtcggcgcaggttggtgaagtaccaggtgcagagaaagggcggcatgtgccacctgctgcccacaatggctgctcgtgccttaccaccccatcctctcagccagcaggagaagtcagggggtactgaaggccaccttcctctaggcagatatccccaaggtcacccactgcacttggacttgcaaaccctggccactgtgcctcctgccccacgcagctgtgagggagcccagggaatggagccttagacccgggctgctgtgttggaatgaggctattctgttccgaaggaagagagggcgaatgaatgtcatgggaaacacacagagttagcaagagttccattgaacccggcaggcaagtgtgttctgttgtgacctcatctcttccttagatggtgcccacaaacatctcctgtaggacttcccatcccaggggccctcagcctttgcacagccctggcgtcgaccccaggctgatgggcaggcctgagctacacacagatgccagggacatgacttctctgagccctggaggacagccccaccttctgccaccagggaattgcgagtgctggacctcctcggctacccaggactggtcctcagtgtccctcacgttcacatgcagaactttctggactccatggggtgaagagcagagtggagaggagggttttagccgagagctctagctggcaggaagcacatctggtggccctgttaaaactggaactctcagcagaaaagttttggtctgtggtcagcctgtgaggcacacacgtgcgtacacatacacacacacatacagctgccaccgagaggaaacgctcccacccaccgcccacatcagccctcccacctcgcccctcgcccagccttacccagtagcgccgctgcaggaactgatgccacaacgcctttttccgctgaggtgggcagacagccatctgggcaggctggttttggaaaatgagtgctggtaaccggcttcaaaccccagggcagtgataagcctgcccactgctgctgcttcctttccccttccttctctcaccctccgctgtctcctattcaatccccactacacccccttgggaaatctcgtgtgacccaggggcaaaggatgtgaaaagccatcggagtttaatacctggatgtagccacagaatcgggggtgaggagccagaaaatcagaacttcccagaagggcagcctctaaccacatgctgaccatgccaatggctctctaagcacacatgtacacacacacactctcacacacataaaaacacagactcacacacacacggacaaacacaaacacatacacagactcacacagacacgcaaactcacacacagacagacacacacacacacacagacacacagactcacacacacaaactcacacagacacacaaatacacagactcagactcaaacacaaactcacacaaacacatttacacaaactcacaaactcacacacacaaacacacacacaaacacgcaaacttacacacacatgagcagacacacacccggcccttctgggctcttcttttcttactccataggaagccatgcaaagtctcgccagacctttcttccaaggccagatctggccaaccccacaggaaccctgcaatcacaatccctcgggccccactttgcagccagatgccaccggttcccatgccccatgcctcgccacccctctacctcctctgcccaggaagccttgaacacttcccacctggcagaatccttatcatcatccatggctcaagcgtaatgtcatttctatgaaggtttccctggacaagaaactgccagagagcccttagctcaggtgttcccggaagcactgttcttgctcagcagatctgggcagcttcttcttgaaagcagatctgggccctactcaacattttttaaaatatatttctggtactgctcaataaatattagttatcagaacgagtactgttagatgctgcccagatatatttagtactcagttttatattccccacagtcccatactagtaaatgagtattgattgcatggtgtaccaaggggatggatggatgcatggatgggnnnnnnnnnnnnnnnnnnnnatggatgcatggatggatggatggatggatggatggatggatgcatgcatggatggatgaatggatggatggatgcatggatggatggatggatggatggatggatggatccatggatggatggatacatggaaggatgcatagatggatggatggatggatacatggatggatgcatggatgtgttgatggatggatgggtgggtggatggatggatgcatggatggatggatgcatggatagatggatggattcatagataaaccaacaaaatgcaagcataaggagaagtggaatcaattctagtgctggcttcttgaagtcgcatgtctgaagaggtaaatggggtctctgctttctgcctcagtttcttcgtccattgattgggtgaataaagccttagtttcctcagctaaaaggtgccaagtagcaccagctgctatccctggcccaggctggtgatcaggggaggagagacaagtctcttcttcttcacagcctctgtccacctggatctgccagtgctccctgggtgcccccacggggcaggcgctgggtgaggttcttggtcacaaatcaacctcgtctaatgcttgcctcaaccccctgccctggagaccacatccctcatgttccatgtcaggactgtggcccctcggggaggttaagcagcttgctagaggtcagcgacttcccgagggcctccagctccaggagctgtgcttccagccagccagtgagagctgcctgtccttgcctcctgctccccctccccctccttccttaccatttcttctcttctccctccctctccttttctcctgcctgtgttcttctatcttccatctctgcagacccttggacacagctgtgtggagcgagaacgaggagggggaggggcacaggtagcccctgtgtctctgatgcccacgttgctgcgttgctgttctgggcttctaggagaggagtttattcggctgaggagcaacacagtcacctttctactccatccaagaaacagctccttccccagcagcccacaggggctgtgcgggggacacagtgtgggctcggtcttggcgtggaggcccccaggctgtccttcaccatgtgcctgttccctcagattgctgaagggatggcatacattgagcgcatgaattccatccaccgcgacctgcgggcggccaacatcctggtgtctgaggccttgtgctgcaaaattgctgattttggcttggctcgaatcatcgacagtgaatacacggcccaagagggtaagcacagcccctaaccacaagggaaacctagggccttatctttcccagctcctcaaagccgcctttaacttctcccagcacagccctgagggaagacacctgagggctatacggtttctacagctctagatcagcatttccttcatttacccaaatgtgttcagcagaatggtagtgccctgagacctcccatggaggaacagctttaggataaggtaggtttggagaaacagcagtccaccctactccctgtcttggagattcccagtgcacatcaacatattaaaggcactgagaagtcctgcagcaaagaaacagtttatgtttgcctcacctagtgcctcccaaactaatttgagctccaaatactattttttttttttttgagatggagtctctgtcacccaggctggagtgcagtggcacaatcttggctcactgcaacctccgcctcctgggttcaagcaattcttctgcctcagcctcccaagtagttgggattacaggcgtgtgccactacacctggctaatttttgtatgtttagtagagatggggtttcaccatgttggccaggctggtctcgaactcctgaatttaggtgatctgcctgccttgacctcccaaagtgctgggatgacaggtgtaagccatgcccaaatactatttttatatagtccctattaaccttccatggaattaggctttcacagagcacactgtgggaaacacagctctcatgtgcgatcagcaaaccaacctgtattagggtgtccacggagcactgttttactctgtgcatataactgaggtggaaatctacgtcacaagagaatctgaaggggtcacatatatttatcaagctagcaagcagtgtctgctgagcctatgagtcagatgacaagcagacaggatatggcttgttctctcgggaacttcaggctggctggggagaccgagaaatggaggccaggggaggctgtgaagtgccaagccctgaggtctgctccaaatgctggccggggctgcagccattgaggtgcttcacagggcagccggatgtgagttcttcctcatagcggccctcggaggtacaagtgtcaccatttccattttgcaggaagggactaacggaggcgcccgcaggtttaaatggcttgcccaggccatgtcttttaaattaaacaaggcccctgtaaggtgaaacaggccccttccatcccaggtggaaacgtggtggctgcccattgaggccatcactctctttttaaagaaccaaagtgggtgactgtgtggtattggtgtccatatcgtctttctgtgctgctgatgccgtgtctgcactcacctggtcatgtgtcctggtgtgcggtagtggctcccccgccatgcctggccgccccgccctgtgaggccccgcagtgggggcttgatggaaggacagcaggagcaggggtaggggtgaggatggagggtaggggccaccggccgtggcctcccaaagcttgcatggcttttcccacaggggccaagttccccatcaagtggacagccccggaagccatccacttcggggtcttcaccatcaaagcagacgtgtggtcgtttggagtcctcctgatggaagttgtcacttatgggcgggtgccatacccaggtaggtggctcaccccgcagctcgcggctccctgctttcccggccggccctgatggcaggtcgcctgtgcttggtgcctgtggctgccctgttcttttcagagtgagtcccagagcgaagacggagacccaggcatggcatctggggtggagctctgccccctgcatcactattgctctgggccacagggctgtgtctccttcctccagcagaggtcaaatgagtccctcaaactgaaatcaagacaaagggcacatccgaactcaagtttactcccaatggcttgttctcagttgaggacaggttgtgcctaccttggctttgcacccatagtggattccccaaagccccttcctgtgtggccagaatcgtggacgacagcccccagccccagtcgaagggctccagccacttggcccccacaggtgggcaggctccgggtcacctgctgctgtgtgcacctggcagctgcccatgagtgatgggcttggctgtgcccctggtggtcacaggtaatcaagagagggagggtcccatcttcagaggacctgccccgtactcaggagaaaatctacagcctcatttctaggcattccccaggcaataaaaagtaaataaagggctgtttagagaccgggcagccaggcaacgcacgaggctggagaagtggtctgggactgtgggcactgctgtcccttgcccgggcccactgtgccccgcgggacgctcagggcccccaacccaccgaggaccccagcccctcatccccgcttgcggtctcctctgccgcagggatgagcaaccccgaggtcatccgcaacctggagcgcggctaccgcatgccgcgccccgacacctgcccgcccgagctgtaccgcggcgtcatcgccgagtgctggcgcagccggcccgaggagcggcccaccttcgagttcctgcagtcggtgctggaggacttctacacggccaccgagcggcagtacgagctgcagccctagccggccgcgcccgcctgcgccccgtgcccacctctgcgcggacgaccccgacttccgtgccatcccagacgggccgcgaaggcggggtgtcgcctgtgcccttttctcagacccggaatccagtgggcagaggcagcttcgcagggggtccccggacggactccttcaccgactgcacccccgggcgagttacgcggcctctctgtgccgcttcatttgtagagggctgtaacagtgacctcgcacggtcatccggagtactaagccccagtaaggtgttcaggactggtaagcgactgtcatcaagtaaggcccccgtgctgggcaccccccgtgctggccgcgtccccgcctctgcgccctgcgtggaccccgccctgccccgctacagaagccagactgggtcccgcggacgccagcaggggcaaccccagcctaggctgcgctccagcactgcggggcttttctgcaataaagtcacgagcgttcgagctgttccgtgtcgttacctgcgacaagctggacatcgcgtgcaggacgagcacggggcgcgggcgtggcgcagccagggagtcccgcgtggtctgggctcccggcggttgagcggggcccgcagggggcgctgtggcctcataaatccgtggctcgggcccgcgccgggagctctgggccgggaaaagccaggggctgacgctgtgggccggcgctttggggacggctaggacgcgagcccagctccagaggctccgagtccccaggccaggtgcataaacaaggatcgggtgacgatggggcgtaaaagcgaggaacgtcggcggctcccactgcatggaggctcttcacttggcatgtttttgttttgtttttaatagaccgatttttttttagcagttaggtttacagaaaaaaaaagtgggaattaagtagacagtctccatatctcgcccatttcccctattactaacatcgtgcaatggtggtgcatttgttatcactgatgagccaatactgataaaatatcattaaccgaagcccaccttttgcatccaggttctcgctgcctgttgtacatgccgtaggtgtagaggaaagtgcagagacttgtacctaccgttctgggtcccccacttgaaagccccctggctccacctgtgcacccgcttccttccccttgaacccttgccacccagcttgtcagtgttgactcctctgactgtgagaacaccccgaggtaggactatacccacccgcagtacagaggtggaaactgaggcagaaagtgctcacacacacccctcttaagcggtaggatgggggcgtaggtgggggaaactgcaggtctgggcagcagaggattagagtggggacttggtgggagaacccccagaaagggggcagtcgctgcaggggtgctgggtgaggacagccaccagccaggaaggatgcggttcacatagcgtgatcacctacagtgtgtggattctccagcagcctggggtgggtgcatcaccattactaccacgaagctgtttctgcagatgatgaaacggacagactccatgccaccaggctcctctcagccagttcttggccctcacagcccccactgaccgtgggcaagcactggatgggagcacagcactttaaggaggtctggggggggcagacctggggcctcgctgaggagcccagagggacaggtgtccccagctgctccaggatgctggaggtggaggaacctagaggtggaactctgtcccatacagtggggctccagaaattgtggggcctctgatctcccccaggacctggtcacaccagggtgctggaaggaggaaactgcctggccaagaacctggtgccaggggacgtggctggtggggggtaaacaggagcgtgggacaacaaggtcagtgggggctcctgctagtgggggccactgggactcatgaatgggagggccaagctgacctgctggggctcctgtggggtggggctgaggagggagctaagatcacgggatgaggaatgagcccttccttcacctcatgagcagggaccatatgccaggacaccacctccccggcccctgcagcccctctgaagtggctgccatgactcgggagctatcctcgagttgcaaggcttgagactgtctcctcacctccctggaccccactgtcattccctaaacatgagtcacccagtgctttgccaacgtcacctcaagtttttgttttaaaatgcaggctgggcgcggtggttcatgcctgtaatcccagcactttgggaggccaaggcgggtggatcacctgaggtcaggagtttgagaccatcctggccaacatggtgaaacccgtctctactaaaaatacaaaaattagctgggcgtggtggcaggtgcctgtaatcccagctactcgggaggctgaggcaggagaatcgcttgaacctgggaggcagaggttgcagtgagctaagatcgtgccat

SEQ ID NO: 11989 - DNA, 158735 bp, Human
atcagatatttgtagaaataaagactcttctaaatgaccacttgtgtctgggccaaggcagaactagaaagaaggactcagtgggtagttggagtcagtggtggtctctatttacccatgagaaatagattcttggaaataggataggaatgcttataagatttggaccaacagaaagcctatgatctcataaattcatgaatcccacagtctataatctatttgacttcactctcaaatgcctaggaccatttggactaaggctggcaagtcagaaaattgcagtttttattttcaactccacacaattttcaccaagtaaaaaaccttcatgttttacgtgaatttgcttctacgatccatagatgactggatgttctcgggcggggtaaaggcaaatgaatttgtgtcctcattggcaaatggtgttggtggtggtgttatcttgtctaaaatccacaggaacctgtgtttcaggaccctgtctattgtcctgaccattcagaatgcatgccaagcccctgctcttcctggagttatctttatcacctctcctcaagttttatcttgcaccatataagtcacattgtatttcaatattaaaatgcaacattaatagataagctggagaatcaagacatttccaagaagacaggggacgccttttctaatatatcgtctgattacaccctctttcttttgggtgctagcttaagaagccaaaccaaagcacaaatgaacagagaagtcaacacatccgaccccaaaccctcaggacgctggcttgggttacatgtggccctctctgtggtcagtttgtgagtagcctccccggagggtgtgtcccaacttccagcagctgccgtggaaagccacgtgtccgctaaacgcctacattacatcaataagagaaactaaggaagggatggaaaagctatcatttttcttttcttcctcagttctggcagtatagtgatttaatcgctgttattatttttatttagttaaagcatcaacttaggccttttaaatgatggtaaaagagaaagcttcagatcggggtattggtcagatcattcttactagcgatgacctcttcgcctttggcacctcgcggctcttcgcatgcctccaagaattcccgggtcttgaaacctacgcgcggcggaggcgacgcctctcgggagagggagggtgaaagaaggggcggggctatttaaatagcccgcgagcttcgcgtccccattggctgccagcctgtcggttaccgcggggcggggagtcccggggctggagtgaggtacctgagccgggcgcgcagcagaaagcccacgttggccgctgcggggagcgcggcgtggagaggcgggagaccgaattccggcgccgccgccgcggccgctgctcggtgcactagcccccttccttcccatcctttctgcgagcgggtttgctgggcagccgggcgaccgccgaacggaaagcaagatcctcgccgcctccgcttgaggaggcgtgcggcgcgcggagattttgagtgggagcgacggtgcccgagagctcaggggcgcggagttcgtgagcgagaaggaagttaaacctcgcggaatagactggcatttcgggacgccttgtcgccgcagcctgggccctgcaacggggtaaacttcatggtggccctgcgatctggggaggggcgtgcgccacggtgatgccgggcatctcccgcagctcgtgagcggccccgctccccgctgccccgggtcccactcagtcgccagggagagcgcggggcagcgcacgtgtgcggccagcgaggcccagagtgaccgcgccgcgactcgcaggagccagggcgcaggctgcagtgcagcccggactcagacgcacctggcctggaccgcgcgcctctagagacctgcgcgaggctgtgaggctccccttcctcccctccaagcggttctcctggtgatcgccccttcgccacctctctagcctgggcaactgggggcgccccggacgaccatgagagataaggactgagggccaggaaggggaagcgagcccgccgagaggtggcggggactgctcacgccaagggccacagcggccgcgctccggcctcgctccgccgctccacgcctcgcgggatccgcgggggcagcccggccgggcggggatgccggggctggggcggagggcgcagtggctgtgctggtggtgggggctgctgtgcagctgctgcgggcccccgccgctgcggccgcccttgcccgctgccgcggccgccgccgccggggggcagctgctgggggacggcgggagccccggccgcacggagcagccgccgccgtcgccgcagtcctcctcgggcttcctgtaccggcggctcaagacgcaggagaagcgggagatgcagaaggagatcttgtcggtgctggggctcccgcaccggccccggcccctgcacggcctccaacagccgcagcccccggcgctccggcagcaggaggagcagcagcagcagcagcagctgcctcgcggagagccccctcccgggcgactgaagtccgcgcccctcttcatgctggatctgtacaacgccctgtccgccgacaacgacgaggacggggcgtcggagggggagaggcagcagtcctggccccacgaagcagccagctcgtcccagcgtcggcagccgcccccgggcgccgcgcacccgctcaaccgcaagagccttctggcccccggatctggcagcggcggcgcgtccccactgaccagcgcgcaggacagcgccttcctcaacgacgcggacatggtcatgagctttgtgaacctgggtaaggatttggggtaacgtaatgacgagaacatttcccccttttcagtgtcccgggcccaggggatggagtgagggggtggaggagctcccggcgcgcgggtcccgcctggtgcgccagagaacgcggggacaggcaggctgtgctcccgccacctgcgcggcggtgggcggcacatgcgctcccccgcgccgcgggcagggctgcgcgccgaggcccccagaggcggctggccggccgggccgcggggctccgggagcgctgtccccagcgggcgtgtatttgcggactccctgagcacgttccgcgctttttttcacttctgcccagctctggccaggttaactcaactgcagcaggagagtccagcccgagtgtggccatcctgggaagagggctcttcagtacgattttcccctctaaactgccgccttttgccccctaacttggagtgcagttttcccaccgagacttttagggaatccgacagcggctgggaactttgaaaacttggcatgagtatgtttagaggtatccacggcactaggggaggttgcagagggaagtcccaaaaggaccgcggaaggcgctcggatcccggccgggcggggctcgcttctgtttggggcgggatgaaagctcaactggggtaatccatcctgtgccccggctcacatgcccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctgggtgatttctttaccagcctatctatgattcccaactccactgagctttgagggagagaacatggggggtaagagccaagggagggtgtggaggcagggcgattggcatccaagtggtgcagaaatcctcctgggaaattcgtgaaacagaatctcacaggagtccaggctcagggcctgccaatctggctgcttgcactgcccggggttctgattggacaagaattttcacaatttattggaaccaaatccaaggttgagccacctccaggaagcattctaaggaaattctcatgccagtcaataaaatttgtagtgggtgggggccagggtggcagaggaccagcgctgttccttattctaacttttctgctgcttctgacttagtaaattcctccccttgctctcttcctctcctctccttccaccctcaccccccgcccccaccccgcctccaggtttcctggcagctctggggaaatgttttattgccttttgggggtagtcctaacctggacaaaggggaggaagactggcgctcctggctacttcacagagaatcgtgttacagtccctgggaaaacaattcctgggcttgaaccgaggttctcagcattagctgccctgtagtatcacccgggggacttagagttctagggttattagggccgcttcgtgggcccagatcagttaggtcagaatcttttgagggtggggcacaggcatcattttttttaagtaccttaggtttttctaatatgctaccgtggtcaggaaacactggcacaggagatcccaatgtctgaaggaaatggatacattgtcccagtaagagatgaagagcaaagctttcaaacattgctacacattagaatcacgtgggtgttacgtgggaggtaggggggaacgccttaaaaaaacccagatgcccaggtggcactccatatcaaatcagaatgtgtggaggtggaaaccaggtagcagtatttttttgttcaaaaataaagaggatctcccaacgttgcccaggctggactcaaaactcctggcctcaagcaatccccctgcctcagcctcctgagttgctgggaagatagaagtgtgccaccatgcccagcagtgtcattgttttgtcaagatctcaggtgatgtcagtgtttggaaaccactgccttagatggtatttgaaatttcaagagctgggcctaaggcgaatttgtaaagtatagtcatatttactgtatttagtgaccctccaaattccccttattccttgcttctctgacttttcgtgggctacagggacacactgcctctgagtcacactgcttaaagctggctgtcagctaatccttgctagggtgatggtttaacatagtatctccctagggatattgacatttttcgtaaaggattttgaaagatctaaaaaaatcccctaaaaatttttaagagaactcacccagtagtgcaattccaggccccaagacaggctgacacagaactgaaagagaattctaggatgggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatgtagcagtaggaaaggggtatttcatcatcagaggctagaatggggtaaaatctgattgccatgactctgaacataggaaggacagttcatttgaacaaagttattgcgtaccaatgttggattctctatatagggatactagagaattacagatttcctaattgctgtcaatgccatgttaactgccacattacctgactcatctattaaagaatctacagaaagataaacatgacagcgctgcgttttaaagtacgcttatacctactaggttaagtaaattacacactggaagtacaagggaaagtattacatagttgtaaacatccgacttccctgggactgggggaataatttactcatgaaatacatttgaaacaccccgagccttgtaagccagccggactatcaggaagtgtgaatcaacaggataaatttctctctcatagcgcaagtgctggtcatccaaccagctcattgttgtttatgttgactgtttcaaactctttctgggtgaataggctgggatgtgtcaccttctaaatgctaaccgtctgctgcctgggctgctggtgtgcagagtgcctgggtgagcgagctcgtgaacttgcattcactcagggccacagatgccattttctatttgttttctaatgctaaaaatgtcttggcagcctagtcagcatccctgccaatttggtgaccttggagaggtatccttcaggtcttagcttaaaattcacctaagagagaccttctctgccactctatataaactggtcatgcctccatcccacccacttctgtaccatgacagcactctgcttatttccttccttgtacttatcacaagtttttcttttttcttgttaaatttgcttactcatttgtttgtctcccctgtaggatgtcagcctccaaaggcggaaaccacgctaacccaccacagtagcccaagtgcctaacataatgctgaccacatggaagatgctttgaaaaggctgaattagtgaacatatagacatagcccatgcttcaaattcatatttcactgatttggaagatttgattatttagaaagggtatacctgatttttattgagtaaaatgtttacagtgaagacatttaggacagggaggttcacagtatttgaggtaaatcatcgtgctttattaatacaccttttttattagtcacccatatgtatattaatttgtaatatgcattacatttgagagtagtaaaaacatttaattaaatatctgcatttcagatttcacttgtttatttgaattcacgaggtatttatctccaaatgctaggattaaatggcaatttaaaaaactcaaattgtgttcagaaaagggaatcagtatatattagtacaagcagcaagaaacttgtgctaaaaatactggcaattttctgaacaaaattactcttgggaaacataaataagaagaaaaatggaatactccctacttgtatttgtaactagatataatgcgctatctctttctcctaaacatagcatcagtagtactgtttttcatttaagctacctgtacttaagaagatttttgttagcagaaaataaatccatgcctgcaagctactcacagcaaaaacagtttggagaatttggttgcaagagtgtgattcaaagaagcagtagatgttcttctaaagagattacaaagagtaaatttgaaattcagtggcatttcaacaaaaaaaagttgtacaaagtgttcttaaactaagatcaaagggcaagcagatactattgttcagacctcagatggtgtttcctctgggtgtccttctaagaatgggtataaatcctttttaaatgtgctgaatcatggttagttcctctatttgagagcttacctctgatcagcttggaggagggcttccctgggataagaatctgtttaaatacaaaaacaatgctcagtgcttgctttagcatataatttgttgcctctctgtgtcttcagagagtaactactttatatgttggatttcaaattgatattttacttgactatgaatactggctaaatactggctatcaaatgtagtatatcaaacgtagtatatcaaacgtagcaaactaaaagatagcagctctgctgtctttgcctcactcctatttacgaaggtgagttagacaaggaaaatgaagagggtacaatgtcttgcatcatgaagcagctttctgtaactttttcacaaaccaatccttcactttctgcttcccatcttatatcaaaaatgaactattctagggaatgatttttttttttttttaagacagtatctttttctgtcacccaggctggagtgcagtggcgagatctcggctcactgcaacctctccgtctcctgggttcaatcaattctcctgtgtcagcctccagagtagctgggattacaggtctccgccaccacacctggctaatattttttttttgtatttttagtggagctggggtttcaccatgttggccaggctagtctcaaactcctgacatcaagtgatctgcctgccttggccacccaaagtgctgggattacaggctcacgccactgcgtccggccaggaatgactattgtttaacttagcacaacgtcgttacagttttaatttttctacttcgatctttattctatttttcttcctcttctgttcagaattttagtcattttgccatctttggtgcttccagtagtgggaagaaaagtagacaatattttaattagacaattttgtttttcactagttttcataaatatatgagtaaaaggagtagaaatcaccgcagaaactccctaagataggaatagacaatttaccaaggccccattcacgtaaacagctgttacacattaaccatcctgtccccccctccctaggccacagcataacccagccatgtgcccagcagctgggctgctccagccgcagggtgtcacctggggggcagatatagggcatagctggcatcttctcttgtgttccccgcaaggaaccagtgcattatgttgttcttatttccctgttttcatcacgacagcggagttaactttattcaaatacactttcttttctgatcatacccttaccttctcttcaacaccctcactcccatctctgatccagcttttacccactggaaacgtgtgagtcggaaaacggcactagtctctcctggaatatatgaaagtggtgatagttgtatgaaggggaaggaaagccatcaccacttcggtgaaaattagagttaactctaatttttcagtgccattaacctctgaagtttcgagagtaccagaaattctcagaacctgcattccccctgttcaccttttactacaagcattagaaatcagtaacacattgtgggtcactgaaatttatcagattttgtgttcagtcactagtgttttgaagattttgttgtctatactttttttccaatgtgaatatgtagtatttcagcaccctatgcataaagttaagggtctgaagccaggctgggaacacagctaccatccctaacatggtttttctggggacacgtatgccccagcaacagaaaacccatttggggtttattggttaaatgagtttgggataactggtgaatgtatgttcgccatagatcatagaatttagagcttgaaaagttctcgcatatcatctaatctgtttgttcgcagttaaatttgttagatgttttcaccaccattttctctttactgctgttacctcttaagattgagggacaatccatgaaaacacacagagatcctagtgcatcagagcaatagggctgttggccaggctggagtggataatgaaggagaaattacaaaagcaggcaagagcacaaccctggaagagccgaggaaacccaaatctggaattgttggggttttctcttagtggatagcatcttctccaagaactctacttttagaaaagaaaatgctatgtatatctataaatgtccaaaggactgttgactccaaagaattgttttctgctccgaaattgagttgaaaaccacgttgctctgagtggcattgttccactgatatccactgattctcttcctgcccttcccatctccattattaaggagattgggaccataatagagatgatatctaaattacatcagttaattccttgatgggtccccacggtctcgttatctcaagcacagtcccagatgactgggtcgaagaatctccttcaaacatttttgcaggatgaggttctggttccaagtgggagagccttcctgactttcagatttataggcatacgcccttgatgactgatcctcctgctggccaggtcaggattgtcctaggcctaaaatgtccttgccacacagtgccgattatatgttcagattgttttcatatcaccaaagagctcagctggccacggggggaagtggagtggagtggattcacagggcgcagaaaacagtgcccctcggaggcagagccccggagcccgctccaccctgacctccgatatccgccacgggccttattatcactctcctgccgcttgccctttcaccgtccagaacgtctgcgtttgttgattgttgttgctgtgtttacagtcctgttggtttcctgtacgtgaacatgggctggaaaaaaaattctgatttgtgtctcagcagagcatgagtgaaccatatcattggtaagagctgattaggccaggagatttcttataatattagccttgcttattctctgagaccagttattttccctccctccttttgaatctatgaattacatttaaatagtccaaagactgagttttgtaaactacaaaattaaggactaaaagtttttacttaattttgatttttattcagattttatttgtagactcccatatcggaataagttaacaacggagaagctgtacattttttagaaagagagggtttttttttaagatcagtttgaggttcacagcaaaactgagcaaaattttgcagagatttcccaggtaccccctgccccacaggtgcacagactcctccattatcacccagcagaatttggtatctttgttgcaattgatgaacttatatggacacatcattgtcacctaaagtctgtagttacatcccggttcactcgtagtgttgcagattctgtggatttggacaaatgtgtaatgatgttatccaccgctatagtatcatgccgaggagttgtgaaactactctgccctacaaatcctctgtggagaagctgtacattaaacaaggaaaaacaagtcaatgaaagtataaaaattcaaaatacgcagagttcggggaaagaattataaaatacctcagttgaagaatattttgtttctggggttttactaaagtggtccctaaggaagtaattttgatagtctatgacaatgtgggatttattttatagtgcttctatgtgttgacaacaaatccatcagaaatctttcttttttctttctttgtttttaagtctaggagtttaaaaatcttttttcctccgcatagtttcactgaggtgtctgtcaccatagtacctagacaatccctcaggcagagatatgagtgattaaatttctccctggcttgtgccctgtttgatccatgctaggcaggatttgggggagtaaaataaagaagcctgaagaatgaacaagaattataggaattttgtgcttgtgaattattaaaatttgggggggttattaggggagaggttaaatatttttcctttctgaaaacttacattaaaacttaatgtgactttagaattgagaaactgacaaaatatcgtactggccctaagggcaggatcagaggactttaaaaggcttcctcaggagagactatttagatcagagtaaaactaaattaacagagactccatcaattcagaggtctttgtaagtgatatatcgaataggcttatttgcctttggactgttttctatgacaaagctacacaggttaatggtaaataaatatgagaatacaataatggagacagaaatgtggtaactgaagagcagttcgtttgagggatattaggggtttgtgtttattcctttacaaatattgtgcaggtgagacatttagtgaattctctccatctctcttcacgtcagttactcattgtagtggggtattactgaattccagctaatttgcccgcccgttatctcccaccctattctgctcccttacagaggaaacctcttaaaaatggggaagagggccgggcgcagtggctcacacctgtaatcccagcactttgggaggccgaggacggtggatcacttgaggtcaggagttcaagaccggcctggccaacatggcaaaaccctgtctctactaaaaatacaaaaattagccaggcgtgggagcacacctgtaatcccagctacttgggaggctgaagcaggagaatcgcttgaacccgggaggcagagatttcagtgagccaggactgcaccactgcactccagccggagtgacaaagcgagactccatctcaaaaaaaaaaaagagcttggggccatggcactgtcactgggcttgagaaattcagccttgtctcataacatctgacttaggatgtcctgtggtttaatacttctctgtgggaggataggtgtttaatggagcaaaaagagaagtgatatccatgggcaggactaaggtgtatgaagggaagagtaagaaagccataggtgcctggagccaaagatatctggagagttgcctttccccccatggagaaaggccatgcatggagcaggcctttgcatttttatggggtctgtttagggcagagccttctaacaccaactcttgatttgttgagattgtttgaccctgttgttatgcatgcacatacctgtcatcgtaggatgatcccacgtggctgcaggggtgaaggaggtatccagtggatgttagagtccctttctgtcttgctttccctttttttttttctcttcttttcctcccattaataaaattggcaactccattgcacttatttccactttcgtatgtgctcttacctatagttttggagcctttgctatggatctagcagagcagattatacacgtccatggagtctgggagttttctaccacagaaatgactcattttcacccactgcaatggttaagtagctggttttcttgacagtgctggaagatgcttatgatcggtttattatagaggaaagagaactggattaatatccaggaggcttgaatttgggctctagttcttagtattattcttttttgtaatattttcttcttttttttttcttcttttttgtaatatcttgttcaagccacttaaccaaatttctaggtctccttccttgtctggaaactgtattggctagatcagcatttttcaaaaagttactacttttccaaaatgttctgcaagaaaaggccgtagaagcactttctattctattcctctctttgaggtttacaaacctttctcctgttaatgccctgacaaggccagaagtaaagaagcctgctaacttggttcagcagagtttgaactgacttttactctctaaccccttttggctgaaacccccttgtgtcagacccaggcctctctgcccccacacccactcctgaaccttctcctgttgtcctcatagatcaggggagggaccccaggaggctgcgtttccagctgctctgctcttctgtggctccagctctctctggtccccatcttatgctagggaccccttggctctcctccctccttcataagagggaacgtggcttcctgcagttgccaatccatgggctgcctcaccacgacctgcttggccgtgtagccctcccgcttctgtgccaccagatccctgcattaaatcccctctgttgtaaactcttgcagaaggttctctgttccaggttggaccctcattgctaaaggctcttaattccctggaacacagttgagaaaccccaggctagataattcccaagacgattctttttaaattttttggtaatgcagcttaatttgacacattgacgtataaggaacagcttaaagtgtacagttcgataaacttagacataggtaggcatggctgcaaccatcatggcagggaagatggtgaacacattctgagctacactttaaagcatctcctgtgctagggaatgaaatcatcactcccaacacacaggaagtgctgtgcaaagtcccatctttcatcgacaccttggctcttcttgcttttctcttatgggctttgtacatccttaagaatggaatttgctgaagatcctcatggcttgttttcttggatcagagaaccatggggtcaaatcttcatagggtcaagcctgctcttggcaactgtgattgacctttaccctatgtctcactttccacattgattttgggaaataataataaaaataggcagacttcttttctaattttggaatcaagtgtctgggggtagttttgcgttgtggtgaccctgtcagcattttgtttctaaagactgaaatttagaagatttgatcctgccggaacacagcacaaagatgcttccctgtgtttctgttttaaatttgggcaatttgggtagggcacaaatccaagaactctaggaaagtagactccaatttacccctgacattttccctatgctcatccttctccaaatattctggaagcttaaatagaaactgcatttttttctgcacaaaaatacaagtactgtatttctttatggccttttgccttaaagaatggctgatgtcacttattatcctattatctcagcaaggcaaatacttacacttttacagctgcagatacataaaagttcttacttttacagtaagaactagtagatagtaagataggggagaatttggaggtttttggagaaaactaatatttagagcaatgttaactgaatgttccaaatagcacccagtcatgtaatagaacagttttgtgaaataacttaactgtcccctacctgcccaccatttggggaggttactctttccttcccactgtcttctctgcccttgtggtctgacttccatccccatccatctgctgaaagtgtttcgttgaaggcagctaatgactgtcctgagtcctcatcctcctttccaaaagccttgatcatgttgacgatgcttttttccctactgggctattttttagcgcttctaaaaaatcctctccttagtttctacaacactgcctgctcactcttggttcctttcctgtcttgaagactgctgctgtatttggggatattttctgaaatacaacaaaagattcagaagggttggcctgtggcatgagacctgcacactgggctgagacaggacacaggcagggagctgggcatagggaggaggtcacacccagttgcaggagtaaagagagaacatgtggccataggtcaggatgatgggcaggtaccaggctcccaggtgacctgccaccaaggctcggtggcctggtggtagctgttgggttcagaaagtcagatgcatctgcagagatgtcccccagctgtgagtgcctcctcacgtgtttgccttctctcttatgacccatctgttcagagcatgccccaagtgtggtcccatcccagactcatgcagcacagcttttctcaaactttgtgcaacaaccacttgtttttcaaattttttagtttttgtggacccatacttttgggtccacgaaaattcattacaaatgcattcgtagaaaaatgacatggaaaaaaacccaaaatatgttcaaaatcaagcctcaacttttaatcattagattccatttgtagaaagttgtcagtcagcttgctgttaaaccatctaaacactccatttctgtactctcattgcaagctggtaacaaagtttgtggatcagcacagatctattaacaagcagcttcttggaccccaccctgactcgggggatttgggtgtgggaatctgcacttcgacaagcggtgactgaggtttgggaaccacagtgctagttactcaggcttaacttcaatctttgccctctcgcccacatcaagtcagttgccaggcttagtgatcctgcttttgaaatctcttactcccatcttcccatcatcttttccatctatccctaagttccctgcagaaggtctttataatcgttggccttgacttttgcactggtctctctgctgtgaatccctccctgcatccctgacaggctggcttttctgtggtgcaggtgtgatctgttagtcctcctccatcaccttcattggctcctgtggccactagattaagctgatgtctctgaggtccaccctgtccatctcttctactcatctttccatatgctgttatccagccagcacactctgctctgtgattttgcctatttacctggtgaaactgcccactgccacattctcaattctgttttttaaaccccagttcaaatgccatctcgttaagaaaggctttctgaaatttgcttacccatgtgccatggctctttagaagaacatttggggccaaatgacaggggacttgtcctatgcagagaggcatggagcagcattctttattatcattattattattattatttttgtagagacagggcctctctgtcacccaggctggaatgcagtggtgcgattataggtcactgcaaccttgaactcctgggctcaagtgatcctcccacctcagcctcttgagtagctggactactaggcgtgtaccaccatgcctggctagttgttttaattttttgtagagatggggtctcattatgttgcccagactagtctcaaactcctgggctcaagtgatcctcccacctcagcctcttgagtagctggactactaggcgtgtaccaccatgcctggctagttgttttaattttttgtagagatggggtctcattatgttgcccagactagtctcaaactcctgggctcaagcgatcctcctgctttggcctccaaaagtgctgggcttacaggcatgagccaccagacccagcctagagcagcattctaatttctgatgcctgtttgcagctgagctgcatgaggcttcaacgaaggagttggaggtctgaagttccagcgttggctctgctacccctcagctgtgggatttggtgaatcaccttcaacactgacttctctgattcctatcctattaaaatgttttattcatctttgacacatccctcctccccccaagtgcctagcatggtgcctttccttcatcgatacccaataagtgcacattgaataaatgtcagtttctcaaaaataaaactggtgtatgccgtctccttccattctctcattacaaataacatcaagcatttgaacgagagaattacaaactgtgaagcatgtgtgctattataagaaatgcttattaagttctgtatgtggcagtggttataaaaagggaaaagagaagttaccttcttgcagggtttatgttctgtgactttctaaatttttttaaaggctttgggaagaagaaatattattttccttctatctgatgtcattatgactttaataagtatgaatacaagtcagaaagacatgccgctgagtctcaatttaaatttcctggttgtgccaggcagaaagcttcgagctttcatgcatgcaaggaggcacgactcttcacgcaggtgccgttgcagaatacttatcttgtcagcttccacttcaggctggtaggcttggcatacattgtgaaggtgttagacattctgtttacataaggactgaggggtgacataatgtctattgaagcaaagtcacttagctccccgctaggcaacagggagcatttaaaaactgaaaactgatcaaagccatgggcaggattgagatacctttacccagggggcgggtggtctcttggttcgttgcccgaaacagatgtgcattattgcttcactgtatttccagaccattggtgaaatgaatcaggcagaattaaaccctgagtggccaatccggagagcctgcttaagtgggcacaagtgtgtccaaataggttggaaaaaatgtcaaatcagagtaggcgcatacaagatgtgatgtttctctttttatagactgctataaaagttgtttaaaattaaacaacccttcagtacttaaattatgtataatgagacaggtaggtcctggaacagagatctttcccccccttcttatcccacttaaattttgcactccctaccagagtatgtgagatataaacactttcatttccaggatatagtgtagtcttaggatggagcaaagggagagagagagatggcttgacatagaccacagaagtagcaaatatctttcacattttattccatgaacttcaaggatgtagccaagggaaaaatgaaaataatttcagatgcatctgtcctatcaagtggtaatcttctgtattttacacttccaaaatatatgtagatatagaggaaggtgtattctatagtgtatactccctctacccccctcccaaataagtagtttattgctgttttgctttttattttggggggctgtatttaggaacgaacaatagtatataatgttgcattattcagggttgacaaggttaatgtgtcttgacaatcgaaatatctgtgccctttttttccatttggccggcttctgttagaatcatttatcttgtgcctgtaggatgcaatctaactggggcactgctattctcctctcagtgttggatgacatgagatgctcttttctgaagccaatggattgggcatctctgatttcttgttcacctagaggactttgttttcagggcaggataaatgcttgtttattctcatgcatgcatgctctccctccctctctcattgaacgtgatgttttcgtggccccttggtgcttgagacctggctcataggaagctgaactcagaatcaaaacttctcctgaggtgccacctagcatcactaaccccagagatgaccggggtagccctgttaacactacacaaataaaatatgtcaccagaacatttcactgagatgaggaatttatttccatgattctctaaggttcaactatagtacatgctgctttttcctactgggcagcaaacatgttttactaaactcttacctaagtgctttctgtttacaattccacaatgaattcctgtcttccttcatgttgatttctacaaatattgtgatttacttccacacctttttgaggaagcaaattccaagttgtgatgcatcttttaacttttatcagcattttattgtgaacaaaatttcaacatatggaaaaaggggaaggttttacagcaaatatctgtataccctccacttagattctatgattaacatttactgtatctgctttatcaggtatctattctgtttatccatccattttcccattcagctgtccatcttttttcttttttgatacatttcaaagtaaagttgcagacatcaccggacacggttgctcacgcttgtaatcccagcacttggggaggccgaggggggcggatcacctgaggtcaggactttggtctcaaacatgaagccttgtctctaccaaaaatacaaaaattagcctggtgtggtggcgggtgcctgtagtcccagctactcgggaggttgaggcaggagaatcacttgaacccaggaggccgaggttgcagtgagctgagatcgcaccactgcacttcactctgggcaacagagtgagactccatctcaaaacaaaaagttgcagacatcagtacactgctttctaaataattctgcttgcctgccattaaagttcaatgtttatagatttttgaggtaaaatttctatacaatgaaatgcacatttcttaagcataccatttgatgagttttggtgtgtgtatacaccactgtaacccaaacctctgtcaagatacagaacattactagaaagttccctcaggctgcttgttatctgccctgagcatgggtggtccaggagtcacccagaatttaggaccataactctcttcatctttcctttctgaggttcccttcctttctgggatgccccagatctgttctctgattctccgggcagaaaggctgttggtttcctgttggcattcctgctggccagcctggtgcagaccaggccctccctttaagccagaagtcatgaaattgggaaatacatacagtgctgtttcccgcctccagtatcagtgcccagaatgtgcctagttttggtcaatctccagtgccttcaggtagctgggtgttattttttaaaaatcatttttgccagagtttatgtttctaatctgtgggagggtcagtccaataggatcgtattggccattgccagaaatggaactctgttcattgttttaataattttctgtgtgtggaatgcccaaaagatctatttataaaaggatttcaaatagcctatgaaggaaaaagtgtataggtcctgttgctgcattgtgttatgttctgggagatgcagtgacagtgtgtctctaaaaaaatggcatctaaggactacttgacacaccctgaacaaagagtctcactctgtcacccaggctggagtgcagtggtgcaatcatggctcaaggcggcctcaaactcctgggctcaagcgatcctcccaccctagcctcctgagtagctggggctacaggcgtataccaccacactcagctatttctttttttgtagacatggggtctcactatgttgcccaggctggtgccttaattcctggcctcaagggatcctcctaccttgtctttccaaggcactgagattacaggcgtgagccaccatgctcagccttgaataaaaggtttttaaactcagggagtgtcttcagtgttagacatgacagagttaatttggttgtccagtgtttattggtccctttcaaggcactgtggtgagtactggctgcagtagggagggggcaggatgaggatacaaatgacaggaagatgtggcagctggcttgagggaaggaggagatgcacagacagctggcccaaacagagcatgatggtatctatgatagaggtgaaaaaaaaaagaggccgggtgtggtggtgcctgcctgtaatcccagctattcgggaggctgagacaggagaatcacttgaacccaggaggcggaggttgcagtgggccgagattgcgtcactacattccagcctaggtggcaagagcaaaactgtctcaagaaaaaaagagagagagagaatattgagggagcaccaaggaaggtatggttaagttcagggtacatgacattcaggctgagcgtggaaagagaatttggatttcccttggtaggtatagaggcaaaggcattcccgccggaggaatgcatcaggggcagtgttgattcgatggtgctgcgggagccctgagaggtccgaggtgcctgaatccgagcgtgagtggctactggtgctggcacagtactcggcaggggaagagattgcaaaggtaggctgacgccagatgctgagggataatgaagccagtctaaggagtttggactttattttgtaggcaatgaggaactatttacaactttttagtaagactgtggaatgactgatgtgtgctttgggagatattcctggctgcagtgtggaagaggcctgaaatgggagacgaactggggcatttttgcaattgtctaggtaacatcccccctcccgtttaatctgtatttacagcatttgagggtctttttgaaattttaaaatagtttacattttttctttcctgcaattaaatttagactgtttaaccaagaggggcaattaggtgacaaatttgtgaattgcacccaagagatgaaaacttgtggaaaaagtactaattccagtaactaaaatctgaaaggttacgatttaaatagacatttaaatagacttaacccgatcctcctggaactctttccctcattcctccttacaattaaaaacacacctttgtgagctggttgcttagaattaggagtgtcatctgccgtcacggtgcagacggtattcgcgtctttgaagctagttggcccacgggaaacttcatcagtgagctgggccttgttcacaggtgctcagccacctgaaatgaccagattgaaatccagcttcattttccacctggtttgtctccactctgttggccaactcacacctgttccaggtagcgtgagagagagctgtcatctcctgggggtggggattggtcagtgccagttcaaaccggtgacacactctcctcctttctaccttctgaacgaatcccataaggcctggctcttaagaaagttttatttaccgaggacaatccgcaaaacttcattacctcggttcacaaaaacaagggcagccctgcgtatgggagatgatttagagaagtttagatgttcgatgtcagtgtttgcggtaggcaggattccagccccgtgggcttcgcctcctggtgttacatctgtgaatatgccaccttatatggcaaaagggaattatggttgctgagcagctggccttaaaatagggagattatcctggattattaatcacataggcccttataaacacagaagaggaaggcagaagaatcagagggatttgatggaagaagaggcaagagggactcgaaacatgagcacctttgaagatggaggaaggggtccccaggccgaggaatgcagtggcctctggaagctgggaagggccctgagctgacagccagcaaagaaatggggagcccagctctgtacttgtgaggagctggattctgccaacaacctgaatgagcaaggaaacatatcctccctcttccctccagataggagcacagtcctgctgacacctggttttcagcacagggagacccctgttggacatttttttctttttcagacaaggtcttgctctgttgcccagactggagtgcagcggtacaataatggctcactgtagcctcaacatcccgggctcaagcgatcctctcgcctcagcctccccagtagctgagagtacaggcatgcactaccttgactagctaatttttttttttttgtagagatggggtttctccatgttgcccaggctggtcatgaactcctggcctcaagcgatcctcctgcctcagcctcccaaagtgctgggattataggcgtgagccactgtgccaggctatggacttctaacctgcaggcctgtgagagaatacatttgtgttgttctgagctgctcagtttctgaaggcagcaataagaaatgaatacagtgttatttatacagggctttgttcccttggaaccttttaaattggagtgatctgggatgctggcatttgattggcaggtgctggagtcagactgtgtttgaatatgggccttaccccttagagagtgtttggttttcggtgagttttcctctctgtgctccagtttagcactgtgaaatggaaataataaatgcattgggttctcagggtggttgggaggattgagataatacatgtaaagagcctagcccagtggttggtacctcttaagtactcagtagttagaagcttttattagagttgtttgcaataaggggccattaaaaagatcttcctgttccatacctgtcatactatttcagacatcattctcttatgctaagagcaggaaaccatcaaaaagaaaactggaacagtttaggcagcgcttactgggtttctgaggtctagaaagcacttatatatgatggaccctctggcacttgagcagctcatgcttatgagagaaacctacgaggctgaagcattatgtcaatgcaggggaaaatgaagtagaacccttgggggctatgccagtttggaggaccacaaataccccgtgaataagctcagttcctacagtcagcttctgactggggcggagatgtttcccattattaagcttaccgaggtgaatgatcaagattcattgccagtgtccagataatcatcatgtcctgagaaatatttccaattccttagtcgtgcaatttcagaatgtcatgctcccataatttccatagtcctctaatgctcttgcatctcaccatacccccatctctaggattgtgaatttcctgctatgttatgatgatgtcctaatcctggaatcagtagaggatgaatctgtcaaagcaaaaaatcgagaaatcctgtattatttagcagcatcaggtgtcttggtaaaagaggaaagacctgtagtaccaccattttgatcttccacattgatgctactagtattctacccttcaggacaagagcttagcgctttcctgcagatttccattgtccacagtgtgtttcatctacaaaaggcaatcactgatgaacccttgtacctccaccggggaggggtggagatcaggattccacgtcaccaatatgatttgcagagtatgaagctgtgcttagctcggattgccagtatcaggaaaattcagtatttttctaaccaactgttgttttatcttatgaatattgagactcttataaatgaacatgtttctatattctttggtcacttcaaaagtcagatcaacctctctttatcatatggtatttagtatcctatattaactgtatcttattttcttgccccattttcccttcattcctatttccacatatgttcaatgtttattccataaaatggtatttctataagttgtctcagatctattttcagaacgaggcaggagcaaaacgaattactgctcaaaatcaataataaatggtcaaaggaactatagcctgttgtcatgggagccagtaggtcccacacctatctctatggtcatgcctttgggactctcctctgaggatgagcctacaccctgtattatgtcaccatatgtgtggggctggagtcttttgccaagtggttatgtgtcaggcacagccctgagtgcagacgggacaccgtgacattgcctggttgattcattgtgaaggcatcactaccaggtttgacttgacatttaactttcttaaagtatggttcatggataatgagcatcagaatcaatggaggggcttactcccagagatttcaatttagtatgtctgatctgggaccaaggaatccgcattttaagaagcatcccagatggtttttaatcaagtggttcatgggccagattttgagaagtactgccttaaagggttggtaggatttaaagaggcagaggtgtgcacttcagagtatagaacgggtggaaacagaggcacagattctggcaatgggcacagtgggtgagacaggatgcttaagggtgggtgccatgaaccctgagggtgcttttactcactgtcaatgccatttgtagatctacatcaacattgaaacattcaacgtcaacatttgagcgtgctagctcaaacatttaacatgttgtgtgcccttgaacatctgcgtgcctactgtgtgctggctgatttgccaggtgccaaggatcctgaaatactaaggccacattcgtctaagagcatgctgttccaaaggagaggctgacgtgtagatacatggaacttccgaactgcagaggtaccatgatagagatatgtttgggggagtatcaatgaggaaacgataagggcaggatgaggaagcagaggagatctgaaactgaaagccgagcagatatttttattctttggagtttctgaaattgtgcagtgcagtgttttagcttaacattctcacagtgacttttgcaataacgataacttatttttattggatggtttgcttgtgtgttacctgtctttttgctgcttaattaaatgacctatataaatatagcagccatgactaggtgtatcttgagatttttccagctggttctggaacttgaaattttttttaaaaaagttaaaagtcctctttgactttttattccctagtcttaaaaacaaaatgacctttatttgaaagatttaaaatggcaagattttaaataacttggctattttttatttctttttaagtcaggtttccatggtcatcaaacactttatgactaaatataagataacttcctcactcttgtccacttctgccccattctgagatgtttgagctgtaattctgcccaccttgcttcttgtcctgaactgtattagcagtgatgttggatggatccatctcaggatacagcttaagtgactctaatttagagtgagagctaaaattctcaacctacttatccttggctacaacccaaagtttcaaatgttgttggattactctcttcccggccatattaagctcagtgcctttgatgtagcttcaaggcagacttgaccaagtggtattgcctcccgctgatatttaggtggaagccaacactataaaaatgaacgttttactaagagtactcgctctactacctgcaaacccagccagttgctctgccaaattggtcaaagaaagaactggcttgagaattgcaaagtgtgttcctctggcaaagaaatggagctcagatcaatctcatggggctccctaactaaaatgtagtagacatgtcaaacactttaattggaaacttcccaaaaatacccatcccaaatgcttagtttattataaaagcaattttgttaagaaatgaataacaaggatgaatctttgatatctttttaagccttactttattcttccactagcccatgcacctgaatttctaggatacaatacctaacagtgcagcagatatttcagagtatataattgggttgacacatatattttctgcctcggcattctctataaggttgcagaaagatctggcaatctggattacacagaaacatcattaaattatatttacaaatctctatggaacaaccgtagcatgttaagacctataatggccacagaattagacatggcttctgtccagtggagtcacttcattgggccaattacagatgaactggcaatcagaagatgcccagggatctccttagcctaattttcttagttagaatgtaagatgttttctttgttagtcaagtgagactgtttttcaagaagtctaatctggacctctgagtaattgatgacataaaatgatgcagaatctcagaagttatttaatggtgtacctttgaatggtgtatacatctccttcagcacaattctaagctggggtcctttaagagctgcttaaacgcttccagctacaggaaactcactacttcacaaacacacttcatttgaattttgtactgtgatagttgatagctttctactcagtggaataattttctacctccttaaaacttattggtccttggtcatccttctagagcaggagttggaacatttttcttaaagggcgaaatggtaaatattttcagctttgcaggtgtgatctttgtctcagctactcaactctgtcatggcagtgtggaagcaatacttcaacaaacagacatggctgtattccattgaaacgttatttataaaactaggtggctggctcatgagctgtagcttggtgactctcattttagacctgtgtaatctaggtcctgaaaatgaattactcaaactcttaattccaggtgggttccctgacatataaggggcacttgctctccctttgtataggcttgatgagtgaactaagaaagtctatctaatgccattcaactaatcttatcaaagtttttaaagtcctagtagaaatgcatttgtaactggaattatctgtggttctaaatacgtacctcatgttattatggagttcaacataggttttttttttttttttttgctttttagaaggaggtcattttaatgctatataatttgttgtgtgtgccagaaagccataacttcaggaaggtgcttttagtgttccatcattgagctttctgggatgggaggtggcaatctggaggtgagaaagatacaggtgaacaaaaatctttgccctaaaagtgtagactatttttatggttctgaatacagccctcctttcagatccgtggattataatttagatatcagcacagaatagctatctgaagcattgctcatgtgttttcccccttttctcttggctcttctgtagggctgtggtagtgccagcttattatctgctgggcataataaacacctacacctagcctccagggatcaagaaactgggtcagccaggagtcagcctatcatgctgcagaagctggtaatattaagcccagaaccagcctcattttaagattttacattatataatggtaagagcaatgctgatgttaaaaaaaaaatactggttggagtccaaagtaattttagacattaaagaaaggtttcagaacattttaagtaatgtttattaaagctagccctgacctcaatcaagcacctgctacttaattgatcaaatggtcactggtaagccctgtctcttctaaagtgacttcgccccaagtcatccactgacctttgctcagcactttctccagagacgagagagtgcacaagaggaaatgaaaaaacagatttggtgggaattgttgttcctggttgaaatgaaatgtatgtatccctgctacccaaatgtggtctgtggaccagcagcagctgccccactagggagcgtgtcagaaatgcagcatcccaggcacctttagattagaaacctgcatttacaagacccctaggtgattcataggcacagtaaggttcgagaagcactgatccaacccacagccctccttctgcacagcggtaacccagcagggccatctttgtttcagaagcacccatattacaaagagcttgagttattctggggaggtaaggtaaaggagagaagtcatacttcaatggcagtgagactttgcctagaaatctacaaaataacattactctgagtgctagaactgtaagtacttccatcactctgctatacagccttttctaaataagcattaaaggatataggttttcgtctaacatcaattttttttgatatgttgtgctttctatttgcattcagctcaaaatatttttaaaattcccctcgtgatttcttctttgacctgtggattatttagaagtatgctgtttaatttcgaaatatttggggatttactgatttctagtttaattccgttgtaatgagagaacactgtatgatatcaatcatttttaattttggtcttattttagggccataatatggttgatcttggtggatgcttcctgtgcccttcaaaagaatatgtgttctgttgttattgggtagagtgttcaataaatggcggttaggtcaagttagttgatagtgttgttctttattgtctttttttctttctttctttttgaaacagagtcttcatgtgtcatccaggctgcagtgcagtggtgcaatcacagctcactgcagcctctccctcctgggctcaagcgatcctcccatctcagcctcccgagtagctgggactacaggcacgtgccaccatgcctaatttttgtgtctttggaaagatcaggtctctccatgttgcctaggtctcaaactcctgagctcaagcgatctgccctcctcggcttcccaaagcgctgggattagaggcatgagccaccacgcccagcccaaatctttactggctttctttgtacttgctctatcaattactggatgttgaaatctccaactataattaaggatttgtctacttcttttttcagttctgtcatttatttttccccttcctgtgttttgaagccctgttcctgggaaatccacatttaggactgttatgtctctggatgaacttgattattctctttgtccttgataatagtctttgttcagtagtcatctttgtctgaaattaatatgaccactctagctttcttttcatttgtgtgcacacggcataatgttctaaccttttttgttgttgttgtttgtttgtttgagacagagtctcgctctattgcccaggctggagtgcagtggtgcgatctcggctcactgcaagctccgccccccaggttcaagccattctcctacctcagccccctgagtagctgggattacaggcacttgccaccacgcccggctaatttttttgtatttttagtagagaccgggtttcaccgtgttctccaggatgatctccatctcatgacctcgtgatctgcctgccttggcctcccaaagtgctgggattacaggcgtgagccaccgcgcccggactaattttctaacctttttaacttttaacttatctgtgtctttagtctttatatataaagtgggtttctcataaataacatagagttaggtcttgtttatttcttgaagcaacctaacaatttctgccttttaattggtgtgtttagaatatttacatttaatgtgattattgatgtgtctgggtgtaaatctaccatcttgctatttgttttctatttgtcccatctgttctttgttcccttcccccctttttctgccttcttttggattgtgtattttttgtgattttattttatttccactactggtttagacctttatgttttatttatttttagtagttgctctaaggtttatagtatatgtgcttaacttaccacagtctgtttttaaatattttaccacttcacgtagaatgtaagaattttacaacagtatacttcaatttccttcttctgttctttgtactattgttttcatatattttatttctgtttatgttacaaagcccataataccctgttagtgtttgcatcaagcagtcaatcacgttttaaataaattaaaaatgagaaaaagtctcttacgtatacccacctatttaccatttctcacactctttattcctttttgtagatcaacatttttttttaatctagaatcatgttccttctgcttgaagaacttctgttaacttttcatgtaatacttgtctactggtgataaatcccctcagcttttatttatctgaaaaaattctctatctgtgttgtggaaagatattcactgggtctataatttgagattgacagtatttatttcccttgcagcactttatagacagtgttttactgacttctaccctggatggcctgatgacatcttggttcctttgtacataaattgtcttctgttatatggctgatttttaagattttctctttatcactggttttcagaaatggttttatcatgtgccttggtgttgttttatttaggtttcttctgcttgaggctctttgagtttctatctgtgagtttatagttttatttaaattcagaaaaatttggtcattacttcttcaagtcactttttggctttcctctttcgtcacctccttctgggtttcaaattacccataggctggacttctttatatctcacgcttcagtgttttgttttgttttgtttcctctctgtgttgtctcatttgggcaagtttctattgctaagacatcaagttcactaatattttctttttcagtatctaaactgctgttaataccatctaatgcatttttcatttgactaaaagtttcatttacttattttgtgtgtctttcatgtatttccttctcatgctcatgcttttctttgtattcttgagcatatatttatgatttataataccaattgtaaggtcctttccttagtcattctatcacctctgttatttctgagtctgtttttatggattgatttttcttttagttatgagttattttcctacatcttcaaatgctcactaatttttgagcatgcaaagatgctgtgtgctggattttgttatattcctttttaaaaagtgagcacgcaaagatgctgtgtgctggattttgttatattcctttttaaaaagttagattttattcttctgtgcaacgaagtaacttgcagatcaatttgatccttttgaactttgctttcaagctttgttatggtggattcagacaggcctttattttaggattaatttatcccctcctaagacacattcttttaagaactctacctaatactccatatattatgaggtgactacattctggttctccagcacgcaaactttccccagccttgtgtaaactggtaattttttttcctgctgctttcccatagttctttccttgccttggaggttttctttgtacacaagcagttcagaactcagccaaaggttagagaagacccctctgtagatctttggagcgctctctctatgtagcactctcttttccagtatttagccctgaaaatttagatgccttggccttcccaaactccaatctctgtcttctaaactcaatgagattgttggaccctatttggtagccctctccctgggctgccacgtaaacatataagtatccttccatttgtaaaatacatagcatagtgtgttagtttcctaaatccgccacaagtggatgactttaaacaacaaagtttattctctcatagttcaggaggctagaagtctgaaaccaaggtgtcagcaggcagtgctccccctgaagactctaggaaggattttgttcatgcctttctctgagcttctggtgttgctggcaatccttgtcttgtagaagcatcacttccatctctacctcggccatcataggacattctccctatgcctgcttatgtgtctctttttcttcccttatgaggacattagtcagattggattaagggcccaccctactccagtatgacctcatcttaattatatcaacaaggatgctatttccaaataatgtcacattctgaggttctgggaaggacgtgaattttggggggacactattcaacctagtacctatggcaactgtgagtcccaaagttgctttgatcccttgataaggaaattctttatgctgagataagactagtttcagatatgctgcctgcatcatttccagactgctctccctacgtctctgcaccctacctggtaatctgtgagtgttctttcataattatacaatgtatccacagcttcatcttcatagatcaggaatgcccatttccttgcaggttccctgtctattcctgaacttcagggcagtgagaaaattccatcttgtgtgccactgaatgcccttcgtagcttcagtcataactgttcatcatcactctctcaccctgctaaaatgcccactctgaaagtttgtctatttcagaatcttgcctctaattatcttcacaagtttcctttgtgatgcactgccctagaagtggctcattttccatatcaaagttctgcagatgagaaacagaattatagtagattactcttgctagtagagaagaatgcccctgcatggggaagatgccaatcaaacataacattttccgcaaacgttttgcatattgccttatgttatagtccagcttctttctggaaagatgacagtccatacgggccccagcatctttgtgaattcgtactgagaatgtgaattcgcagattgagtagccaccagacttagacaagtgatctcccagctatccaggcaaggagctggataaagagatgatgatggtcaccaaggtcagaaataactggcagaatcaggaatagattcagtgagttttggctcacaactcaccaccaggcattttttttcaagacaaagaaatccatctgggtttctgttgggtccttgcaggacctgactagatttgtgtttggaaaattgccataccaacaactacggtttgcaaccaagcctatttaaaacaagatcaacaaaacccctctcttccctacagtgccttgtggtatttgagtgttaattttgacttcttttgaatagctgtggtggcagtggctaaagggtgaagctttaagatgccttagaggatcagtcatagaaggcggcttgccaagcctgacaccgaagaaaaacgcagcccttgggtccggctgtgcctcgcaattctggcatccagtcttttctctgacccaaccacaaaccccttcaccctctctccacccccttccacatgctcacacgcacatgaggtgcagccactgtccccttctctgtgtgctcccttgtccacggatgcatttgtggttggaggggagtcggtgcagccatggtagaatagaggtcctcgtgtaagactaacatgagtggtctatttactcatctgtgctgcccactagaccaagagctcctaagagcagagactgtcttattcttgtttatatcttcaatgtccagcacagtgtctgctcaggacagccattgaattatctcctgaatggttagatggtataaggaaggcttcccttaaagaatatcttgccgctgtcttgggatttgacattcaatgaatcaggagatgattcttgaagtttcatatccgttaagttcctcattaccatgtatgtatgtatgtatgcttgatactagtaatatcatcaatcttaccaggaacgtggtgtccccaggaaggtcatacattgccacagaatctggccaaatggttccttgagcagttccacgtggaggggacgtctgtgcacatgagtagataaaaaatgcaagcaatgttgttgaaagttagaactcagcttttttccccttgaggtcctcggccaccactcagctgctgaaatccagaacactttggttctagtcctggttctgacatgaatgccctggtgaccttcgattcacttaacctttccagaccctagttttgcctcatcagcaaaacacatgctctttaaggcccttataaccctaaactcttgccttgaacctgctttgagttttaagtaatgaacacatgagactaaacaaatcagattttaaaagcttgagtgaaataaaagaattaaaaaaaaagaagtgaattttaaagactaatttctttcttcttctttttttttttttttttttttttttggagactgaatctcactctgttgcccaggctggagtgcggtggcacaatctcaactcactgcggcctctgcctcccaggttcaagcagttctcctgccttagcctcccaagtagctgggattacaggtgccagccaccatgcctggctaatttttgtatttttagtagagatggggtttcaccacattggccaggctagtctcagaactcctgacctcaggtgatctgcctaccttggcctcccaaagtgctgggattacaggtgtgagccactacacctggcctctttcttaattttatctaagaaagcagaatttcacatcttaatttttatttttcaacttttttttttttttttttttagatacaagatctcgctctgtcacccaggctggagtacagcgattatagcttactgcagcctcgaactcctggcttcaagtaatcctcccaccccagtctcccaaattgctgggattataggaatgagccagtgtacctgaccttcaagtatattttttgaggtggtatgatagactagtgaaattgaaacaggaactgtgaaattataatttatttgttccttttcctaaatacctttgtcagtctgcatgtgaattaaagtaattatttactttatatcagagtagagcaaggaacaccgtctttccaccttgactttgctgctctgggtgactttgggcaagtagtttagctctcttggaccatagttttacttatttatttatttatttgtttctttgagacagagtcttactctgtcacccaggctggagtgcagtggtgcagtctcagctctctgcaaccttcacctcccgggttccagcgattctccctgcctcagcctcccaagtagctgggattacagacgcctgccaccacacccagctaatttttgtatttttagtagagatggggtttcaccatgttagccaggctggtctcaaacttctgacctcaggtgatctgcctgccttagcctcccaaagtgcggggattacaggcgtgagccaccgtgcctggctggaccgtagtgttttaacatgtgaaagtagatgtctggtgaataaaagttaaagtaaagttttgaatgcatcaaaaacgtctctttgaaataagtgctgttatgcggagcctccaaaatgagttttcttcacctcgtgctgtaattagtgagtagaaagtctccagttaattttgtaaaatataagccattacggacattgttctttctccctggattaacaactccagcagatctgaatggcaatagcacatattagttgaacgagggtcagtttggcctttgccttatattcggcattatcgttacaatgcgatacaatatcctcttcaagattcaagctttcttctcttattttatgcttttctatgtcacatttctccaagactatctttggattacttatacacacagctgttttatgagactctgttggagcttatgagtcagattactgttaccaaaatgtttgtgaaatcacttcttaagtcatatatttgcatcatgtacaacctgtttgacaatcaaaacattatgcccttcagcacttggctggttatgatagtaagttttccagtagagtgttccagcagaatataattgggcagtagacagaaggagcacagtatattattttaacatagaattccaagtgcatttctcttcttgtaagattgagaaggacacataatattctgtaatagactcagggtgatcaattaatagcatagagaaattccagtgcagctggggcattaccaagtgcagccctggagccaacaggggtggatggaaggatggaatggccggaacacaagacgcagacatggccactgacacagcactgcctgtctgtgttggtcagtatctcaggcacctgctgacactggctgttctttacctgctcttggccaaccttcaaggcccatctcaaatggtggctccttcaaaaaggcttcattgatatcttcagagtagacttagagactccctttcctcaaagtctttacggcattttctttgtactttctgatcgctcagttgtcatttgtcatttgttattgtctcattgcccccacttgtccgtaacttccttgaggacaaggaatgtgtcttactccccttggatttcttttcttttctttttttgagacggagtctgactctgttgcccaggctggagtgtagtggtgtgatctcagctcactgcagtggcgtgatctcagctcactgcaacctccactttctgagctcgagcaattctcctgcctcagcctcccgagtagctgggattacaggcgcccgccaccatgtctggctaatttttgtatttttagtagaaatggggtttcaccatggtggccaggctggtctcgaactcctgacctcaaatgatccacctacctcagcctcccaaagtgctggcattacaggtctgagccactgcacctggccaaccttggatttcttaaaaggaaggggttgtatcttgattaaggtgtgagtggtcaaatgtcaatgcagtgttattatatgtcatttttcaaaggacacatccaaattcagccagtgacatcctgggttgacacttgaaggtctgctttaatgatcttgaaggtttgctttaatgatcttgaaggtttgctttaatagtctttcgcagtagtcctgggcactgacttttgctaaggcatgacgtgggggaattcaaacttctatgcagtcagccttgccctcttggagtttatgatattatcagggacaatatacaaatatataacatatatacatatgtcctaagtgctagctgagtaaaacggcacataaattctatagaaatataagcttcatccccagcttactaaataaatattctttctagctctgaacataattgcatctgtaacaatccttatattctgattaaataaaaagatgcaactcaatgtgcatgtctgagtgtgtgtccacgcattttaagtgtttttccagtgcccataatatgtcttatcaacatattgattttctgtccatattctcgcagttcttctccaggggataggagtatgttgctagaggggatcttaatagttggcttgatgtttaagccgccgggcgacgcagatgtgcagccagctgaagtccgttttgcaatgacggtatcctgggagtctggaggagaaaccttttaacgactgtgagatgtagccacagcccataaaacatggccgtgcggcaggcgcccagctctccacctgacctgtaaactcctatgcgcctttgcatccccacactctgctttgcagatactcttatgaattctgcaagtcttggtaaataggttagcttttagaaacctgtgttttaaagtacaaagcatgcatctcagatgcgagtttagaacttggagaaagttctcccgtgttttcagcctccactgtctgcagccaaccccaggggaggaatagtatggaagagaactcaaagaaatgaaagcacaacatacccctttactttgaaacaagaggcctgtaagtattcatgtaaaaagtcatggtaaaattctgtgttcttacagaatgatgatcctcttattttcaaagttgtggggaggcactcttatgggaataaaaagactccaaaaacaaaacaagaagaaaaagtatttttctacacagaaaaacttcaagaaaacatcccatcgccttttatgtcctaggcttttatccttattcttttaaaacacccattaaaaagaaagaggctggcgggtttcatgctaaaagctatttgctacaggggacaatttgccagatatgaaagtgtggtttgtgggtgttgacattcgggtttgtcctatcatggctgggcagaacctctgatggactccactggactatttactgggctgacccctctgagaagtggggacactgcccctccattttaaggaaatggcaggctcagatggtgaatgcaggtgcagtccttggccctgctaaaaggaaagaaaaaaaaatctatagaatgtggagcaaataatacaagtttgccctccatggtgaccttctctctgcccaccctcttggctcacatcaatggcaagttataattggactacaaggaccaatatattgtgtagtctagaggggaaaatgccaaaagaaaaactctgttggatcaagcgtatgtgtcctgcgttcatttctaggtctgtaaacaaacacagctgttgagtgaaggatccgtcttcagaaatggtgaaaaaacagccatgccctgccagtgagagcgcagcaggggagagttgttccagggcttgggaggagcaggcgaggcgcagcagggccgggaccatgtgtctcctccgtattccaggagaggccattctgtgttttcagctgaggctgttggagcatggagaatgatgagtgtgggaagattgggagggaagaggattctgaaatttcatctgctttcctcaaattaaacctttgtttaacatacaagaccttggctgcctttttctggaggtggtggaagggaacttgtatctttttctcgactaattttaaaataatctgcaacttggagcaaaagacattagaaactcacgggtccagcagcttgtatttatatcagttattgctaatttatatcaattactgctaagctgaagttttgggcctcactcctgtctcttttctctctctacagctaaaacttaggtaatatctatattgtgtagagaacgtgctactgcgatggacctgccatttgcacatcagatgtttgttctgatggtgttatatggaggtcagatttctgcaccatgatggacctctggcttttggttgcctcccagtccccaattctttttattaaaaaaatttttttaggggcagggtctcgctatgttgcccatgccggattcaaactcttggactcaagacgtcctcccatctcagcctctggagtagctgggactacaggtatgcgcccccatgtccggctgcccttcacatttttattaccggaagtgcaggtccctcagcagtagctgatgcaggacgaggcccaagggagagtaggggagtgaggtcgaggagggatttactttatgcctggagatcttcttagcttggcagttgatggcttgaggcttcccttcatgccttcatttatataatagacattttcataatactctgtgcaggtaattcgttgacttcctggccaaattttttctcgatagtgggagactggtcgaaagtttgaactttggctttttgcagttgtattcctccctgctcccacttgcagtgtcgttttgagtgaatcactgcccaggcatggaccattcccgagacttgtaggcctcgagtttcccagtgattggttgatacttctgccttctgattggttgggtgagttggctggtgcagggatgctgatgagcccaggattgtggatttattcccccaaaagtttaaattagtttcccagagagggggaaaccccagtttgaccacatttattattttatttgctgcctcaggattgtaggagggacaatgtaataatgtaataatctaataattggaccaactcagcagtacaggtaaagaacaaaagattcccctcaaaaacaaaacaatacaaagctaggtcaatccttgcttggtgcagttaggtaccttgccccgtgaccacacctgattttaataagggatgcgtaagtgtatcaaaaacacacattaaccaaggtacatttctcgccatgtcagcagcatcatctcccagggggagggaccaccctgattcctgcttctctatcactcattggcttgacgctcttttagcacatgctggtagacggcaagcatgtttcttgtggctgctgtcacaaattaccacaaacctagtggcttacaacaatccacggttattctctcacagctgtgtaaagcagaggtctggcatgagcctcactggattaagatcaaggtgccggcagggccgtgttccttctggaggctctaggggagaatccatttcctcgctgtttccagttcctagtaaccgcttgcattccttggcttgtgataccctccttcaagttcagatttctctccgttactcccacttccatcaccacatttccttctctgactctcctgcctcctgcattccctttgtgggcccagctgaataatccagatcctttctccatctcaaaaatcttaccttaagcattcctggaagatattcacagcttccagggatcaggatgaggacatctttttttgagcggcagggaaatggcctttctccatcggccacaataaacttaatgtcttcacaatgactcacagtttttaaaggggagattctttctgcatttagtgtgtgcttccagtttttttttgtttgttttttatttggcagatggaagaaagatcctatgaatgttgaggactgtatcttgtctgctgattttctgagtggctttgcaatctacctctaataatgagctaaataaagtggattataagaaatcactaggctgggtgtggtggcttacacctgtagtcccaacattttgggaggctgaagtggaaggattgcttgagaccaggagtttgaaaaccagcctgggcaacatagtgggaccctgtctctacaaaaatgtttttaaaaaattaaccagatgtggtggtgcacacctgtagtcctagctacttgggaggctgaggcaggagaatcacttgaacctggaagatcaaggctgcagtgagccaagatcgtgccactgcactccagcctgggcatcagagtgagatcttgtctcataaaaaataaaataaataaataaaaagaaaacactaattagaaggtatgtaattcatagacaatttccttgctcctaagtgtagacttgttttaaagaatagcctacatcattaaataaaatcagttatatattttgaaggcctatcttctatgtcttcatggtacatgtgaagacattttagctatcattcctatcctattggtgaatttattgctctatttcaaaaaagtcaaacaaaatcaaaaagaatcaaataccttcagacacttaggattggcccagtaaggtgtaaatcaaatggatatggaatcgtataatttttatttttattttttatttatttatttatttttttaaatgatagtttgtttgttttttttttgagacggagtctcgctctgtcacccaggctggggtgcagtggcgcgatctcggtgcactgcaagctccacctcccgggttcacgccattctcctgcctcagctctccgagtagctgggactacaggtgccggccaccacacccggctaattttttgtatttttaggagagacggggtttcaccgcgttttcgatctcctgacctcatgatccacccgccttggcctcccaaagtgctgggattacaagcatgagtcacagcgcctggcggaatagtataatttttaaagatgttttatgcttattgtgctttttataaaagatagcaacaatcttccaatgaggtcattcatttctgttggtacagttagaatgtgtgtctctgggttggtctctttgagtttcttttggcatagagcagtattctcaccctgcatgatcatcagagcacctgagatgcttcgtaaagtgtaggtctgagccccaccacggagatttggatacagtaggttatgaggggggagcgtcgagcttctcaggaaacctagttctcagctgtttttctccagatacaaatctgtaactttttgtatttatcttagggtgaagctttcatactgtgagctcattcaagccagagataatttcttatccaggaaccagttggcaaatcttttgtacctgcagttagtcctacttattttaatttcctgatttgataattccaacagccctgctacgtctgagtctgcttttggtgcttgctgtgtctcttgtgttttttgctcttagtgtgccttgtaatttttgttgagagctggacatgatatcctaggtgaaaggaactgctgtagctaggcctttggtgaagtggaggtaaggtgttgtggaggggaagccctctgtggtctatgattaggtctgggtctctaatgagcctgtgccctggtctcagcttttttctttaatgaccctgtgccctgggctcagtgggtctcaggtttttttctccccgcttgggtgggacaggatggctggagataggtattttccttctcttcctggggaggcaagagcgggcaggaagtgcgcatgtcccttcctccaggtggttttggctctggtttattagtttttcctgagggcaggccttgttaagaagaacggagtgctctggtgtattgcaaaccattccctttcctctcccactgtgaagtatgaaaggatttttctcccacattcacttggaggacctggtccagctcctggaagtaaaacttgtgaaagcatgcccctcccatgactgggtcgccctggagtttttcactctcagtcttgtccacgctgagcctccagcaattcgccacttaggattcaaggtttctctggcgttggttcctttggaggtttctgctctggtaagtttgagtctttgttttgccctgggcagagtggggtcctctgggtgtttccaggccatgggttctggtctctttgcttctatgtcccaaggctgtcttctggtatttgccacctgcttctgagcatgggtctcaagcctcgaaatggcctcacctcagcgtcctcaacatatgtgttcaccattcttatttttgccccgttcttattgactgtagtggttcctctgaaaaaaagtcgctccacccagcctggcatctttttctcacttctgtccagtctgcacagggacgcaaggtgttcctctttatttcaacagctttctaagagtgccgatttaatcaatcctgcatcattactttgagcgggaaaggaacatttctccctctcttgaattcccctaacactttgtggctttcttgttgtactcatcacagcttgccatgatctgtcatatattatagttacgtgtgtccttttctaccactttatgaactataaaaccaggaggccagagactgaaccttaaccaattgctgttacttccagggccagaaatgatatattgcagtcaacttgcataacagctttactgactagatacaacagttcaaaaggagtatacgcttctccccaaaactaagcacattcactgagtatgtgacgtgttaatatgctactgcaggtaggaaaaacaaaacccaaagcaaaaaagttttgcaaatgtcccaggtaatttctaaatgagactggctaaaggtaggggaattgagctagctgttgggaaggacaaagtggaactacaccgatcagctcttcagagcccagacttaccaaaatgatgagcaacctgagaattgtttcagccagtgcctcccaaactttgttggaatcacctggagagctttgaaaagcccaagttacaccccatccaaatcaggatgcctgggggggtgggagtttggcatcagcatgtttaaaaagctccccaggtgattctagcatgcagcagagtttgctatcgcctggcttttgcatcagatgcattgagtaggggtcgagttctgcacaggtgtatttgaccttacgcccttgttaagacctctgcagtgtttttgtttttcagcattttctggcctttgaatttaaaacttgaaagacttaactggaaggatcacacgtaaatcaagcataggaaaacccttatgatagttgccttagggttttggaatttcagggggaagaaacaatttagaaaaacaattcttgttacaatgtgcaaattgtaatttcacaattatttttaaaagtcaaacgacaatctatgatgtaaagaggttgatcttgaatttttgagtcctaccgcatgtctgcaaatgcagatagtttttctttccaatattcctaacttgtcttttcattgtctagaaccttgtcaaatagatcataatgacaacaggcatccttgaaaacagtgacttgtgtaaacagattttctaatgttgagtcattcttgcatcaaaaacccttagtcatcatatataattattttagtagactactattttagcatctttggatgtagtcagatgaggttgcctatgtcccctcctccaacaccacccccctgcacctcccctcgccccctttttaaatgctgcttgtcaggttttgatatcacggttatataaccacttgtaaacttcaagaatgagcttggaaactgcctttttccttttttaaaaaaatgcagtggagcattttaaatgatacagtgtaagatttatttaaaatgggaaaataagccacatcctgtttttaagcggttgaacatactttcaagtgaattgatatctaaatgcttcttcagtgatgtgaatacagcttacatcattgttaaatactaggtcctggtggtttggttcaaataatagtgaaagaaaaatcccttaaggaatgactggaaccacatgtaacaattggttctgtctctgggccttgtgacctacccggtaaagattgcatagtctcgggactgggagtttttttcacgatttgtcttcatctgagtcctggacataggttgggactggaacaaaacctcagttggagggattctggattaacagatgtaaatatgtgtacttggagtcattactgtcaatttgacatccctgttgattttatggtattacccacacccggccctaaaagcgctccttgttttctgaaccttttgattctgtacatcacctggggtgctcgtaaggattcctgagctcctttccagatttactaactcagaagttctaggaaagggggctgggaaatctgtgcagtcagcagttacaccaggtgatccctattatttgaagttcatcacagcagtgactcctaaccttgccttgcattacaatcacttggagtgttaagaatcttgatgcccaggcctcccttattgagtgaatccatctctgtaggtggggcctgggcatcaggattttgtaaacattctgccagcattgagagtcattgagtttcagcattcttaggaactgagtggtattatttgagataattgtcaattccttggctcgttggaaattcaagactgggtataactgagtagaatctgtgtttttgcttgtaacagaaatgagactgagatcctctttctgctctgatttttattttttacctcctcttctctcggatttaattctacttaaaatcatactggtcagttaagccgctgcagaataacagatatgtacctgacacgtagtaaatgtttgataaacgttaattactgttactggaatccagatgtcagctgggcttgtccagctccttaagctgactgcattgaatctccagtccatgtcctcagagcatctgctaatttgatgtttgtgggactctaccggcctctgccttggtgtctgctgctgtgcctagagttgttctgcactgagttgacccagatgtgaaatcacccctccttcacacaaaaccctcataataataccatgtgtatatagcacccacataaggtaattgctgtcattatccccactttgcagatgaggaaactgaggcagagaagttacataacgtttttcctagattatccagtaagtgcgtggtggagcggacattaagcccaggcatattgaccccacagcctgtgttgaggtttcatggtcgtatttgctggcctctcagcagcattctactgaagacttaggcagggcatggaggggtgttacacagggtggtgcagggcaggctgtatagcagaaacccaaaactgcgcatcagccattcctttccttagaagtccttttaggtcggatgcggtggctcatgcctgtaatcccagcactttgggaggccgaggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgcagtgagccgagattgtgcgattgcactccagcctgggcgacagagcaagcctgcctcaaaaaaaaaaaccaaaaaaacaaaaaaaaacaaacccaaaaaaacccttttagctttcatgcttcaacctcttagggtcatccttgggaaccccacactcccctccctctattttacagaccactctgctctcaatgtgcataaccaaactcattcaggtcctaagccaacagagtggcctccagttaacgagacaccctgtgtcttcttgtcattgttcacggaaaaggcatagtcctgttcgttacttttcttgctttctcacatacagaattatacctgttgggatcttttcgttggtgaattcagaacctgtcttaaaggcccacggcccaatctgtcagtaatgaatttatttatttatgatgaaattataaggactgagggggaccagaccactctagtcaaacagccagaacactctctccctgtagatggggccaaagcaagccaaatcccaaactcaatgccagtttgttgatttacagtgagaatgacaactgccaatgggaccgagtaccatgcctttctgccattgcatcctctccctcagggccagtgctatgggggtaaaattataaccaagagctggttaggcaaaaccagaaccaggatgcaagaatcaatgagacttccaaaatttggatttcttctcagaatccatgaggctaagtctcctctccccctggacaccgcttggggagaacatgtcctgtctttgtctctggacccttctatctaaggtcccatggctggcaggtgacagattcccctcccctagttggtgttcccattctcacatttcttctttagctattttactgaacatttgatctgattactttcatgcttgacaggactgggacccaatctatctccttgtggtgctttaatttgtcttaattgagttcattaggcgttgattttaaaatgcaattttctgagggcaattttctcttatttccagagtcttggaggggactcttccaaggccctccaagggccctatgtgccattaacagtcaggaaaatggcagaagaaaaatgcttagatgaacgtagcagatgctctgttacgaaattttgcccaactgatgcctgatgctgtttctgtagtgctgtttcttgtacctgctcccaaatggtgcacctaacaccccagtgtgaccctccctctgcccttcatctccatgtacacacatgtatacacagcccaggagaactagttctgtagattatgccgttttaggcaaagccagatgagttcccatattccaaaaggaattagggaagggccagaagagcagagaacacctgttgttaagtgttcattcgccccggtgcattttcctagtgaaggtggttaggcagggttctagggagagactggaaggcagaggtcactgtggagagtatcctatagacaagatcagaaataggggaagggataagccagtctctatgtcatgcataaacataggctcagaaaggatatgcaaatgactcatacaatagcagaatgtgcacagtagctctgtttccattcaacgtattttctttcagaaaaagcatccaaaagttttaaaaggaaagggataaagaaaaatgtgaacaatggttaaatttaagcacaggacttaaaaatttaaatattctaagggaagccttctagcttaattgaatcatgtacatggggccttttcagaaacagctcactagattgcttgggatttccacgcgtttactacctgacttttggtcatcttgtttaggctagggttaatgggacaggttctcttcctcatttctccctcttctgagtgagcctattttcctaggctgtttggagtttttggataatggcattttatccacttggtcgttattccctgggaatgtatgaaagggccaggagccctgaacatctttgaccatcacctctgttatttccagagagacgtggtcattccagcctcacctgccggaggaggtatagtcctgggccaaggtgggagtggactgcagttagcagtggcacctggacttcacgaaacgggtcttagaggctagaataaggtgtttttcgatgaagagagacacatggaactcaatccacggcagggtttgggtggctccctcagcctggtggcagagaaaattctcaggttgcttgctctcattcctgctttctgccttccacccaagaaagcatagcaggctggctgtggtggctcacgccggtaatcccaacactctgggaggctgaggagggtggattacttgaggtcaggagtttgagaccatcctgaccaacatgtcgaagccccgtctctactaaaactacaaaaactagctgggcatggtgctgggcacctgtaatcccagctactcagaaggctgaggcaggagaatcacttgaacccctgggaggcagaggttgcagtgagccaagatcgcgccactgcactccagcctgggcgacagagggagactctgtctcaaaacaaaacaaaaattagccaggtgtggtggcacattccttagtcctagctactcgagaggttgaagccccacttgaagccaagaggcggaggttgtagtgagcccagatcgtgccactgcactccagcctggatgacagagtgagactccgtcaaaaaaaagatcaacacaatacattttcctggaccctcagctttccttccttattgaaacaaacatggatattgccttagttcttttttggttgctataacaatgccacaggcttggcaattataaagaaaagaaaattgtttgacttacaattctggaggctgggatgttcaagagcatggcaccatcatctgtttggcatctgatgagggccttcttgttgtattatttcatggcagaaggtggaatggcaagagaacactcaaaggagaaacagagaggaagggggctgaacttactcttttatcaaaaacctactcctgagttcactgacctactcccacaataatggcattaatccattcatgaaggcagatccctcgtgacctaatcacctcttaaaggtcccgcctctcaacagtgttgcgttggggattaagtctccaacacatgaactttgggggacaccttcaaaccatagcagctatattgaggaatacaatggaaattaagatgaatgtttgagataaggcacaaggtgttaacaaaattgtggacttttggctaagctggagatctctaggatatataaattctctctcctttgctccaaggatgatgaccttggtagtgaatgttgaaggtcacagagctgctgaagtggtcctgaatggctgtggagaccaagcttttattttggaaagatacagaacacccatggtgttcaccatgagcttgtgatttaaaaaagaatctcctgcatgctctcaaagcatcatgcagattttggtttttatccataatacatccctgtttattgtaatgtaagaataatgtttgtaattatctcctagtgattaaaataggaggaagatgtgctcattagtctgtgtgtccgcctgcctgttgtcaagtagtcaagggaccgggttcatgtccccagttgtagaatgtggtaaggtcagctctctgattctgttaccctatcccttgcttgcttcccaagtcaaaatttctttttcttccaggcgtctggggtcaggttagttcttcttgattgttggagataaatttgctaatgttcttcatcaactccaatgacttagttcagtatttataatctattttctgtgattccaaaactaaacatttggggtagcaacgaatataccattctctaccttctaagaagaaattatgtttgttttcaaataactttacttcgcactcattctacttacattagaatgaaacagcacttcctctacgtccataccaccctgaatgcacttgatctcgttagaatgaaacagcacttcaagtacactttctgtgcttttctttaattaaaacaactaaaacactagatgatgtttgttttataagcaagagagagagtagaaggtaaattttgcagcacttggaaattgtttgacttcttaggggcagttacctaagttgaagcagaatttagagctgagttaaagaatttagtcactgagatagttgcccaagttatacatgcagacgttgagctcagaacttccatcactgcctcccttccctcagttttctcactttggcccaagggctttatctagttgatcctggactggaacatttaaaggagattttatagagactttgatttaataaaagatgaatcaacagtaacatgaagcaaagttgtctggcttagatgtatagcttctttcatgggtctccaataaaaaggttggttcccaacaaatcttttatttagttggcaagtcatgtgcccatttccagtcttctaggaggaagaacctcatggtgtcagtcaaccatctagtcattagggtggcttcctcagagtcactggttctctaaaacttgttcctatgtgtgtcattccccaactttactattggtagttgtcaaattaagagagtattaggtacgaatacttgtgtttgtgtgtaagagacagggtcttgctctatcacctaggcttgagtgcagtggtgcaatcatgattcactgcaaccttgaactcctggcctcaaacaattttcccacgtcagtgccccaaccagctgggatcacaggcagatagtattttaacatttttattgatatgggaagctgcttagctctgtaccccagtttaccttacaataatagcaatgaagaaaaggtgagaagatataaaagaagacatatagtagggtgagaattggattcttaaaaatactgctcagtctggctacaactcaactatctacgcccaaatgttttctttgaagatcaagcacctacattactacaatatggggaggacataatgagaaactttgtggtatagagctgagaatggctcctaagccttctaaatcacagcccttagggctcccatggggaagtggagttcatatgccatgatctagcaaggatatcttccacctgagaaggtcatccttggaactggcaggtgccttctggatctgtgcatgtggtgaggggaaggaggtcagaggtgctggctgagtcattcggattagccctagtggtggcaggtggccttcatgtgtgtttcagctgccagaccttaacagacgtgcacattcaggcacatacttcaaacgggcagccttcaaggcaagggagaggggcgtggatacacttttatgcactgtggttttcaaaatgttacaagtaatacatgaatactttcttccaagtattctaaagctccctcagagtacctctgtgtcagtggaatgcccccctctggctccagtatggggactggagaatcgaagatacagaggaaattgaactcccttgaggccagttgggtaagaaggaagtgccatgtttcttagaagacttctggtgtttgtagatttgagaagggaggtgggagaggacttaggtgaatattaaaacaaacacataaaccaaatgaagacctctatctttccggcatcactaataaaaaaaaaaaagggagaaaaagctgaaagtaaagcataaaaccccagtaaacacatcagaactaccaaattagtcctctgcacaaacacacctttatatttagagctggaaccactttgggagtgacctttctcggaggttgctggcttgggcggcagtgggactctcccaagcgacaaacactctttagagcccccgtccgggacaccactgtatacattagttcatgttttctttggcttaaggaatagtgatggcattgcccttctgtttttccccctttcccaaaatgagtgctaataacttttatataaggaacattacctgttcgttcagaagtctggttacatactcccaggcagaagtgcatctccctggagagggagactgtgccatttggaaattattttaaattactgtttactgactgtcggcgaccatcagagcacagtaggaaactttgtagggagaggtgtgtcataaaaggcgtgacgtatcttttacaccctcctctcaaagcagtgggtgtacacaggataaatgcacgttgtagaaaaagaagtgtgtatgggtgcagaactttaaaacaaatattactaacagctcacatgtattgagggtacttgttccaaacatcgtactctgttctttaaaagtgctctctcatcgaatttcctcaatccttgaggtagttgctgttattcctattttagagataaggagactgaggttttaaagaagttcagtgccttgcccgaagtcacacagccagcaatggcagagtccacatgtgttgtgtctgactccaaatcccgtctcttggccacaagaggattctgcctctttctaactgagcacatatggggagctgcttcctagacattgtttctgtggtggtaaactttggagtttcaaaaaccgaggcacagggtagacttgaaggagaaactggaactgtgtcataattttagggtttcagacctagaaaagagtttgggattatctggtcttcaccttcactgtttttgctggagtctgtatgaagtgacttctgaaagtcactaaatgagtcagtggcggaactggaatcgagtctggacaccagacaccacctttctgccatttggccttcatccttcccattcccggagggcactgtctatcatttctgttacctctattcatcatttgatgtttactcatctggcctcactgattattttctccagtattcgtatcctatttctccaacaagattatacactgaggacaggtgctgtgcaacttctttttcaccaagctcacagtccactgcctcaaacaggtaggcattcaaatcctgtgattttagtgttgcattaggtgtgccatacaactgtgcctttcgggaagcagtgtttctagacttggctctggatcctgagggtctccccaaggagccgagtaggaggacccattcttgccctgtggcccaggctatagcccagcaaatatttgtggtgggtgcccaagaaatccagtacgttattgaagtgtccccagtgccaggcaaccatggtgccctctgggggatgctcaagttatcagctccactctacacctgggtggatttaagctctagtaagattttaatttgtaaacttatttatttttttttttaaatttcttgagatggagtctcgctctgtttgcacatcccaggctggagtgcagtggtgtgatcttggctcacttcaacctccacctcccaggttcaagtgattctcctacctcagcctcccgagtagctgggattacaggcgcccaccaccactcccaggctaatttttatatatttggtagagacggggtttcaccatgttggccaggctggtcttgaactcctggcctcaagtgatctgcctgcctcggcctcccaaagtgctgggattacaggcgtgagccactgagcccagccaatagtgcacttattaagaatgataataaaaatgccattactcttacatagaacattctcttggcccaagtgttctcaggtgcactatttcatttcatctgtactgagctctcatgaggccattattcttattttagagacaagaaaaccaaagtgaagggggagaggggtactcaaatagcaaagagatgccatctgaggtcaggaagggattgatgagaaacagccttttcctggtacctccttggggcttgctgtgtctttttgtggtgtctggtgagtgtgtttgggtgtgtatgggctttcttccctgaaaccacaggccacctttgggaaaccaatttacagctccggttcacctcactgtaccttactccatgggctgtgtggttgaggatgtgtttgagttaagtaggctctagatagcacacacactcatttatttccgtgcttccctcacttcactgtagtgctcatttgtccaggcttattctagggaagcaggaataaatgttctcgcacttgtgttgtgtttctgtgatcagtttaattctgcatctcctagtgggtgttagactgttcacccaccacagtggcacctctaattctttttaaaaagcaagggaggctgggcacggtggctcatgcatgtaatcccagaactttggaaggccgaggcgggtggatcacctgaggtcaggagcccaagaccagcctggccaacatggtgaaaccccatctctactgaaaatacaaaaaattagccggatgtggtggctggcccctgtaatcccagctgctcgggaggctgaggcagaagaattgcttgaacccgggaggcggaggttgtagtgagccgagatcgcgccattgcactccagcctggacaacaagagtgaaattccatcgcaaaaaaaaaaagcaagggagactcttcaaacttaaatttcttttaatccttgacttaatatacattttttttatatgtcccccagacagcttctaacttagtaagggatcaatatatatttgttaaatgtgacacagacaattctatttttattttattgttattattatcattattattttgagacagtctcactctgttgcccagactggagtgcagtggtgcagtctcagctcactgcagtgttgatctcggggctcaagccatcctccccgttcagcctcccaagtagctgggactacaggcaccccctaccacacctggctaatttttgtattttttgtagagatggagtttcaacatgttgcccaggctggtctcaaactcctgagctcaagcaatcctcctgccttggcctcccaaagtgctgggattacaggcatgagccactgcgcccagctaacaactcttttttcaatctgtacctcttaacgacttcctagtccacacagtacagtgcatcgtgttgctgtcctttatttgccctaacactatcattaaagctatgtccatggttacttcttgttccctcttattgaatatttagtattcagtagccaagagactgtttatattctgcttaatcctcaccaaatttctgcaaaataagtagtatcgttacttttattaccactttacagataaggaagccaaggcacagaaagattgagtgatgtgctaaagttcacatggccagtaaatgacaaaacccatgctcgttcatacgtaccatgccactgtctctgtcagcttcaaggtgtgcttcttggggatgtgggctgaggcttagtgagctcgtctatttttgctgtgtttgtacagattcagcctcagcaagcacacagcaggcctggctgtgggaggcagtgtggtttagagcaaagagtatgatggcctttagcatttgttagtctggctttggcttgtactctgtcactcaccgcctcaccacattatttaattgagtctctctccattcattcattgtttcatccccgtgttcactgagtgcctattgagtgtccggaactatgcccagtgatacacttaaataaaaaacagacatggttatcaatcaagtgatcatagttctgagtataatgacaaactgagtgaagttccctgaacgagcaaaagccagtaaggaagactgggaggtctgggaaggtttcctggaacaaatggcgcttggtcagaggccccatgtcagtgggggaatatgaaactcttggagaactgaaaagataggtgagaagtgcgaggtctttcaggccatattcagggtctccaccttctttccaagagctgtgagtagtcatgaaacggttttaagcaactgtggtgaggatggtaggggctgccttgatcacacttggaagggatggagtggacacaggggccccatttaggaagtttttagtagctgggttgagaaatggtggtggcttgaatggcagaggaggtggagagaagcaaatgaacttgagagagattcagggggcaaactgccaacaagacatggcgatggataagatgtgaaggagtgccagagggggaggcaagatgcacaggcttccagcttgccaacctggaagggagggtaccttcttcattgagatagggaactctaggaagccccccacaccagattggtggagggagattgtaactggggcatgctcgtgttgagtttgaggtgtttttgagacatcagagggggattgttgaataggctttggttgacagagttctggaggctgaaagagaggtggggtagggataggacttggtgctctgtgtgtacaaagtaactgaagcagcccaggcacggtggcacatgcctgtaatcccagcactttggaaggctgaggcgggcagattacctgaggtcagaagtttgagaccagcctggccaacatggtgaaaccctgtctctactagcaatataaaacaggccaggtgaggtggcccacgcctgcagtcccagctacctggggggcaggagaattgcttgaaccgggaggcagaggttgtagtgcgctaagatggcgtgactgtactctagcctgggtgacagaacaagattccatctcaaaaaaagaaaaaagagaaagaaaaaaaagtatagatgaacttgcccaggaaaggagtatagagcagacgagacagcccaggactgagtttgcagaagaaactaaaagggagcagccagagagataagaggaaaaccggagttctgagaaagggcttgtcaagaggaaaggcaattaacagtttaaaatactgctgctgagatctcggtaatatgagatcctaaaatatgagaactgaaacttggttattgaactttgcaacatggcggtcactgatcattgagatccatttggtagagagatctaggcaagagtcaaataggaaagggtcagagtaaaaataagagatagggaaatgcagacataggggcaagacagcttttatgaaatctggctgtgaaggagaggagagagaaagggtttgcactggagaggatgcacagcaaagaagcgtttgtggcatttgtatgattagagaaggtgagatctgagtgtatgtaaatactccccgggaaggaaccagtggagacagaggagctcactctccaggagagagaatggatgattgaaaaggtaaagtggaactatcttctccataagactgttgtgaaaattaaatgagataacatgtaaagttatccggagcagttgctgttcctgtcctctatgacgctgtatatttttattgggtcgcttcaaaggttccatttttctgggtctgaaaagtcttaactattttttattcctctttgccacttattttctttctatagaaacatgctttcttttcatttaattaggtccattttaataaagggtataggagtttacaactcaaaacaattcgtaagaactatcagatacgtacgataaatcacgccaagggcgcaataacgtaaatccagtggtctgcaaatcagaggcattgtaaaaattgttaagattgactttcatgtcttccccctcctttctcttgttcacagcccgagattatgtacatattgttttctgaggcctgatgacctcaatactccttctggctggggagacctcctcattcagtccattccaaatagtcagcagagggagttcacctcttcttcatggaatgagcatggtccttgtcctttattatttggtttctgtctcctagcaaatgacattaaaacattttgcaggccttgtggaattctggtcactgttgccctccaaatgccacacatgagccctcaggatgagccctacagagtttcatccttgtagataggaagatgtgtatttgggaacgaggctaaagccatggccgatttccccaacatgctttctatttctattttcgttaatctttttaagttcaatttttaaaatcatctaaatgaatctaaacattctttagcaatttgcttaaatcatcttgtatattatatagaaatgttagatgcatttatttctagcctgcttactctgtatttcacataggaaccaaaaatagtctttccttcttcccagtttccttttgtgattgttgacatttttttacgtttcatcattaaatttatgacttatcttcttgtacctctgcccttcttattatctaagtccatcctatctatttttaaggaatatgaaagtatgaaagtaatcttcagtaccagttctttccaaatgaatcgactgtcttttcatggtgctcgatgggtctgtgtgtaggcgtctgagtgtgtgtaggcgtctgagtgtgtgtaggcatctgagtgtgtgttcggatcacgtgatagtaaagtgttcacagtgttatcacaagtgttattgcaaaataaagcttctctgtgccaggataaattttttaaaaattcatgtctcaattcagatattttttccagagttgctttaaaaaaaaattaacacatttggcaaaattcattttttcttgcaaactcctttgaactttaaatgacaatgttttatatgagcaagggggaagatcaaacacaaaagagaaggaagtgtagtaagttgatcttggaccatactttgaagtggtctgttttctcagtaggatgctaacctacagctaataggagcagctgagggaaggagggaccagctgtccccaaggagcttggcagccttctaccttgggattgcacagtcacctcctccttgctggggctgcagagtttacgctgaggaagtgaaagaaggttgtgtgtttattacagtttgaggtgtacttttcactccaggaaggggaagcccctagaacttttcccatttggcaaggggtaaccaatgcttgcaaaccaagaagtgtagtcatggagatgagaaagtttagatgaattctgatctcccagccccaagcacctgttccaggtagctagacgcagggggcccctcaaggttgaaggtgtatggtagtacaccagatagcttttatggtggtccgcttttagcattttataaaaagtgactagtacttgtcttctacccactagtgtcataagaagcaaagaagatagcgggtctactaagttggatgttcttcaaatagatgatattttaaagtgcaaggaattattgctgtaattaatatagctgggagtgtggtggctaatttgcttgtttctctcaatttcttttcatgtgtcataactgagtgcttgtttgtagcttcctttgtaaatcagaagagttatttggtgttagaaactcagaattgtcagacacagtaagattggttgtgttttattataggatttaatgtcaagcctgtcattttgagtgatgagaaactgggaaaggcgtccttcactgacatagtaggagaaggaggcacttttgttttcaactccaatttggtctgaagctattaaaggaataaatggaggtcgtgcaacatgttgattttagactcttcccatgtctgctgctagaaggaacgtgaggagcagcttagtattttgttgtgtcttgcagacttcttttgccttaaaaaaaagtctgtttatggagggagaggacatggctgaaaaaacacttgtacataaaacagctgttaagcgaatctccacacactgagatcaagagaacgtgaagaaatatgtccttccaaggacccttttgccaacttggagcctccttcagaaaataaatacagccacgctacaagtttctggtaacttagttactgaaaaataaattgagctacttagacccttgaacctttattaaaaaaaaaaatctctgaattctattgcagtgatgcaaatgaagccagagaaactatgcagaatgtttctttgcccttgtattaacgaatgtgcccctgaagagtcttgaaaatgcaggaggcagaagccccggcctcctagtagagggaaagcacgtacacgcgtctttggtctctaagctccatctgcaataaggaaagatttcctgatagtgaagttttctctggatttttttttccttctccgtgacttgctgtggtaaaggacagttgtgctcagtggcttccagaaaagctggacgtcccaccatgatggcacatctgggcacaccacacctctcctctctactactgggaacactggagaggactgactgcctgtggcatatgctttgtgcttggagtgttgcttatgaaagatgaggcccctttaaaacctcatgctcacacttagagaattctggtcgtgtgctacagatgttttacagtttatttccaaacagctgcttttcccttctttagtctgtttttttttttttttttttttaaataaaatccctctggaaacctttcagctcacatccttggcaatgcttccttagtacaagtccttgcattctatgccatgacattctcccaaccagcacctgttactacaggcaggccatcgacttagctgttctgtgagttagaagtactattgtgtatgtggatcagaactgtagattcaatcagcctagaacagacagcccccagtgacaagccctccctagcacttcatgagaatacacagaaagaagaaggaaaaacttgacttataatgtatgtctccctcggaacatcaggtagaaaagccccatgcaggtgactcaatccagggtcaaagcagggagggtttccctgagggcacagcaatttgacaagtttgtcccatttcaaacttccccagcagccagctgtcaataatatctttgaccttcagaggtaggaagagcaggaataattaagatccacagatgatccccgaatcctggtaatgattttcacatccttctttctcatgatccttttccccagagctgccatttctctaaactaaagtgacgagtgtaagttcagcctcctttagtttcttttccaataatcttctgataaagatattaggaagaagtaaaagtccaattgaagagggcagtatcagggagggaacagaagtaaagagtttgggagatcattccttgaataactaagtgttgatcggctcttgggaaaatgtgttgatttgtcttctggccagttgtacatatgcagatacaccatctgtactgaaaaatatgcgtgaacttctctggaagcgcctgagtgagtcagtgtctgaaaaggagctacacctctaaaacagttatcaagtatttagggatgaggtgctgcaaagccaagagagtgaaaacaatccttaaaggcgtgtttggccagctctcaaaaatcttagacagttgcaacacagtccttggctcagacactggatttttcccattcatgtacttttttgacagatgaattgttgcaggctgcaaaaaaagctcgaagaggaatctgttagactcctcactcagagcagggatctatttgcttgcaatcctgttagcaaaccaaggtgccatttgctttgtgtggtgtgctacttggccactttttcttagccgtggctgctctgtctgaaacggtcatggtctcattcagctctagcatatttgcgtgttaggttggcatgaagattctcaatttagtaaatgctagacactagtataacttccctgaattcctgcctctcaactcctatggaatgtttatggctttcattatagtaataacaagatttcttgcacaaaaactcacttgaccttggcactttctttctagagccatccttcctttttgctgataggtgggtttgcatttatttttggcatgactttttcaccttctgaattgctgactatggtagattgatttttttttttaaagaaacgcaagtcattttgatgaaacgatcaacccagcctgatataactttaagtatagtttcacaccacatgtaataaatgtgaccctttagagatattagaaactgatgatgaatgtttagttacaagaatagttcagaccctcaggtatgggtattctttgcacaactctggaatatatttcttgaatcactggaagaagatggagtccttggaaacatgttgtcaggggctcaattacctttagacctttaagtgttcttggccaaaggcttggtagtaattatttgagggcattagtgatagaccacatgttaaggctgtagctgaaaccaagagtcatcatatgcatcctgtatggaaagaactggggatcatacttcagtctttccagccaaactatgtgtataccatcactaacttaagaaacacagtgtatgctattgtgtgctggtacacaatggggaaaatgactggctgccttcaaatcctgtcttctatgtctaggctcaacaacgggggacccctctgtatgtttttatgccgagaactaaagaattttaaaaataaacttggatagttttaaagggtgtaatatcctatgaattgtaacactgtatatatgctttaagtgtattatcaaagagtcaaagttatggacttttctccttcatacttggaaaatgttcatcattgtaaaacaaatggcagcaaaaccagtccttaggatgaagcaaatcagaaggagtgactttgtttttaaaatttaagtaaatgtgttaacatgtcatttcaaataatcatcttgcttctgaactaaaattcctaagatacgtagatagaaaaggcagtgagtttgtcacctggtagaaataagatccctcccaccccttattccatcctatctctgtttttttttttttttttaaagtgttctgtgctttgctctccaaggtgcttcctcaggaatgcattgtcaaattactccttgtatttggcaacccaaggagctttttcctccagctttattgaagtatagttgacaactaattgtatgtgtttaaggtatacaacttgatgattggcctatgtatacattgtaagatatccagtacaatcaagtaacatatccatcacctcggtgttgttaactatagtcagcatgctgtatgctagaccttcagaactcgttcatctcgcacagcagggattctgtacccctagccctacgtctccccaaaggctttactacactggtcagtaaaggggaggaggaaacgagaactgaatgagcaatctcaggctaatcggtttcaggaaggagttcatatggaaactgaggttctggaaatgtaatctacttttaagaatcaaccacacctgtgcctcctccagaaaatctttgtagtgcatgactcttaccaggcgtatatgtagaggaaaaggtcaaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagatggacagacaggttggcaggtgctcctggagtctcatggagagggggtcacttgctcccaagcagccagttccaaagtgtcttgacggcttcctttctggaagtactcggggctggttagtaattatttcccagcttatgggatttcttagactctccctggctggccttttaaaaatgaatgaccctcctatcctttcaagatgaagcaggctctttaggccctctgataccccttgccagcccacactgagcctgtgggacctagagacaggcagcttttcacaccttctggattgctgattatggtagactgatttttttttaaataaaatcaagtcattttgatgaaatgaccaactcagcctgatataactgggtctgctgcaggagcaggctggctgggttctgtgtccaaagacctgggcctgctctgttgctccttctcagggttgccagtgctgcttggcactgttcagtgtctgtggaggtgttgtctagggctgttccctctgtccattttctgtgagcaatacatgccccctgctcctttccagaaaccacttgtattttactaattgctacagtcagctttctgaacgtgggccgcttattttgatactggcttgagaacacacacaaggctgggtgcagtggctcacgcccgtaaccctcacactttgggatgcggaagcaggcggatctctttagcccgggagtttgagaccagcctgggcatcatggtgaaactccatctctaccaaaaaaaatacagaaattacccaggcatagtggcacacttctgtagtcccagctacttgggaggttgaggtggggggatgacctgggccctggaggtggaggtttcagtgagctgagatcgcactgcactccagccagggtgacacagtgagaccctgtctcaaaaaaaaaaaaaaaaaaaaaaaaaaaaaaaagacacacacatatacagctgttcttgttggggtgtgtgtatattaagtttgttttcaagtaagcttctctgcctcctgcccttctactggttgataatttttctagtatctatcagggacagcaggttgatggtgttggcagagtttgtccgtagcatcatggtccttgaggcttttgtagtacaaacaaaacagaataccacacaactaccagttctctcactccataggacatcgccacatggcccaatactccttcttgcaggtctgtccttgtcacacggaggattctaacatgattgactctgttgggtcaatttctactcccagctcttctagcctcacaaatccacttatctccctttccatttgcatgttcgagtccaccctttctgtaggctccttcccatgagcatttatacacgcttgagtctgtctgacagaaacctcccttggccccttcaccctaaagcacatgtgttctctcccctctcctccgacaaaatccaaaagtatggtctacactcatacttcccttccttctcttctgctccccttgactcccttgcctctggtttaccccaccagagggtggagggggcatggtcacttgtatgagaggatggcaaagttccttctttcttaaaatatgtgacttctccatcatcccagagcaaatcacatcctgttccactacttatttaactaatgtcaacgactttggacgatcctaaagcattttcagtagacctctgagtccctcctctgtgtttgcgtccactcccactgcttcggtgagatggatcagtgactctctcattgccacatcttcttcctgtggggagcagcatcttcccctagcttctgtgccaccctatctctgtctgtcacctctacagtcactgcctctggccccttaaatgttagtgtttttcaggcactgtccttggccctctctgcttctccatcttcatggcaacctcacctcctcccagcgcttcagttggtccttgagctgctgccccttaacccagaattctgtctctggaacttttgactctcctaatggcgctctgaacatcactacctggaagtcccagaagcccctcaaattcagcatgtaggaaacttatttcattgtgacccccatgcctgccactctttctgtgttccctctccagcgaatgacgttgccatgtactcagcttcctaagccagcaaaaagggctttatcttagattccttcctacctgttgtcttatccccagtttcaatggccaaatcacatccattctacctcagtatattttatatccgtctacttatttttatcctttgccaccctttgcctcctacttaagaatcaaaaaccctgtaagacttccttgacctcataagaacaggttagattcttgtatcagtcagagaaacaggaccaattggatggatggatggatggatggatggatggatggatggatggatggaaacttattttaaggaattaatcttgaggctgacaattcaaaatccataactgcgggaggagggtgctaacaattctgaatctgtagggcaggctgtaaactcaggcgggaggtgatgccaaagtgtcgaggtggaatctcttcttacctgggaaacctccgtttttgctctgaaagccttcaactgggtggataacacccacattatcaagggtggtctcctttgcttaaagttaactgattgaggatattaacctcatctataaaacaccttcacagcaacacctagattagtgtttgattacataactggggaccgtacccttgctcagttgacacgtaaaactgaccctcacagttctccctctgggtggatattcccacaccacacatcttctaaacagtattttactatattgaagtgggctgtgtactcacctgtgtcccccactggactgcaggcaggtattatgtcttgtccacctaatggctgcataaaataggaatacacacagacatacccgactcaaacagatacaaacacatagacaggcacacaggcatacccagatgcgtctacatatctgaaagtgaatgaatgaatgttcttagccttctgttttttcatggatggtctgtaggaagcaacattccaacaaggcagagccagtaacagaggatgcttgatggcagggaatggttgtcagatatgaaaaatgtttcaatgggccctacaaccaacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaaatatagttacgtgtttttttcattatgtagcaactgtgcatcttcatgtcacaaacttgcaagaaatagaatttctttattatcttataaattggtttgtctcacttgtcccacttctgcctgatgggagaaacttgatatacagttaatgccaggaaaactcagtcgattaagagtttttttcaggtaagtcttaatattcctgtagatgaatggataaacaaactggcacatccagacgatgggctattcttcagcactaaaaagaaatgagctttcaagctacagaggaatatagagtttgctctacatattgttaactaaagaagccaaactgaaaaggttacatactatatagttccaactgtacgacattctgggaaaggcaaaactgtagagacagtaaaaacattagtggtggccaagggtttgggggaaggagggatgaatagatggagcccacatgatttttagcacagtaaaaatactgtatgatactacaatggtagatgcatgtcattatacggttgcccaaacccatagactatacaacaccgagagtgaactctaatgtcaactgtggaccttgggtgataatgatgtgtccgtgtaggtccaccgatgataactaatgtaccactttggtgcaggatgttgatatgggggaggctgtgcttggtgggaggcagacagggggcatatgagaactctctgtaccttgtgctcagcatagctgtaaacccaaaagtgctctaaaagataaagcctattaaaaaacaaagtcttattagtcctcctccatggggttgcttttcatttatggggagttcacatggcttcaaagaagtgagaggcgtgtgaccatcctcagtcgccatgattccagatatccacgggctgtcagtcttctcatcttgtccccaggcactgccttccctcaaccctgatgcctgctgatgtgtctgtgtttctgcctgagccccagccacctagtccaggctcgcatctgctgctttcatactgcatggcattttcagagctgccagctgcctattccccagcacaggatccacaggcctatctgggagttctgttgctctcattcgcaagctctgtccatgggtaaggctcgtactcagaggcctgtggcactgatgctcttcactcttgctccttatggccccttgacttggagattctttttgtgtctgggaaggagtggagggaggtacacctggctcagcatgtgttctgtcaaacctattacttatcaagggtcttgactcttgaaacttgaaagccaaaagttgggccatttggttctcttgttctgctgtaaggatttctgtctggaataatgggttgcttcatgtctagtagcccaaatagaaaagtgtcatggggtaacaacaagaatgtacactttgggagaggccaaggcaggaggatcccttgagcctaacagttctagaccagcctggcaacatagcctctctactaaaaatttttttaaaaatagctgggtgtggtggctcatgcctttagacccagctcctccagaggctgaggcagaaggattgcctgagtccaggagttccaggttgcagtgagttgtgatagtaccacagcactccaggctgggtgacagaatgaaaccctgtcccaaaagaaaaaaaaaaaaaaaaaggagaagaagaatgtaaagggtatgggaaagtaatatgttagttgataccttacaataaatttgccacatttacaaccttaggagatcgtattctcagccctaggttgaaggtgaggaaatgtgaggcagggagttggaagagccttcacttgcccagggtcgtaagtgataggacagggatttggacacaggttggtctgacttcactgtgccatactgctcataagaagagaacatggaggaaggatcactttctaagggatacccaacagtgtgaaaagacccatttatagtatttctgaatcctggaaaggctctccctattctatagagaaattttccaagacctcaggattccagtactatccatgggaacacaggagtccttgacaggaaacatttattttccagtttttccagtttattaaactgcaaaataacagccacccagttaaggaaggaaagcatgttgaacatctctttgccaggcacgggagataaagctcctgctgtgttctgggttttacagacataaaggaaatgaagcatagtccccatgtctgtaacctttcatggggagaaacacaagggcagacaattttcattcatccccactcttgagattttgaaagaggcatgtgcaagggcagccagaaccacaaggaaggaccctggcctggtctgagatggtcagtgtgggtttttgaaggacagagtcaagtcctaagaagaaggaattggcctgggaagatgatctagagagtgtgactggggagtgctccaggctgaggggatggaggaacaaagcaaggcagtggtaaaacagccctgttagttcagggatccccaaggcagagggatgtggctggacagagaggcaaggtcctggctacaaagggctagtttgtcatgaagccacttagattcaaccccacagctgatgacaagccattgagggagtttaatcaggagcgatgtgaccagacttgtgtttttaggtacactgctgggtggcaacgaagagagtgcatgggatagaacttggagaaggagggccatcacattgtccagcagagagatgagggcctgggctaaggtagggatggaacagaaggagagcagaagacaaagccagaaaaccccggggaagtcaaatgagtgggacttagtgctgattggaaaggggagagcaatggtagggaatgaggtgttgaaggtgactcctgggcacccatcttgaatgtatgggtggatggaggcgcctctaaatgagagagtgaggagcaaaagtagatttgggggaaaacatgatgagttcagtttgacatatgttgaatttgaggtatccttgggagatagcaagtacgcagttggagtcaaatctatcatttgtaagaaaggtgatagagatttaggattggaagtctatagcctggagtaagagttaacaccatgagggcagatgagattgcccagggagagcacccagggtgaaaatgaaatagttcttgagatagacaaagaagcaagcagtgaagaggatcctggggaggaggttggacacaatcagacatctatggaatctcaaaaatggaggaggccagtgggatcagtaatgtcacattctgcagagaagtccttaaaaagaagagtgccatctggattgccagagggaacacattggtggcccaagggaggaatgttttggcagattttatgaggatgaagccaaactgccaccctcgtggccaagatggccttgatcctgtcgcaggaaagtcccttctgtgcttggtagaagaatagtacttttttcaccctgttccccacactgttgcattaagcatgctaaatagcatcacccccttcctcatctataggaatattaattttaggctttgtcttgctgtcacaatattttaactaatttttcctaagttcttatcaggtacataatggacattctaattagaaaaaaaccatccgtatgccctaaaccttacctctgagggtatcttcatagtgaagaagtttctattttgccagaaaaaaagcgatacttataaaataaatgttttctcttttactacttagtagaaccaatacataatggaattttagtttcatttcataaaatatttactctgtaagcaaattaaagtgactttttttaaacaaaagaaggttgctgtattcaccattgaatcaaatctttagatttccaaattagtgaactaattctgtgaaataatcatcttattcatagctattcaaatctttctggataattcgttctgtttcccaggtatcggcacaatcataggctcataaacagaactccaatgcgttgtttctgtttctctttgtcatgtgatttagggtttatttttgtttgtcaatttaaattctaagaatctagatctcagtgtctccttgaaagaatactttattaagtactacctatttgtaatatgtttcaatgtagactaaccaacccaataatgagtatttggtaaagcaataggaaactttgcagtaactacaacaaatatacgtcatcatactctttgtggagatgacacgctggaaatttcaggtggtgcttatttttaaatgtatgctctatttaatgtgtccctaagttctcagtctccaaaataaatctaacacgggcagcacccccctcccatccgccacacaaaacatgagctgttacacatcccgagtaatgaagtgtatagtcgcttcagctttctcttggcatccgaggctaaggagctaatattctaagaggtgatgtattttaatcctaataagcacctaagaattcattgagtgaaaagttaaggttagcaatcaaccttggcaaactgatgcttataaattataccaatgtgaaattgtgtttgaggtgagaaacaagagtgggtgctgagagggagtaataaaccatccaactgcaaatggcgacatttcatcacaccactgttctcattggacattattcacaagcatacttttgatttatttttctcagtgggtctgtaaatctctttcttggagtgcaaattgcatgagtagtaagttccatgtgccaggagatggcttggttcatctcttagaccttgactttattaataacagcaacaaaaagaagagaccgatacaagttatagagaacctcaaaatgaaaagcaaatttattctagattctacctttttgttttatgtgtgtttttcttttactaaacaatcttatctggtaatttgttccatcatgatgctttgagaaacatagaaactggttattgaaaagatcagatgtatacgttgatttttgtaaagatcagatgtccttcccctaagatagggtgacttctactgccattgtgttgtagatcttgtgcctgtcattctttcccttaagctaaatatgctctagtactctctctaagtctaatcttatagtctgttaactagttgacttgtttggtggggtgtgaagtaccaaggagaccaagtcttggatttaatgatgacaaaagtcaacctatattccacatatgtccttatttctgtagagtccattaggcttcttgtatttgaaggccacagggtatacctttaggccactcagccaagttcttgccatgagtcacaaagcagaaccagatgtaagaccagagggtgaggacttcgagcccagcggggaccacagggatggtctggaccactttcctcaccttactgatggtgaactgaagccaaaagaggtcaagtccctgttcgcagtcatgcagccccttagagttggctctgggtgaccacccttccagtccagcactgtttctgatacagtgcgcatgagcatctcagcaagtatctcacatcatttttgcaaatgagcaaaaccacactaatttagggttcgtgttctacctgttcccaacagtctgcttcctacttccaatgccagtgacactttgccagtcccattcatcttggggacaatcctcagatgttccttccacactcactcactcggcactgctgcttgccacacactgtgctttggttgcaggaacaaggacagacctccacctgttgagaaaaactatttcaaaataatccttgccaccacaccacatgtagcataaggaaaattataaagtaattcccttagacttagactttgtaataaccagctcaggaaccagagaaacccctgctagggttagaggtgactttatttcacagattccatggccagacgccagagtgatacagagaaactcggaacgtggtcaccagtgggccttctggcaggcctagggagattggatcatctcattacatcatttttaattattacctcttgacctcactcactttctctcaccacatcatgtactggttttaattggtcagtagccgaagagtaacaagcttactcgaaatttccaacatagaacatgaaaactttggctactgcgaattccaaggttttggatggcaaaaatctggcaatgactccaaaggagggagagaggagagagcagcttgttcaatggaataacctcattttaaggctggagtgccaagctaatttgttaaaattactatactcctttctcaattatccatctcaaggtttatttatgttgtggatttgtgatggtcgccacatctcagccaatcaaagtaggggacagggtcaggtgcgaaatcagtaattctgtataaagtagaattcagaaaactgctagtcacttggattaattcagggaagtcctgttcagattattgaaaagatcaaagttatgatttctttttttgaagaagggctatttgattccaactgaatgttagtgtgccagttatttaactcttctgggccttccttataaataaggagtatagacaatgatgaaattaaggtctcttctaggcaggcatcctataagattagaactattactttgaaatacctacagcaactggtaatgagctggcagagtagtcctcaccgctcagcttactttaataaataagcagccatgatttatagttgacaagagcaccagccaaaatctattctccttgacttatagttacactgattataaaaaaaaaaaaaaagataatgtctctggtgcttaaaagcatattatcatagagtctttaaaacttgaaaggattttgattttattctctactctcattcacagttgagcctgtgccctgacctaggtgtcatctgcatttgcttaaggaaccgatcacttattgataggtgcaaatgttgaagggtcaggtgtcatcaataagcatacattccaaaatcatgaagtcctgaattgatgaagttctactgcacggttcttttggagttgtttatattaactttatcaggatatcttctctcatccaaaagagatgagtgttattacgataaaggaaggggtgtgtgtgtgtgtgtgtgtgtgtgtgtgtgtgtgtgtgtgtgatctaaaagaagccaccctggcatatgatttcttccctcctcacatacccacttccaaacatgtcagatttactgcaatcctttatctcagatgcctgtactataaagtgggataatccttatctttgctacttcacagtgagtagtggagacaaatgagatagtaaataggagcattctttgaactcttatggagagagcttttaaatacagactttaaaaaagagtcagataattccagtggaaaattttgtagataatcaataatgtccataaaatgttacattagacctcacatctccttcacagaatggcctttgtccctgtagcctgagtgtctcacaaaatctctaacatttatatcctgaaaaagctcttcttctgtccctcccctgcccatggtgtctgggaggcccagtctaaaccatgtctgggtggcaaggtctttgttttcttcttattaagctctgggggtttgattgtagctctcccctactataaaagcacctttcttttcctctagggtttggggatggattgatatatttacttctagttatcctggggttccttttattattctgtcttatttccatatgcaggagcatgatagaagtatttattggactttgttttacaaaccaaccaataaattgattcattaaaacttcattaatttaaggaaattatatttaacccacattttctagggttctagggccaatgatttgtcatttgaactggctagggttaggttttcaggctgtggtcataaaataaagcggggggaggggggggcacatgtccttgaccttggctccagtcagtcaagttggtcagtgccaccatgtgtacttccatgagagcttgctgcaggtacctaagtttttcagaactgagactgttctcatctggccacttaatttggaggaagatatgtatctcagttccagaatgtagtaacgaaggcaaaaatgaagcaaaatatttctaaattgatgctctctcctgcacaaatgaatagtattcgttcactttgggtggcttggcatcaactttttaagacagcatttattaacttgaaccgaatcctcttaaaaattttcttgcataatttccaaactgctttgtttactgttttcttgaagaccagtcctcttgtttttggcattggctgatactattggacttcaatccagtgcttcatcgctgagcggtgacgcactgagaaactcgatagagaagcacctgcagttagtgacgctcgggtggactctgccaggctggatctgaataaatccttaagagcaaacccaggtgaacaggaaatcatttccttctggtcaacattgagctctgagatccatagtgatcaaatgctgaggtccaggacagttgggtgctgccaagtcacgtttcatccacaggcttggcatcaccttgtgacctcagtgggttctgtgaaatagctcaggggctgaagaagtctgtccagataatagagtagtgtcagagaaaaaatttcccaccacttttccctcccagtctgggagatgtgtgccaaattggggtgggtgggaagctgaagtggcttgcagaatgcagcatgaacacagatgccttctgcctctttgcaaggtttatggagaactgagacatgggggtgctgctcatgatttagtgggctcctgagccacagtagacacaacagatgttgttcttgttggcagaagcaacggcctgatatcaagcaatatggggtgcagatggtcctatactacaattgatgaatccggtcagcttgctctaggtcagggagacataggcactgcccagaaattcatagaaggccccttctgtcagggagatgtggagtgcccccagccagacagagatccagagggtacattccaaatctgcttcctgaacacagaggacctgccaacaggccatttagaaggcatttggtggaatgctcaagagaaatgcagcctggatgagaaccttatgtgagccatttaatttgctacctaactcagttcatctctttgtgtctgttattaaagaaaaagctctaaagaaaagcttacagatattttggatttaagagaagagtatgattgattatataacggagcccaatgggaagagtgtcttatttgatgttttccctcattcaatcattaaatgttaattgaggacctctgttctcagcaccagctatgatggtaatgaaacaggtatgatccctcacctctcccttgaggcccattcagtcatatgatggagcagcattcagagaccaatgatgggcccaatagctgttctttattgaactgtttcccagacgttgtaatcctcacaagtaaggggtttctaataaggcagtcaaaattaatggaacaggcccaccgttcagcatgacactagatttgtggcgggattgagtgaggacaacactatttgatgggcttgcatcagggagggaggaagacagggcagtcacttgatgaggagggatgggtgctgccatcagcaacaacctatgcaccttctgagcaggtcactgaaaggagaggaaggtggcagtgtccttggatggactgagacttgtcctttgattgtcacctgacagtgaagggtttcctcatcccagagagacattcttaggcaattgccttctttccagatggtgagactgagtaggtctggggcccatctggccttctggcttagagctgaatatgcggtagggaaggagggggtcagacactcatttattcgttcaccgaatgctcatagaatgcctgctccctgcaggtgctgtgggatacaacagatgctaagagagatatggttgctatacagatgaacctttctttccaaggagggagacaaaagcaaatcaacctgggaagaaaaacacttgaagttgtgatgggtgctaggaaggaagcctgcagaggcttgaatgggaaaatagtagactcgggatggggttggccagggcaggtcccttcctcccagggaagagtggcgcaggcagagggagcagcgtacatccacctcaaggtagaaagaccgtgactggctcaagcttggctagagcatccgtggtcaagagcagtgggacaggttggggagggaggtgacggccagatcattgagagttttagcttccttgaaaaaaagtctgggtttggtccaactcaaatccactgaagggtttgagcatagctgtgatgtcatcctagacaccactaccacattaatggtctctgtgggttatgatacaacactcaaatcttaggggattccccactgccttctcgttggcatcagcttgtcttaatctttcatttcttcccatcctgcaccttaagctctaacctaatggcaacctctactccctacacattcacagtctacttcaagcctttgtccatgccactgtctccacctacagaaaactccccaccctgcaaggcctggttcacgtggcatccccttcaccatgcctctcttttgtagttttctcggcccagatgtgatcgcccttctctgccagccctttgtaacttatgaataccgctatatttcattgatttcaagatgcaccatttttttttcacatttaacttgcgaaatcaggtcgggcctaacaattgctagtgtattgtttaattggccatgcttttcctctcttagcagttacataaatgaacgctgcattttactatcactggcatattagattggatgaaatatggtaattaatttttaccaggtactacagtaatcaatataattgcattttcccctcttgaaatcagatctctgagcataggagcacatggtccccctttcagtatcccaaggtaagcacactttttgacatgcaaagttggtgccctccaatgaatataaaatgctaaatgagaggaaaatgtgcaggaaacaataagggatttgttccagctggatctgacacactaaattggagcattataagagatggaaatgtctagagtgggatgagtgacccgtttagtagtaagcccaaatgtcaagctaaggaattctgatctctcaaggattatcccacactgtaaattgcaggcaaagccatcgggtaggaaattaaagcagaggttaaagtaacttttttttttttaaactctcacttaaaacttacatatttttaaaaattacctcctcttctcattagccatctggccatgcaaactggctttcacactcctttctttctttctttcctttgcttttttctttattattcagtagaggtgctggtttatacatagtgattgtcaggacagagttttcaggcagctctatgactattgggaccagtcgccaaagtccttcatttaaatgaccaatttcacattcagtctggacttcaatggggatgaagattttagaacccgaagacacatgggtaatgctggaagtctttttctctttccctatgaatggaaaattcattcattcatttagcaaacatctggtgtcttttacgtgccagtcacagtgctgggtttgaagaatacacagataaaaatatgctcggtcccttcacatagcttctattctaaacacaaggagagtttgttagtagattatttctacagtgtcatgtatagatgtatagactaccttctgtactggattggtttaaattagatgatttccatgatgggactagaggattttaagaatattttccaacgctttctacaactgatttttttttttcttagtgtattaaaaaacacagccattgcacagaaataatctcccactttccaaccaacctgatgcttgtaaactccctctcaggtcacaccagagggacgaaatcatttatagaaagcaaattactattaaatcctaagcaattttattgttgaaagtttaaccctatttatataatactgtcattgatgtgatgtaaatttctttgcccatttcaatgttttgtccctagtctacagattctattagatccagtagacagtgacgtgaaggattatgaatcctccctgaggtcttttccgtgtaaaagagctctgttggttgctcatctttcatcttttcagtgcagccagaataatcgctgagctcactgtccgtatcttatacaatgcggacttcataaatgttatcttttggattacagagctgcacactgacacacaggtatgtgaagagatctgtatctattcaacacacacacgattattatcttggttgtagtcaccttaaaaagtagaatgaaatttgtgttattttaatgagagatactgagatgctgctattctttgtggttttctattaggttcatttaaagaagcaagcctgtcctgctgtcttattttaatggtttaggacggatggaattttaattgtatagatgcagcagatcctttggaaggaaaccggatctaccccattagagtttcatagaggtttcagataacagaaatgaatgtgaatcaactagcgcctatttcattatgactggggaaaacaaacagtgtcaatatttggtacaagagctcttccgttttaaaagagcaacttgtaagagccatgtaaggcaaaataaaacctcacaaagagaattctgagggtcggtagagatgataaaatactctagcacagaaatcaaaagaccattaaaatcttaaatatgccatgatttgaaaaacgtcccagtgaggcttcccacagtaagcgaggtcatcatagaaggcacgtttgaatctgtttatctcgggttggaatgacacatgactgcagccacattcaggctcattactgctgaagtgtgaagtgtccacttggaaagaatgcattctttcacacataaagattgctgcattctgagatgtggggtcagcaatgtggttggatgttttttaggagattaacatcgaacatattttctacaaagcctgctcaacaagttaaccacttggtgccagcctcctgggggccccgacatggggcaagcactgctctggggatttccagcatcctgagactttccctcaccctcacacatagcagatcagggtcttcaagtgcaggtgacacatacattgtgatccacctcaacctgatgaaattgatttctcttagtacctattgcttctacatgtgaataggcaatctataagttacattccctgtgtcccatttttaggattactaaccagctgattgcccatgtgaggacatctttatgagtgtttgcattatcctggtgagaatttatgtagctcttctaatgtgtaaattgctaaactttttcttcccctacctgaaattttgacttacatgtgtatggcttttgtaattgcgtgaatgtattctattggctattgatggtttctctgattctaggaaacacatacttctgctgatcctgacaaccagaaaaaacaaaaacaaaaacaaaaaaaaacaagtgatttaaacaaagcaagtacaaagtcattacagagatttcttttttttttagtatggactattcttagttatctttttcttttcttgggttggataattttaaatattttatacatcctaatgaaattaatattttccacttaaaatagcttatcttgttgaactgtgattggattgctaaataatttttaaaagaagattaaagtttcatgccttgtcaagaggccaattaatgtagcacagctaggcaggtaggaaagaaaaacttcacctgtcacaagataggaatgtgttggttgatactccctgtcttcctttgaaatcataccatcgaaatgaaagttgtccctagttttaataacctcctgacaagaggattccactgtttctctgctatcccatttcaatatttaacaactttctaaaagtctgagcatctcttgcttcagattgtcaatttttctgttattgttaggaaacagagggtcattctcttacgtaatactctccttatgattgtggtcggggaagagaatggtgccccacaggaatcttagacctcctgttccatctccatcctttcgatatacaaagggcagcagttctcaaagtgtggtccatggaccagcagcatcagcatctcctgggacctcgttgttttttgtttgtttgtttttgttttgtttgtttgagacagatttttgctcttgttgcccaggctggagtgcagtgacgcactctctgcttattggaacctccaccttccagtttcaagtgattctcctgcctcagcctccagagtagcacaggccaccacacccggctgatttttgcatttttagtagagatggggtttcaccatgttggccagactggtctcgaactcctgacctagtgatccgcccaccttggcctcccaaagtgctgggatcacaggcctgagcccacgcgcccggccgggaccttgtttaacatgcacattttggggctccatcccagacctaccaattcagaaactccaggagcgggtcccagcaatttgtgtttctactggccctccaggtggttctaatgcatgctaagtttgaaaacccttgttatgttggaggttagagtcagtcagaaagaagacagagcaattcaaactacccaaagaggaatggacagccttcaccttccattacacttcaggtacactttgaagacaaccaaagaatgcagacattggcctgcaaatgcctgtgcctgcaattgattgcagttctttttgtattactaacgggaagtctttactttttttttttttttttttttttttgagacggagtcttgctctgttgcccaggctggagtgcagtggcacgatctcagctcactgcaatctccacttcgcgggttcacgccattctcctgcctcagcctcccaagtagctgggactacaggcacccgccaccacacccggctaattttttgtgtttttagtagagatggggtttcaccgtgttagccaggatggtcttgatttcctgaccttgtgatctgcccacctcggcctcccaaagtgctgggattacaggcgtgagccaccgcgcccggccttaaatgttaaaaggaaagaaaatatgcatataaagagattgcacttaaaattagtcagcttgtactttggttggtagaaaacaaacttctgcaaaatctgaagatttactgataggtggatgaggaagtatttctgaaatgtgttaaccactcatttcatttaccagaaactgctcagagcctcttgggggggcgatcattgcaaacttaacaaaaccaatcgcctgacatttctgcattgcacataacttcttaagactgccagttctgaattgtccattttaaactttgcatttattcttaggacatgggaagtctaaagaagatttggatgttccccgaaacgctttccttcttcatttccaactagcaccaaacttttgtctgattttatttaccttcaaaaagttaggctgggcacagtggctcatgcctataattccagtgctttgggaggctgaggtgtgaggattgcttgagtacaggagtttgagaccagcctgggtaacatgacaagatcatgtctcaaacaaaaaatttaaaaattagccagtgtggtggcatgcttttgtgatcctagctactcaggaggctaaagcagaaggattgcttgagcccaggaggtggaggctgcattgagctatgatagtggaactgcactccagcctgggcaacagaacaagaccctgtctctaaaaaaaaaaaaaaaaaaaaaaaaattggtgaacattcacctactctgatcagaggcatccgcttcccgtgagcacttctgtgccttgaggatcctgagcacatgtgatcataaggaaaatttagggctaatttttaaaaacataggggtttggtgagggctccatttcttccaatgggcgtatagtaccccccacccccccccaaaaaaaaaacgctttttaaacatgttgactaaaaaatgtaaaagtgataacttcctttaaaaactttgggctggagtttatttaagtggaactttctggtagctttttgcaacctgtaataaactcattggaatgagtgggaaatagatatcatgtgtttcctgagccttccttggatccgtggccaggaaaaaaagctgctgttcaaggggttaatggtgtccaaaccttatttatatttgtgtgattagggatgtgcaaaatgtgcctcttgcactcaatccaggtttgtggaagattagctgttctaaacagaaatggaagaacagcccagaagaattgtaaaaagaatgcgtagcatgagcaacaggattttttttttcctgtgtgtggctatgtagaggcggaaaaggatgaaatgcggtttaaaaattaaatgcagactaactgctttcctcctctgaagaatgccagaaaacatttaatccaggagatactcctgaccattgaccacattccacccaccaccattcagtcggaagcttcagactccgtaaaataggcgaacatggttattactgcaaatgctatttgttgattttttagggtcgacagcccaatggctgaacagtgcatgattgagtatgaattcatactgcgttcagcttgtaaaaaagacttgctatgtacaaagtagcctcatcggtttgaatgcttaggaatttttctagggaacaaaacattatcaaagacagcaaaattaagggaaactgagtaagattattaaaatagatcatattaatgccaaaatctcttgtacaaagagaccacttattcatatatttattcactgagcaaatattcattgttacctattatgcacagctagagaatgttagctcaaagttttcaaaccatttttttaaaacaaagatgtttatatatcctctacagattcctaaagttggatcttattttcttggttaattgtatgtattgatggggaaaattttttaaagtcatattcaaatagatttctttgattcgctggagaataagaattggacatttgctccaggccaattgttcatcttatcgataaatacaaaatgatgtcactcaagttgtgggataaccccccaacccaccctcaaagtttaagaaaacagctacgtagatagcattatggaattcttaaagctccgaggggtatgagaagacatcagttcaatatcttgaatttgcaaaagagctcactgaggcccagtaatcttagctcaagtgactttcccaaggctccagaggcagctggtggcagagccaatcccggcagccatggtcggtcttttcttgtgtttccctccaggtcttctgcgtgcattaaactcttacagaggtactgacttggttccagacatgtacctgtacatgggaagtccctgtacttgggtagctcatggtattcatatttgtcttagatctttcttccttggatattacaaagtggaagcttatgaagtgtgaaaattaaccaaaggatcttagaatccttcagattattttgagtcattcattatacttaataattgcattcattgtattttactaaaactatgtgtatgaagcatgaaaatacatttgttcttgaaagaagggaacactcaaagtatatggtacatttggctctttcttatcttgcttctctgctacctaggccaacactgattcttggcgatggggtctctgagaggaaacatccttagctacacgatcctgtgggtatgacaacagtggagtcaggtggggctgtgattcaaaccccgccacagccatactttgaagcctgggtctgaaactgggccctcattgaagtatcttcaatgtgtagggcctgataggtacccccatgtggcccccagggcccccaccatggcctgataggtgccccattacctcaggacagctcatgctttgggacgaatcagtcccacttggtaaatctcaaggctcatactcaagggcatcaaaggccagtgtgtaaattggggctattctcgtcttgagaaggcatccacctgtcactgtgtcacaggctgctgacacctctcagcctacattctcagtgactgtagcaatgattcccaggtgaacagagctgctcccccaggcccccttgcttctggccccagaagtccaggacacctctcctaggtgcacggcttcccaagctcctctgggggtcttgggttgggatatacttgcttgggggagaaaatgggagactatctagaaggaaggtctgatttggagggatgtagcgctggcatggtagttgctatgtccgcctttcaactggttgctatggggttgagccccagttcgggcaaatgtatgttcccggagaaaagcattttcagtcggcaattcctgacccaccctttgaaatgacttgattcagatactgtttatgaagcactttccgttctgaaatggggcctaagttcagggtagtgttcttttctgctgtttcatttgactgtaacgggagttacacaagtaacacagggtataatttgacctaattgattccaggcctcttcattgtcgctctaacatcttcctccctttattaaattcacatcagttcacatttcccttcgttaaacttccagttaaactcttgcagagatgagaatgctttctgcagataacttcagtaatggaagcacctaattttctgtttgggtgataaaaagcctctggtgatgaaaatatttactttaaaaaactgggattcttaactaagtgaaaaatatatatatgaaaattactgttctgcaaatagttagaacagggtagcgcctctgctcatagctttgtatcaacataggcaggtgttcaaatggagagagcagggtggggggcccaaagcgaggagactgagtttccaaattcaacatttagctgttttgggttagggttgagttagatcaaggcttgtacattttatatactttgacagaattgtgttattggattgagaaaaatggaaggactttagggagagggagtaatcagtgaatccatctgcgtgttctcagaactcagtgaattaattccatataataactattttaaattttcagtcttagaaaaaggttcctttggtttgcttgaagaatactatccattccagttcttaggaacattggcctagacacatttgaaattcagtagactttgggcaactgaaatttacaagattaaactattacaaactagaagaaaataaaggtgatggttttaactggtctctcaatggagaaaagctttctggctataagtaataggagactgtataatgtacatgtacacatgtagatacatttcttacacatacagtatatgtaaagaaatacccagatattagatgacataaaattttcagacacatgtcaaaatataaacaaaattaaacatatacacattaaccctctggtatatttgttgcaaatatgatagacaataaatatggcaaagacctattcttatataaaaagcccatataaatcaagaagaaaaatatcaaagttgaatgtaaaatatgtagaacacatgaaaaagaaactgagaaagaactataagtgcctgtggtgtattttcaacagctctgtgaatttcattattatgtttctgaaagtgccgtggtgacctcacccacatgattgacatggtgtcccatttgtgaggacacacaccaggatctcccccaggtctgggcttttcctgggctacctttctctgagttctgtaactggccacgtatctgtgttttcagtgatttctacaaaggtgaggaaaaaaaaaacatgctgggtcaggtgtgatggcttctgcctgtaattccagcactggaggctgaggcaggtattcaagatcagcctgagcaacatggcaaagccctgtctctacaaaaaaaaaaaaaaaaaaaaaaatatatatatatatatatatatatatatatatatatatatatataaaattagtgggcatggtagtagataagggatcttcatgacacataatttgtatatctctgattgtgttttctctctttagtttctcatttatttttatgatgatatattatttgatttttataaaacacctccaatactttgtggaatgacatgggttttaagtaaatcattacataaaaatatatttgaggccagatatgatggcgtatacctgtaatcccagcacttttggaggccaaggcaagaggttgcttaaccctaggaatctgagaccagcctgggcaacatagtgagatccctgtctctacaaaaaaaaaaaaaaaaaaaaaaactatttaaaaaactagctgagcatggtggcatgtgcctgtagtctcagctactagggaggctgaggtgggagaatcatttgagcccaggagttcaagggtccagtgagctgtgatcacaccactgcgctccagccagggtgacagagtgtgaccctgtctcaaaaaaaaaaaaaaaaaaaaaaaaaaaaccaacaaacccagtatagaaaatatatatttgaaaatttctatagatactccatagcatctccttgcaatttattaatttatctttataattcccttgattttgaatacctgagttggaaacagtcactgtataagtagccacctaaagagtgaccccctcacccctactgccccatcagtcactcccttttctgatttcctctacggagggaaagcccagctgttcttagatgttgcgaccactggtggccagcttggggacatccaggtagtccaatccttcctttcaggttgttggaagaattcagttttgcagtcataggaccgaggtgccccttttcttgctgactgtcagccagggctgctctcagatcctagaagctgcctgtatttctcaccaagtggccctttccatcttcatagccagtaacagctcattatgcctgggatccctctgcctctctcttctgttaccagctagagaaaactatgtgcttttaaagagctgctgagattcaattaggcccacatgggcaatctcccttctgattgtactcaaagtcaactgattagtaaccttaattatatctgcagaatccctattgccacgtaacttaatcaggacatgacatctcatcatgtttatactcctgggaattagggcaagaaatcttaggagtccattttagaaatttgcttaaaacagccagatgtcaaaaactcttagcttctcttcattcataaggttgtatttcttccactccccgatttctgtcttcctgttgtttgcagacttttgctgttctttagtttgagtgttttttttcttctttcacatacagtgtacaatatccttttaaatcttatcctttgttacagtctctgaattcttcactaataactgtaggaagtatctctctctacctttctcttcctctcattctcactcttcaagccattggcaggagacatgtaatgatgtgagggtcaggaggccaatacaccagttcctgttctgtccctacattaagtatgtagcttgatcttagtgtcttggtctcctcaatcagtaataactaataattatctctatttaaatgaaaacacatggacacaaggaggggaacatcacataccggggcctgtcggggtgaggcaggggagggggagagcattaggacaaatacctaatgcatgcagggcttaaaacctaggtgacaggttggtaggtgcagcaaaccaccgtggcacatgtatacctatgtaacaaaagtgcacattctgcacatgtatcccagaacttaaagtaaaataataataattttctctgtttagaggataaaatgagcctatttaaatgtctttcaaaatattcaaattgtgtgatgctaagttcctaaatcacctcttgtaagattattcttccttttctgggatcccttctctcatgatatgcccaagaattcctgggacttaaagggtcagccttggtttctcttaccaagctattagagtcattactcaaaatacctcctagaagctgaggactccagacctctaccgagtgctgtggcacctaaacactgatgaacttggagatatttttggatgtgccgcaactgcctctatgtgtgcagaatagcagggtgactaagagcaagaacttctgaataaaaaatatctgggcttgaatcctggctctgccactgataagctttaagaattggagcaagtttcacatcagtaaattaggataataattgggattgagagaaataaatcagatgtttataaaaagcttatcactgtgcttggcacataataaatgtttaataaatagtacctactgttacttttgctaagttacttttgctaagaattaacatggcagtggcaaaaccttagtcttggttgaaattacagtattatgaaaacattttggaggttaaaatgatcatagaaggatcacacagttgaattacaaattcaaaaagttttaaatactaaaatttaaaaatacaaaataccaaattttaaaaaatagagaacacacactgtaattagacccctaagaagggaagaaaatggcttaattcattcccgttataattaacagtgggcgtttaacagtaaagatgtgcttcgtgttaacattttcctttgtctccagttgctggacttcctaatacaacccatttatccaaaaatagagcaagaggaaacagaacatagtagcattgtagaaataaatagtcgttctggctggaaaccaaatggttggcaggggcattttactaatcactggtgtattgatatggcctaagctgtgcttgttggcaaaattgttacagtctgacttggtgactctttaggatggggttgtaattttattttagaatatttcacacagtaaaggactaaggaagtccggtctcctaggttgcaaagccatcagttagtaggttagaaaattgctggagaggcttgtgtgtgtacttacaccattgttcagcattaattgagtatgtattctgacaaatggattaagaagggagcaggaaatagtggaaacagagaaatacatagaagtagtggaagagaatggagtttacatttgtgtaacttgtgggctcttcgtttaatcccctccgtaatccacagaacagatatcctccctgttttaaaggtaagcagcttgggggtcaaaaaaactcttcaaggtcatgctcattgataagtggtagagctggaatttaaacccaggtctgtgtgaccacaaatgccatgtattttccactgatttgactttagatttgaagcagaagtaaaattgggaaagtatcagtacattcagccatggcatcaccagtaggggagatgaagttaaagcaaaatttgagagaatcccttctggtggaagggctctcagttaaagccccatccataattgctttctgttcatgttgacctttattttagactaatggtttgtttattaattaaactgtgaaaactagttttacttgattaaagtgcacagcagagtatactttgttttggtagtgattgttttttcttctattttttaaccctttaatgtcagttttcccttggagggataatatattagattaaaaaaaaacactatgacattaggggaaaatagtatagaatgctacgtaggcagaagttattactctactgtttttcatatggcttattagctggtcgttcttttttattgtggcaatatttcagttactaagatcagatccttcagttaaccagggttgtctgttgttctgaactctacttggaaaagaaagagatcaataaactcagaaacaaaggcaaacaaagatacacgtcctcaccttctcatcaccagtccactcgagagaaaccagctttcaaaacattcagtctattttttcaataccttgctttttaactttacaatttgtaacatgcttttaagtgtgttaatgagctcctttgattatcatgtttttttaatgtgagaaaaaataggcatatgctgttcttcccaggtcttctggtgttcaaagttctatcaactaaacaacactggacttcttatcttttcagtggatgcttatgtggaggtggtgcaggatgctcaattattaaaaaatgatgtgattatatattaaggtcaaaaactgcctgatgcacatatacaccatggaatactatgcaaccataaaaaaggatgagttcatgtcctttgtagggacatggatgaggctagaaaccatcattctgagaaactatcacaaggacagaaaaccaaacaccgcatgttctcactcataggtgggaattgaacaatgagaacacttggacacagggcggggaacatcacacacgggggcctgtcgtggcgtggggggtggggggagggatagcattaggagatatacctaatgtaaatgatgagttaatgggtgcagcacaccaacatggcacatgtatacatatgtaacaaacctgcacattgtgcacatgtaccctagaacttaaagtataatttaaaaaaaaaactgcctgatgttttaaagctgaattgaaagtgtatttttaaatttagatttggccttttgctaaccaagatattagattatctagaacatctccagtaatgatagaaatgtagtgttgcgaagggctttgggaatcatcttgtacaaatgcctcacattgcaaagtgagaaaactgaggtttgtggatggcaagccatcagtcagcttgtctgggatgtcatgttgtgggcccaacaggtgggtaaatttagatcaggtcacacattttttaaaaacacatttataattggactggatacttgaaaacttttaaaaagcataaaatagaccaaatccatggcttagactgttttgttctgctgatttttctcagaatttacaaaatacagaggattgcagcagatcaaaaataagcaaatacatacgaattagagccggagaagctttccagatttcctgatcttactgccctacaagtatgaaaaagcgtttctaaacatgtctttttttaatgtcaagatgagcgtggcaacctcgtgtttgttttatacttttggacattttatattccactctgctaaaggggacttggggtgaaaaaacagaaaagattttggaatctttaatactccctgtagaatcatgttatttaacttacggccacaacttgtggaatatttcagcacttgtaattctgatttgaaaagtgtttttgttttttccttccaacttgctagcagctgtaggcagtaactgacatctttatataagttgcacattgtcgacatagataactggacaagttctttagagtggcctggcacttttagaggtttcttttcctgctagacggtgtttaatcatgaaacagcccctagagggaagtgcttctagctgtctccatcacaaacaaagccagcacattggctcaaaccaaggggcctcctccagagcctgaggtcctggagccttgccccgtagcccttgctttcaaatgaacaggggatgtgtagccacctacaatctgacgtcaactgtcaggtcacacgcctcatgcctaggtcagaggtacatcacttttagacacgttgatactatcaagagaaaggaaaagaccatcaggatctggggaagggagatctttttgagccaatgattgcattttataaacacgtgaaattggcaagacattctttccagatttcacagagggatatcccatgtccaaccagggtaagacatgaggacatgagtaattagaaggagaaacattgttcataatgacaaggtggaatgtgaaaattggctggagcagaaagggggaaaaagacaagctgcaatgtgagatttaggcacacagacaggcgtgtggtgtctttgtgtgtgagtacatatgtgagtgtgtgactgttcacgcgtgcacatgtgacctctagcctaccagatcatgtgaggctttattgaagagatgttctgtgacagtagggtgaccaatttgtcctagtcttaccagtctgtcccagttttagcagctggagaggatgatcggttgaaattcaaacctgagtatactgggtataattgcatatatacttcattgtctccacaatgagtttgtgtaacttgtaggttacacaaattgctggctgaagttcatccaggtcaatttatgtgctaatgttttagggattgcatggctgataacagtatttttttttactatcagatccagaaaacaattgaatttgaatttggcaaacggagataaacagggagaaggagaagtaaaaaagggatgtaaggggagagaaaggaagaaagggaaggggaaaaggcctctaagcctcactgggaaggtcctggtaatgtcactgaaccaacatgagcccaaccacaggaaccaagaatctgctctggaaatcctgcttagttgtatttaagtttttttccctccagttaccattttcttccaaaactcggcatgtaagtgaagatggtctttaaatcccagatgttgtttttccatcttccagctggagttgaggtaatattgtgatattcaaacagaaacagaagctgcattttttgggttattttttctagcagcattaccataaattggactgcagtgagtaatcttttaatcagatggaaagaggcattccaaatatgtttctagtcatctgagagtatttaacaacttctttaagaaataaagttaagcgttggtgaaagtggggatattggtggtctgtttaagtgaaatacttttaaactttttgttttaaataatgtaggtgtgttttattacaaatagaatgtacttagtatgaagaatttataaaatagagataaccaaaaataagacaatagaaattattcatactccatcatccagctaactacaattttgtttcagccttttaaaaagtatgtgtatataccttttaaaatgtgtgtgcatatacaaatgacatcaccccatacatgtgattttgtaagtagatttttaaaggtttgctctcttttgttttgagattgctttgggtattgcagcattcctaatacaggactaagactttcacctcaagatgatagatccccacccaggtgcattggtggtggtttgggaagctgtgaccaaaactccacaaacctcgcaaatcgaaagctctgagaaaagtgtttttctggctctcgggacttgctgatgactgcgcattggctctttttgcttcacgtgaccccttctgtccccaccaaagggagttctgcctggggacctttctagcgctccagttgccttatggcctgggagccctcagcatctttctgtctgcctgcctggaggaaattaggtggggacagtgaactagagcctggcccagctgctcattccccgaggcaggtgagcatgccctgggtggaagcctgcagcacatttttctaggagctgagttgctcgttcttcatctttcccttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcagaaggagcacgcgatctagatcgcttgtgtgcccggttcacaatagggtttgtgctcctatgagaagctagtgccaaggctaatctgacaggaggtggagctcaggcggaaatgctcatcgccagccatgcaccttctgctgtgcggcccaatccctaacagggcacaggccagtgcctcgggtctgcagccctggggttggggacccctcttctatgggacatcattctgcctgttgtgggctgtttctccagtggtccctttcttccagggcaacttcagccttcttgagctgaatatgacaccagccttttaaaagctttccaccttgttctatccaggtctggcagtttgacccaagaactgtggggattggggccctaaaggactctcctgtccccacccaggggtggcttcacctaggctgagtggcagaactgatgtttgcttctgggttcttgcattgtgcccatgactgctgagccttgggccaactcttttgtcatctctgctctcagaattactcaactgagctggtcatggttgctcacacctgtaatccccgcactttgggaggctgaggcaggaggatcacttgaggccgggagggcagcatcgtgaaaccccatctctacaaaaaaacttaaaaaataataaaagaaaaattaaggaatgactcctgtagttatcagtaggcatcatagtgtaatgatgactgtgtgggtttgggatcatgtcccagttctgccctcatcaatcacatgaccttgagtaagttactttcttctttgagagtcagttttctcccaaactgcagtgggtatagtaatggtgactaccatgtgtggtgattataaagatgcagtaagatcgtgcacgtatgccactttgcaaaccatttggcttactgtcaggagtcaatatattcattcttaagcaagacattctccactgtctaagactattcaacacaaggcacactgaaaaggtctatacagagggactttggctgttcggaatgtgaaggggaaagttgcagggaatgagatttaacctaaaatagggcttacggttatgaattttaactatccacattccctctacccagtgaaaccatcaactgactgcacgttgccatggactgcaggagggacttttttttttttgagacagagttttggtcttgttgcccaggctagagtgcaatgacacgatctcggctgactgcaacctccgcctcccaggttcaagcaattctcctgcctcagcctcccgagtagctggggttacagtcatgcgccagcatgcccagctaattttgtatttttagtagagatggagtttcaccatgtcggtcaggctggtctcgaactcctgacctcatgtgatctgcccgccttggcctcccaaagtgttgggattacaggcgtgagccaccgcacctgggaaggacttttaagcagccctagcatttgaaatgggacgtggtctgcagagacggggtgcatttcttttctctgtcatctttgtgcagttgcctttgttcactggatcaggtccctgaaaatcttctttcccctcttccctcctcatgcctgcagcccagttccggaaccaccttgtctggcactgattgcagccagcagtggtgccacctcactgctctatttctgtgggttttatttctatcctgggagcgtgtgtacaaataccttcttcccctccctcaagcccaccctggctctgaggtctccatcctcttcttatggtgctatcgaaacccagatgctctcctttttctcactaccttttagattctccatcctaattgttgggaacagcagtacaaaatgagggaaaatgatacaagtgaccaaaagggtgatgagactttcaaaaacctgagttccagaaggcaccagcgtcagcaattcagagtgttttggatcttaagccatagcaactagtggaaaccttgtggaaacctcagcaggaccccccatgctacagtaggattggtgctggttgtgtgtgtgtgtgtgtgtgtgtgtgtgtgtgtgtgtgtgtgtacacactggtaaatagggctcttttatttctagcactggtctattccgaagtttccgaatatagaattacatattacagcagggctgcttagcattcttgtaacattctgaaccccaagattttctgtgttatattctcccagatccctcactttctttttccatggaaaatgttctgagttgggggattgcagttaccaccacgacacgtcccaaacatttcctgagcatctcctgcagatgatgatgaggctgaccgaattgtggactctgctttgttccaaggcagtggacaaacaaattacaccttccacttacagaatattgtactgatacttcttgaaatgcttgcacgtatattacttcattttagcattggacagctctttgagacagatgagtcgttattacctccctttagccaatgaagacaataaatttgagaaggttactcaaagaattattgactatcagctatgtgacatatgggatattaaaaggcaccacacgaacttcttgcactcatgaaacgtgcattctagtggaagaggtaacaataaattaataaattcaatgtaatgccagatagtgaccaatgctatggagacatgtattttaaaaagcaggcattttaagaagatggaatatgaccagacacgctgtgttaggtgggcaggtctacctaacacagaaggtctctctgaggagatgatatgtgagcagagatgtgacaaggggagagagaaagctgtgtggctgtctggggtaagagcatctgcactgaggaaatagcatgtgcaaaggtcctgtggcaggagactggctggggccttcagcgtttccctgctgagaagctgcatcagtagaatgaagctaggtcagagagcaagccagggccctacgtgggttaggctttgtgcaccaccctaatgattgtgaaaaataccctgaaaaggtttttgctctgaggaggaggacttttgagggttacctactgggaatgatatcatctggtttatattttaaaaggatccttctggccactgtgtagagaataggctggaggggcaaagtagaacgaaaaaggcatgttaggtggctgttgcagtggtttagataacagatggtgatggtttagtccacagtgttagtggtggaggtggtgagcagattgggtactgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgactggcccagatctcccggcgatctttccagggccactttgagaaaaggcagtgagtagcaggggtctccgtccggcttggcacgttctccttgaggccattgtgagtcctctaagaagggactctgtctctgtcaacccacctttgaccacagacctttactgatcctttctgattgataaacaatagagggaggaggttgtgtgatcttttagtttatctcaaggatatcaaaggggaggggaagccctaactgaatatctagctaaataggagataccattcagtctatttgtagtgtattttaaagcctgtttcatgtgcaaatgtgaactacacagaggtaatctgataatcccaaaagggtaatctgataattccaaaagggtaatctgataatcccaaaagcttattaacataccttgtagataatagatatccagttagtatttgttgcatttggtgatttgtggttgaatattgagtgttggtattttctagaaccttacattcaattctcttccctatatttgtggttagagtcacacttcactttcagatggaatgagtgtcagtgtttccagtattttccagatgaggaaactgagatgggaaaaagggaaaaggtaggcgtttaacaaaggcatttcataccactggcttattgtcgatgaaacaggcagaagaatcttcctgctgtatcccagacattcactatcgggattcacaccctgttgtatcattgaaaaacgcgcagacttcagctggatgaggtgctcatgcctgcaatcccagcactttgagaggccgaggccagagggttgcttgaggccaggagttcgagaccagtctcggcaacattgtgagaccccatttctacaaaaaatattttgaaaactagctgggtatggtggcacacacctctagttccaggagttcaagcttacgtgagctgtaatcacatcactgtgctccagtctgctcaacagagcaagaccctatctctaaaagaaaagaaaaagagaaaggaaagaaacaatgaatgaaaatgtgtagactttaattcacactgaccttctaagtttttcttaggcctttattgacattgttatgtcacaacaaaatctggccatctctgagaacttataaaactttagtggttttaggccaggcgtggtggatcacacctgtcatcccagcactttgggaggctgaggcgggcggatcacctgaggtcaggaattcgagaccagcctgaccaatatggtgaaaccccatctctactaaaaatacaaaattagccaggcatggtggcgcatgcctgtaatcactgctactcgggaggctgaggcaggagagccacttgaacccgggaggcagagattgcagtgagtcgagattgtgtcattgcgctccagcctgggcaacaagagtgaaagtccatctcgaaaaaaaaaaaacaaaaaccaaaaaaaaaactttagtgtttttcagagacatagtgtttccccaagttgtcatttgaagtacacaccccttcttccaaccacatgggcgtcagcaactccactgtgatcaaaaggcagcctgtctgacagaatattccccagtcttcttccctatcggcattttgaggcagggacacactacagcaaaatcagtccagacccttatataaaataactcttccgtccaccacagtggccaatatttccttttcctaccttggccctgcctgatcacacacaccagctctgcagccagaggacccctcatgggtgaagtgggctccgggtaccctgtgagttgagaccacggtcccccaggagcatgcagtggtgcctgagggtggttggcagtggtgatggctgtgttatgtgtccttctctctctgtctgcgagtctggttgggtggactttgtccttggttcaaaaagctctcagggatcagctccctgttctcttactcacaggtcgcttctagtcaagtttcttctgctgtaggattcacgttcactttctcctgttctgactgtcctctgtggcatacacctttgatgtattgatctcccaggtggcttcctaatcctcagggtgctgcagaggtcagaggggcagtgtgaccacacacctggaggggcctggggaagtgccttttgtcagcccaggtttgaatgacctgcaggctaattatgttacttacgacttatgttgcactgggctccttaatgccaacctctgggcgtttgaaggttataaaaagagaaaaatcaaaactcagaccatcagttgcgctgattactaattgctttggtgggagattttgtgggaaagacactaatagtcaaaggtggtttgaacaatcacctgtgacttaacctcattccgacttttcttttgactacttattgccagcaccagacaggaagagcaaaaggcagagcaaagcgtctgctgcaggtgaatcaagatgtagcatgatcttgtcccaaatatgcatagccacacagtcacctctcatgggagcacagtcctgtgtgtttgcctatccacgctgcatggctgattcctttcttgatatatgcttcctgtcttttgtagggggaggtgctctttggcatctccagacagacccctctccactcctctcctatctcttgtcttcttttgcactatgagccatgatgttttagaatttccatgcctcgttgaggctggaatttggtacagatccaccacaacccagcatcaacctggaaaccaatgcagctctccttggaggcttgctgcccgtatctacagctttcttcactttttccccaacctgcggaaaggcctttttgttgatctcatcaatctgtgatttgagatcttgaaagaaccaagatcttgtgacttggcagggggagccacccgccatgtagccccaccctgtgccctccctgaccccgtcgccccctgtgcggacctgctgcgcttcaggggaaaacagcacgttaagtgagcagtttagcttggactgaatccggaggcaaatcaagtaactttatactgagatactctctccattgtgttctcaggaagatgaagtgaatcaccagagcaaagaatgtgctctctggtgctacaccaataataaagtacaatgttttgaattagaggagggagagagagtaactgagaaacctttggctggtcactttattgttccttgtggctcccccttcccttccctcagatatatacttggataagaatttccttctccagcccagtatttcctaaactcaatcctgcagtaaaatgacaaggccgtgttagacatggaaattattgcagagcaacaaatccaagattgttatttcaccaaaggccccaggaagtggagatgaagaactgtgagagcataagcctccagctcaacccaaatgtgtttttcttgccccacttgttaattagtaaatcaaaaccaaatgaaaaatgcaaataagtgcatgccacaaatctgtcatacttgaatgtttcccactttatttctgtctttctgactttatcctgtccatcattctcgtcatctgtgagtaaaagcacccaaaagcaccttggtagattggcgtcaatttgggtcttatacataaaactgcctgacaaatgacagcgttcaggtagggattatttagttaacacagaagttatgtgatttatattttttaagaacagaaagatgggagtgataaggcactatttttcccactcttttttaagtttcttacaggtgttttctgtttttgttttgttttgtttctaaatcatacattcaaatgcttgagcctggtgaattttttgttagcttgcttgtttttggtcatttaggaagcattgcctattcagatagacatttacaatcaaatagggctgaacacaccagcacagctgttgctcagaagggaccaggagggctggttgccccagaaaaggaaagatattctccaagaacagtcctgggagaagcattttgttgtgtttttgcaaggacgtggggatccaagttttgtctattaaaggaaaggaatggccctgttctgtttgtgtgttcagagcgcacggctgtgctcagagatgttcgtgcaccctgcggtggtatttttccattctcttgtttagaacccctgggcatttagacacatgtcctgcacacagctcagcatctgtgatcacatggtggtttagaactgaggtcttggttctaaaccaaggaaagattcaagtgtctgtcccttgctgcttccaggccaggccagccagctcttgagaagtgtggctccttcaggtccggatgggtggctccctcattcaacagacatatactggacacctgctatgtgcaggtactgtttcgagcacttggactgcatgacgcaacaaaacaaaactccttgccttcccttgtggggcatacattggaggggagtttagccctcagcaggagcatgcctgttttctttctcactggctaccgtttcggtgttgttgaggtgaagagggacagccatgtgcagatgcccccgattagggacatgttctgaccacggctgcccagggctcaggccagcctgggcccatcacgcggaccagaggttggacggaaccatgagaaaagactctccccgtgtcccagggcttggcacagtggtgctgtgccgcgaataataggtcatctgatgcggtataatttaataggaatatgaatccccagtaacccggggaaccaaagcaaggaattggcctctcagttacttttaactttcaaaacttgaacatttccttaaaccaaatagccccatcgtcatggtcagaagtccactgtggagaaaggcaggatttagtgtttatttaagctgccaccccatgagagaaactgttgcccagtggagtttgactctcaatttttcaaggaatgattttccattttgtggattttttatgtatgtcttctctctctctctgtctttccttccttccttccctacctccctccagaaatgttgatgggagcaggaaaatttattggccaggtaagggtgtatatgaagaaaaaccttgatggtagggatcctgataagtaaggctcttaaaaagactgcagttagccaggcacagtggctcacacctgtaaccccagcactttgggaggctgagtcaggagggttgcttgaggctgggagttcaagaccagcctaggcaatgtagtgggaccccatctttacaaaaaaataaaaaacattagctatgcatggcagtgtttgcctgtagtcctagctactcaggaggccaaggcaggaggattgcttgggcccaggaggtcgaggctgcagtgatctgtgattgcaccactgcactccagcctcggcaacagagggagacactgtctcaaataaaaatgcaccatctggtgccatgtagcactgttgggcgtctgcagagcattttggtcacagggtcttctttgcctcccgcctcttcatatgtagatgttactacgccacaagcagagggaggttggtcaccaaatccggaaacatgggcaaacccacaataaatgggttattgatactacattccagtatacagtaagatactcttgtctttgtttccagattttatggccactctgtagaagcttcaagggactgaaaataagtcatttgatgcagctaaaaagagacattgctgccttttgatctcacatcttcagcctgacggtcctgtgttctcttcatatcagactcctgactttcagaaaagagccaatcaccatttgactagggctcatcacttttcaactttttcaggatttcttttggcaagagcaccccccctctctctcatgtgagctcactctctcctctctctcatatccgtgctcctcttcctacagtgctgacctctgaggtatccttttttcttttgactctcatcagtctacaacctctgtctatttctccttctcttagtctctctgtgactcccctggattaaaccttgtttctgctcagactcagcaaatattcattgtgagcctactatgtgccaggtgctgtgctgggcttatcactcagtattcactgatttccccagcctctttctgctcagaggtcctacatagccttggggtgagggtgtttagctaatccccttgtgtttggggtgggccgtaaatgagctctgatggaccatcctcagcccctccagaatgacctctgaggaatcaatggctgagaaggagagatggagagtgtattagtccattttcaaattgctgtgaagaaatacccaaggctggataatttacaaagaaaaagaggtttaatggactcacagttccacatgactggggaggtctcacaatcatgatggaagacagaggtacaccttatatggcggcaatcaagaaagagcatgtgcaggggaaatgccctttatgaaatcatcagatctcatgagacttattcactatcacaagaacagcacgggaaaacccacccccacgattcaactgtctcccaccaggtacctcccacaacacatggggattatgggagctacagttcaagatgagatttgggtggggacacagccaaaccttatcaaagaggaagagcaaaagagaatggaagaggtatatgccccaaagaactgaaaacacgtactcacatacaagtacatgcatgttcatagaagcactattcacaatagccaaaaggtggaaagagtccaaatgtccatcgatggatgaatggataaacaaaatgtggcatgtatccatacaatggaatgtcattcagccataaataaggatggagtgcagacacacgctacaacatggatgcaccttgaaaacatgatgctaaatgaagccagtcacaaaggatcacatgttgtgtgattgttttcatgtgaaatatccaaaataggcagatccagaagaggcagaacacagaatgatggttgttaccaaggccgcgggggaggaggaaatggggagcttttgcttcatgggctttgtgtagaggcgatgaaaatgttttggaatcatttagaggtagtggatgcacaacattatgcatgtactaaaacgccactgaattgtccacttcaaaatggtgaattttatgttatgtaaattttacctcaattgaaaagaatgaaagataaaggaaggaatgtgttaggggtctattgctttgaattaaggatgcaatttagaaatctggcctgactttcctatgcatggtgaccttgtgatgtggcttgagtataattgaagtaatttgagtagattaatttccttccttggcttcttaaaatttaacgtgcttgaagtttgcatcctgaatttagaatgcaaagcagtatgtggatgagtattctgggccaatagtgctgctgcttaaaacaacaaacccagacagatgtgttcagcaggttctccagcttagctgtttgcatcttggagaactgttcctgggtcctggggaaagaccactgggggtggggtcagaagcctgagttctgttctgcctccttatgcccatggaggatactgcagagctcaggaaagagcacgaagcaggacccagccctggctcacacgtgcattcaacacacattcttgggcaccatgtactaagccttctatgggatatatgaaggtgaacatgacatggaccctgcctttgagaggcttgcagcccagcaggttaaggtagacacgcaaacagctgatcgttttggtataaggtaggggtttgatgctgaagatcttcatgggaccttatagaggtctagagttgagggtactaaaactacctgggggtgaggtttggtggaagaaggcaactaaggaaagcttcctggattcaatcttaaaggaagatttaaaatattgctgaattactgcaataaaccgaatgtttgtttccacgcccctgcaaattcatatcttgaaacctaacccccaaggtgatggtattaggaggtggggcctttgggaggtgattaagccctcatgaatgagattagtgcccttattaaagagaccccagagagctgcctcactgcttccaccatgtgagggcacagcgagaagacagccatctatgaaccagggaagaggccctcatcagcaccttggtcttagacttccagcccctagaactgtgagaaatacatttgtgttgtttgtgagccacctagtctatattttgttacagcagcccaaatggactaagacaattacccattgcgtattgcaagtaggtggttagaggagcagcaaaacaggaactgttaaaactgagtgaaaacatgcttacgaagagtttgtttgttattttgcaccaaagcattaataattagatataagaacactgatgtacctacccttgttttatggctttaattatctaggatgacgtaggggcaccaagccttttcaaaatttgggttctgtaacagtctcaatccaggaagtaagagaaggaaagctcacttccagggcaagtatattgtatgaggaaggcgaagtcacgagatcctgggcagtgtggtgggacaaatagagcaatttaagaccttcaaaggtagagtttaaggtggaaaagggtgagggacgagggtgggaggtggctgtggggtacaggctgaagggctcttggcaggcctgttacaagtcagacttgtggccctggtactagctgcagtgtggagagagtggatggacatggggcaaaatgcgaggcagtgggactgaggctctgcatgagggcagtggtagtgaagggagtgggacccactgggtttgagacacttctagaatgatgctgtccagtagaactctctgagatgatggaagcatccaacggtgtgctctccaatacaggagccaccagacacttgtgactcttgaacactttcaacgtgactgatgtgacaggaaccaaattttacattttaatttatttaaatttaaatagctccccgtgcctgtagcttctatattggacagtatagttctagaaagtaaaagcaacaagagttgatgattaattgggcaatttagggtggcagggtagacagagctagagacagaggggcaggttaattgtagaggggggaaagatgagtaccactgtgtgcatgttggctccaagtgcgagagacatctgggggaagaagtatgcccagcagtaagaaacgcaagcctctttggagaacgctgggctggagatagaaatttgagagctttcactgttaactatgataggtgagatcataaaactgagtagcacagggaagccacttcactgcttttggcctcagattcctgttgatttgatggtggtcataatatttgctctgcctaccttctgggactgttctgaaaaattcagatgggattacgtgcatgaaaatgctttgtaaactcttcagacattaggcagagtttataacgtctttaggagtgagaggaatgtgtcccacatgttattttccaaacatgaaagataaagacttcaaattctggaagtattgcagagtagatcatctgcagggcctcctgctaaaaaacgacaagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgctttttttttttttttttttaggaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaacaaaaagggagcaatttgaatttttttttttttaaatcattgaggtggaaaaactagggtgtggtgacatgcacctggtgacatgtagtcctagctacttgggaggctgaggtaggatcacttgagcccaggagttcgagaccagcctgggcaaaatagcgaggtgccaacccaaaaaaaataagaacaaataaacaaaactcactaatagattatttaaactgcacattaaacagtgaaggagagaactggtaaatgtgtaaatagaagatattacctaaatctagtccagagatcgggagataaatggtgtaaaatcagtagctaagagatgtggacattagaaagtctaatatatacctaattgtcatttttgaaggaaactctaaaacaaatggcagagaggccataattgatgagtgactggctgagaattttccaggactgatgggagctaggaacccacagacagatgaactacgacggcatctgagccgggcagaatgaataaaaagaaacacacaagtaggcacaaaacactgtagcaaatgcagtgtaccagaagacaatggcattgtcaatgggaccacagaacccagatcacccgggaaggaatgctttgtttgtttgtttgtttttgagacggagtcttgctctgtcacccaggctggagtgcagtggcaccatctcggctcactgccagctccgcctcccgggttcacgccattctcctgcctcagcctcccgagtagctgggactacagacacccgccaccaggcccggctaattttttgtatttttagtagagatggggttagccaggatggtctcgatctcctgaccttgtgatccgcccaaagtgctgagattagaggcgtgagccaccgtgcccggccaggaatgctgagtctgaaggaatgaatacaggctgagagttgttcttagtcaagtggaggatattgtgcctgttgttcctctgcagtggaaatcaggtgtgggaggatcttttgttctctctttaagctggcctatctgtgttttgactggagatgtagcagtttttctcaagtgtgaaaaaaggcatgttgtgtagattgatttttactaaatgtggtctgattgcttctttaaggcagcccttgtaagggggcaaaaatgcggttatttgacattaatggaactctatcaaggctgtgatcattcatttgaaatctttcttcccaacgcatgtttattgactgaagtgcctgagtgtgctctcatagaagccaaggtccactactaatttccataatgagacatgtatagtggtagctactgagcatctccccaatttttttttttctttttttgagatggagtcttgctctgtcacccaggctggagtgcagtggcgtgatctcggctccctgcaacctctgcctcccgggttcaagctattctcctgcctcagcctcgcgagtagccgggactacaggcatgtgccaccaagcccttctgactaacttttgtatttttaatagaggcaaggtttccccgtgttggccaggccggtctcaaactcctgacctcaggtgatctgcccacggcctcccaaagtgctggaattacccgtgtgagccactgcgcccggcctatctccccagtttaaagtgaaattaatacctatatttgggtatgaaaatggttttaacatgattttttttttaaaaaaaaatgactattaaccctttgtgctaataatatgtaggtgcctagtgtcctaaagctctttacgatacatgtactggatatcttcttaaaaagtcatttggaataaaagggtagccccagagagttttattgtggcaacggaggatttctggatctggatttgggtggtggtaacatggatctatacatgtgataaggggtcatagaataatacacatacgtactcaaacagtgcttgtgaaaactggtgaaatcagagtgggtgtggtctagtaaatgtattgagccaatgtcagtttcctggttttgatcttgtacttcagttatgtaaaatgttactatggggggaagctgggtgaagggtgcatggggcttctctactgttttttcaactacttgtgggactttaattatttacaacacaaaataaagtttaaaaatgtcatttggagcatggcaaccagaaaaaatagattattcttgatatttgtgattcttatagaatatgaatacaaatacttagaaatatttgatgaaccctggagggtaaagtcttttgtttcaccttggtcaaaagtgaattggaaagtttagctcagtctttgtattacaattcaaggttatatgcttgcaacatgaaagtcaaaaggccgctgtcgttacaacccttggaagtccagccagaaatgtccttgttgcctaaaattaaataagcttgtgccatagaatgaaaaattgcttacattagtcaatggaatgaccatgtttcaaaaaaaatttcaagtttggtgtgtaactgtaaatggaaacgtgaaatatttggaaaatgtaggatttattgggaattattgtaattgccttaactaatctagactaaattaaccagagagtaagtccagttagtgagagaataatgaatatgtgattacttttaaagtaaatatgttaaatcgattgctctgttctttttcctctctgttgttcccctttttattttatcttttgtgtttgtagtttgagataggcagtgtctttgtttttctctggacaattttaattgaaataattcagacttagataccattcagaaaagatatatattaaaatatctttattagcatcaaacaaagcagtagtgagaaaaaaagaaaaatctttagtaagatcaaggaaaagtgaacgtacaaattcggatgaaaaaggagaaacaaccatagatagagcagagatgaaataatgagaggattctatgaaaaatgttatggtaatagttcgctgcaacctggatggggttggagaccattattctaagtgaagtgactcaggaatggaaaaccaaatattgtatgttctcacttataagtgggagctaagctatgaggatgcaaagtcaaagaatgacacaatggactttgaggactcgggggaagactgaggggggcttaggcataaaagaccacatattgggttcagtgtacactgcttgggcgatgggtgcaccaaaatctccgaacccaccactaaaaaacttacccatataaccaaacacgacttgttcccccaaaagtattgaaataaaataaaataaaatttaaaacaaattatggcaataaacttgaaaaattaaaaatggacagacctctagaaaacagacttaaaaagaaataggttcaatatttctatgtttaaaggaaaatgagtaatttaaaatgtcccccaaaagaaaacaccagaatcaaatgactctacagataagtctgccagattttcaggaagtatattacttcttgaaaagaaggagctgaaaggctccccagcttattccaagagaaagtgcagtagttcccccttatccacggtttccgtatccacagtttcggtttccacagtttgctcttgaggtctgaaaacagttgagtatagtatagtaagatattttgaaaaagagagagagaccatcttcatataacttttattatagtatattgttgtatttgttttattatcattaatcttactatgcctaatttataaatttaaatttattttcctaggtatgcacgtataggaagaaacatagtgcatatagggttggcactattcacggtttcaggcatccattggggcccttggaaggtatccccctcggataagaggggaaaattgtataacttgaaaccacacaatgccataggaaatgagaacatcgccagtctcacttacgaactcacacataaaaattccaaatagtaaatatatgaaagcaaccctctaaactttctcattaggtccaatgctttgcaatgtgtctcttcttttcctattatttaatcttaatagtaccgaactggactccaacatcagactgaaagtcagagtccttgccgctctcctgattttaaaggcagtgatgtgaatgtatcaccattaagaatgtccttagctggctgggcgcggtggctcacgcctgtaatcccagcactttgggaggccgaggcgggtggatcacgaggtcaggagatcgagaccatcctggctaatacggtgaaacctcgtctctactaaaaatacaaaaaattagcctggcgtggtggcaggcgcctggagtcccagctactcgggaggctgaggcaggagaatggcgtcaacccgggaggtggagtttgcagtgagccgagatcgcgccactgcactccagcctgggtgacagagcgagactctgtctcaaaaaaaaaaaaaaaaaaaaagactgtccttagctgtagggatctttttaatatacactcattatcaggttaatggagttctttctatgcctggtttgctagtttaaaagagacttaagaggtagaataatcaagtgtcatgagtgaacactggctcctgatttcaacacacaaaatttagacagttttttagatatttgaggaaatctgatcactttaacaattttattattattttacagagacagggtctcactctgttgcccaggctggagcgcagtggtgtaatcatagctcattgcagcctcacactcctgggctcaagcagtcctcctgccttggcctcccaaggggccgggactacaggcaatgccactgcacctggctgctttaacagtttttaagtgtacggttcagtggcattaaggacattcacattgattgtgccactatcaccacttcctctccagaactttttcttcttcccaagctgactatttgggtacttactaaacctgaacttcccattcccctctcccatagcccctggtataccattctcctttctatctctatggatttgactaggcttgctacctcatataagtggaattatacagtatttgtccttttgtgggtggcacatttcacttcacacaatgtcctcggggttcatgtggtaccatgtgtcagaatttccttccgttttaaggttgaagagtattccatcataggtctgtaccacattgtgtttacccattcatccgtcagtggacatgtgggttgcttccagcttttggctattgtgaataatgctgccatgaacatgagtgtacaaatatccgttcaaggccctgcttttaatgcttttgcatatatatccagaaagataattgctggatcaatgctaattttatgtttgtttgaggaattgccacactatttgctacagtgctgcaccattttgcattcccatcagcaaagcacaagggttctagtttctctaaatctttatcaacacttgtcagaaaatgcccatacttttaatacatctctatgaagtagggctgaagaaggagaggagttactggtcaccattgcctgcacagcggccatgcccacctatgatacatgagccattcacccgctgacaggcagacgaccctccacacaggctgccttgctcttaaccataaccaggcctacgttttccatgtgagcctgcctgtacaacttcatcatgtctctaaaaaggaaaggaaaggaggagaaccgaacagtgtatgatttagtgatacacacatgcagtagaattgttaggttttaaagggcaggggagtgataaacattattcctgatgtgaggtacctttggagagaagcagttgaagaggatcaggaaagaatacaacagtctcagtcactttctggttttcaggttgggtgatggtttccttggtgctttactattatgcttcattacctccgtaaattgcatacatccttttgtatgtataattacataatttacattttaaatcttaaaccagtgacttttattccttaaggcttttgttcctatgtgttggccaaaggtctaggacaggtgagaaatttccactgggatggtctgaggcagaaaggagagaaggaagtgagttttataaagcttcgtttgttcagtatgtcttccctattttatttagtattaaaaagacttttagaaatgcagtggtagagttagagcatgcagtttgttgttttgtttttattgtccttaacaatggcaagcagaagaagcagatagccttgtgtaaggtcattatcatttcaaaaactgtcttgactggtccttgaaatttaaaaattctaggaattattgcctcagagaacacagcgccgcattcaggagccagccaccaaggctgatgctcagtgagattttgcttactggcctttcacagaatgcctcactcgaattgaaaaagctaatttagagggagcagccgtcagtcctatctgtagactcgtgaataaatttgaattactcagcaaagacatactccaagctccgaggacctggattctcaaataacagccaatgattatcacagctaacattgattgggtattgactccgtggctttggctattttgtatagattgtgtcacctaatctttagaaatgttattatttcaatttacctgatactgaaactttattatttaactcagcatcatataggtaagaaaaaagctagaattcaacaccagcgtctcagtttgacatgtcaccaacactcttaactacgacttaattgtgactgcatctggccccatcatcagtaagccaaatgctaatgggtataaagtaggtactgagggctgaatttggaactcagccctctccctttctctcccattcatatttcttgaactgtctggcatttgaggagtcttgactcatatagcttgaattgctgcgctcattggaaacattactgttttaccattgtggcgttcaggtgcacatacaggcagtaacctaattgtatttatttcttatatccctatgagacattagcaaacaaactgtgtacattcaatcgcaggcaaaagagtggggggaacggaggagttctgagcaaacttcagtgatcagtggctgaggtatgatgaggagagtgaggaaggtggtacagctttgaggtaaaaggcacaggagcagcttagaagaccagacggtaatgggatgggcgtgagagtttaaaaggttgtgggtggcaatcagaggctcgtggatgacactaaggaagccgtgcatcttttctaagaaggataaaggaaaagaaagttcagagtacttcatgatattgttgttttggtagaggaaaaattggaaaatccacatatgaggcaatgggttctattttacattgtaataaaaggaatgctttgaactgtgcttctgttttctcatttttagattttttatctcctcacatcttcaaatctgtgagcatttgccaagattcttccttagtcgtacatatgggctcccagcattgcacaacacttatccttaaaagttacatgcaatttatccccttcctggcatggtcagacttcccttttctctcctccctcctcttttcctcccatccccctttcccttgttgtgttagttgcctattaccgtgtgacaaatcccccaaaacatagtggtttaaaacaacaacgagttaccatctctcacagtcttgtggaatgaccaggttcaactaggtggttctttcaaggcctcttgtgcagctgcaaccaggtggtggctggggctgagtcatgcaaaggacatccaagatggcatcttcataacacttctggtgcctcagctgaggtgcttggggacaggctggacagtttgtgtgttctgtctctctcttctcccacccacccccatctctgttctcctctcccacccctctgtgtagcttctctacatggctagcttgggcttcctcacaacatggaagtttcagggtagtcacacttcttagatgacagctgtctttcctcagacaagcattccaagaagtctaagtggaaggaagttcaaagcttatgacccagccttggaagtcactcagcaccactgttgaagactttcgttctgttggtccaaaacaggtcatacagccagccacagagccagctcagagccacccgaagggagcagaccacccacgggcatagatgctgggagatgtggtttattgggaatggcatacctctcagaagaccagctaccacatttctcctttgttaaaaatgtctgtttctctgctccttataactgaaatatcttaaagttactgtcttatgtcttatttcttatattttttctaaggaagtttattgaaagacttctttgaagaattcttacacatgctctccagcgaatcttaaaatattattttcatttagtaatattacaattaggcctccaaaaagctctatagagaaaagctgtgtgactgttttttagaaagtctctttggaaaatcagatttgattcactttttaaccaacgatgataacatatcaaacttaaaaggcagatcggttttagggaaaagtgatacaccgtcctgtgtgggtgtccttgagtgaacttcccaacaatattgcttttcatgcgtagccactaattagaaaacctgctctcttgttggggctaaactgtggtttacttttctggttggacttcttcttgcttatattcaagcttttacagaagccaaagcttattcttttttaaccctcaaaataaaaaaaaaaaagaactcgaatctaaaaaatgtgttgtgtaattacatggcagtttcagaaattctttttaaaaaatcttgtacctatagatggcttaacttagcttctgcaaatgccattgaggacttagattcttctggggagttagctcttttttttcttttcttttctttcttttttttttttttaagaagctaaatctccaaagcttttctctggtaattatgaaaaacaacatgtgtaagagaaagtgggaagttggaggtggctaataatttgatattttttctacccacaaaccttgggaaaactctgctataaggattaatttgctcatgagatttcactttggttgccattaaggaaaaacgaacaggaacagcaaggcagaagtgtttcttgactctggggaaaagagtcaagggtttatggtgggaaacagagcactccttttttccttttacagcaattataagtgaggcatctgaagtttgatatcacttttctcacacaggactttgtatagacacctaaaatctgactgaaaaatcatcagtaattgcaatttctcatttgtcttcatgcgggaaaaagattttattttaaaaacgtattttttctagcttcattgtggtgtaattgacaaatattgtatgtatttaaggggtacaacgtgatttgatatactaatacatatacattatgacatgattaccactatcaagctaattaatgtgtttatcacctcacagagacacggctttattttttttgtggtgagattgtcccagttcctggtaacctccattctattttctgcttctgtgagttccacttttttagattctgcatatgagtgaggtcgtgcagtgattgtctttctatgctttgcttatttcacttcacataacatcctccaggttcatccatgttgcaagtggcagaagctctcccttttttaagaccaaatacaaatgcatttatgcacataccacgttttcttcattcatctttcagtgcacaataggttgattccatattaaaaaaccttttagattctatcctttccccccagttttttttttttttcaatgtaaaccatgagaaaatagcagtggctctgctctgttggtgatttccttccacatctttgtggcatctacatgcagattaaatgggggttccagcaacttcccagtgtggagagtcccccactgctcagagtcgtggagccttcaggttctaccagtaggaggaaggcataaatatttccactgaacaggcaaaatgtgaagaccctttacacttcaggcccaggcaaaatgctttgcccaccccccttccccacccgcagccatccccaccaatgttcagctcagggctgcccttggttatgtcaactgctgatggtgacacgtgaaccagcctgaggagggaagagtagccgggaggagagggggccaggaggacataacggggccaggatgggcggacgggttcttcttcattgcttcattaattctcacacctttttctgtgaagtcatactcttcccatttttgcagatgagaaaactttaacgcaagagttttcataacttgctctcatgcaaattcattcaaataagtatataagcagaagtatttaaactaaataaaatctaagaattttgcttcatcttgggtaacatgaaggattttcatctcctcctcatgggccagccagtggtctgttcactacccgatccccgtagtaagccgtgggtaattggtaatccacctatgaagtcaaacggggaaactggtgaggtaagcccgtggcacttagtcaagtaacaatagttgtcactctctcttgtttaatcttatagtggagtacgacaaggagttctcccctcgtcagcgacaccacaaagagttcaagttcaacttatcccagattcctgagggtgaggtggtgacggctgcagaattccgcatctacaaggactgtgttatggggagttttaaaaaccaaacttttcttatcagcatttatcaagtcttacaggagcatcagcacaggtatgaaggctcgagaaagccccaaaggtggggctggcccctgtttcccaccttttgtcatgacaataaccccagctatgtctgtgcagggtgacctggagttcaggggcagcatgtgagtacgatgaggtgggtgttgtaaatgggagtgtttagctggtgagatcttttgctatttgattttccaaatagctatcttttcctaagaaagctagtgaatgtatttattataagcatcttttgtgatcagataactccataatttattagggttaaaatgttcccactattgattagtcctcattttgaatgataggtgagagtggctaaaataaattcatacattaaaagtatatgatgcttgtaagtgataataattccagtgaatacaaggcagtgtatttgtgcacataagatacacatacacacatgtatctttgagtaagcttgtgtgtgatgtattttttttttttatcacttggatacaagggagcagtagactttttccatgtctgtattactctcgtttcctaaaacaaggccagaccattttacaaaagaactgcagtgaagcatgtgcatggagctgcctagcaatacagaaaaacttccatggaacaattgctggaggactggaagggctgagggatgaagttttatagtcgttagtacagaagaagccaatacacagaagccaatgacctcgaattttgcttagtatttaggggtcagtttagtaagtcagtgagaatcaaggcctttatgcatagtagaatagtgttaccgtgtagctcttagtgtgtacaaggtggaaattaagcaggtgatatgacggtctggcaattatatggcagctacaaggataaaaatgaagggaagtgaacatatgggggagggaactccatgcttccagactccgtaagggatttgtcagatttggttttataaaccaagtccaggttcccacttttggtcttgtgagtctattgatttcccaagaatttccaaaggcttaagaatgactttggtttttcctgaatgtattgatctgtgtgtgggtctgtcacaaatacacacacctgaactcataagcaacattaatttgtccgtgaaaggttcatttttgttttgaaagcaccgccagcatccagcccttgtgcatatttaggtctgtaatggggaaacacagaaggaggaaggacagatgccatgctttgggacatttcatggtatgaacatacatgctgatagttgtaggtaattcatagctaggagagctaaataatgagtaaaatacatccattgtggtatctttataatgggtcacaattttggaacaaaagggaagttttctgatatctgattctcactcctaaataaaaatatattcagtggctatactactgagggcctcttttgaaaagtacattttttgttgctagatttttgtctgttgatacttcagagataattggtattcactgactctttggaactgttttagccattgattttcagtctgcctaattatttatttcattatgtttctctggttagaataacctactggtatctttttggctcagaaatatattgggaatatatgtttttctccgtcctgcaggaaaacctttacagtgaaaaccctaggctgggagttaagtgactggcatttaaaaaaattgttatttgttttaaaaaagagagagagaaagttagcagaacatttgtaaggtttatactgaactccagccaaaaaagaacagctgccctgtgcttaggatggtggtgtcatacttcctcgaggccagcagtgagtttggaaaataaaatcctgaatggtcccaacctttgatgactctctatcaaagcggagagttgtagtttctttgccttctaggatgggagcatttggcacctgcatgtgtttcgttgttgtgcataggaaaggggaaattctgggagaactgggagagtttcatgcttttgaagggctccagtttggccaggaagagattttcttttcttatctgtgggccaggagcccaggcctcctgccgcctcctagcgttcttccagaggcctccagattcagctgcaggactcctttcgggggaaggtttgatctccccatctgtaccatcttggggtgtcttggctgaaaacaattctccaggcttgtgaagaaatgtatttgtctaatctgtgtttaagtgaaatttgtagtagttgatggattaactccatttaacaagggtttgtgttgcaaaatagttgacctccttgaaaaattaaaaacagagtcagggttttaaatgctgagtcacacactcagctggggtggcagaagttgtgtgtcagccttctgatattaaagacagttaggaagcctgacccagggagggtcagggaagattcttgcaagatgggcttttgctgtgaactctgcacaaacatgttcctttgactgaaaagaaatgacgggaccaggtaagtttaaaaagaaaaaaggtggctacttgaatagacggtacttttagtaagaacaagcaaacacttgatactttactcaaaagttgagaataagcccttagatggagtctaagtcatggaagatttgattgaagcaactcatagattagaatggaatcagcaacctaatagggaaacagtttttgcaaaaattacattggcaagggaaatctgacttaactgactccatcttgcttctacttggctaaattgctcttgctcattcttgtgcagaggccatagtggtcctttccttgaatggatccccttcatgtttaaaaattgaaactatatttgtaaagaggtcacaaggttagaattatggaagggggtcaagctttgctaaagaataggcataaacagtgacttgccattgatcagcttacttgtctataagttgctgactgccccagaatcatgtaactggggttcacaaagtgtatgacttccccaactacacctatagataacatcactattgtgaaagctaaagaacttgtctttgagatatttttcagagttagcatttcagcagaccacgagataccacctggtcctgagattccttcctaggaactgactcagctatgtgaagacagttttagacacccctgtgatttcatcctcggtcagtcagtgatttcagttccccagctccctgcctgtcaaagtaccctaaaaactctagcctccaaattctcggggaggcatatttgagaaatacctcctgtcgtactagttggctggtcctatgattattgacctctttctttgctgtaatacctgctgttttcagtgcattggcttttctgggcagtgggcaagaagaacccatcaggctgcaacaatagtctgcatcattaagcttgagtaacacatgatgcctttgcgctttatttatttttagaagtttacttcatggtattgcatggtgtttaaaagatgactttggtattaaaatttggtgttataaatcattgtgtccttgtgatgatgcaggtaaaaaaaattgcattcatatagtagttacagtttggaaaaggccttctcttatattttctcattagggttttaccatgaccttatcagatagacagggcaggcatgttatccttgagagaacaaagtatggcacatacgaattttgccaagaccaaataattcctaaactattgtctgctatgcttcctaaaagtcacttcaattatgtgggtacagtctcaagataaagacgaagtaccggaaagaggtaagcaacctccttatgacacatcctcacacctccatgtccttaggtttgaagcagacaccccaagaatgcttctgtttgaatggcaaatgttttcataggtagtgaagatctgtgtctgttagaattcagactctggtactttgatgtctaaggccttcctacagaaaacctttgcaaaactttgttgatctcttgaccaaccactgatctattaacagtttttctagaggaggggaatagaagggaagaaagattggaataaatttacacaaaagtattatatatttgtcagtttacttctttactattttttctgtattgcatgcatactaagctgacttcacaccgggagtatagactgctctgaatgacttctgacctttcatagtcacctatggtagcatcatgagtacatgcttttcacaacatgcactcatgatctttgttctgtagcacctttatatgaatagtgacattttgaggtctttagagaatatcattttcttctacgttttttacttggttaaaggcatacttttactgttgtaattgaattttgtatacctagaagtcaaagagcatctcttgaaagccaaccagaaattttaacagacacgttcaatatctgaaccgtggtcctgtttggtccatgaagatcggccacacttgtctctgctagttttgaaattccgtgttctgctctctgtgttttggcatttgcattgctcggcagtgatggtctatattctgtgtgtatgataacttttcttctccatgttctatcatggtacaatcttttgggagacatttgaagaattaccaaatttaaaatttatgttccatttaagcaatatcccaggttactcctctgtttagaaataggcaaggatgttttttgtcatttgattttagagtttggtttatatattcatcgtaacttcagaatccttaggctttgaagaaatgcatcttaaaatcaaggagggaaatgctgctctgtagttggtttccatgtttttgttttttgtttgtttgttcgtttttgaggcagagtctcgctctgttgcccatgctggagtgcagtggtgcgatctcggctcactgcaagctccacctcctgggttcaagccattctcttgcctcagcctcccgagtagctgggactacaggcgcccgccaccatgcctggctaattttggttttcatgtttttaatacatttttattgaagttaaagctacatataaaatttaccatctttactatttttaagtgtgtagttcagtggtaataaacatatattcttttcttcccccttcatccctccctccttactaaaacaggaagatttcctcaggcaagcacaggaggctgctgttggagtctccaggaacaatcccagactgaactattgctttaatttttgacagaattcacaaaatcttacctattttacagacagaatataattgtcccaggagagaaaagggtaaaaacacattttccagaatttttagtttgatactgcactctgaaccattcacagagatcgggaacacaggaataagcagagttcagatttgcacgtttgagtcatggtatgagtacccgagacgatgtgagatgtagaagttttgagctcagcagaatgagctaaactacagtaggagattgttgagaccacagggcgaaccactgaagtaggtcacatagaccagatgtgtaagaatagaaaacctaattgaccctgtaccatttattgaaaatactatctttttctcatgtgctttagtggcaactttctcataaattaggtgactatatatgtgtgagtccattttttggatcttctgttccctgggttaatttttctcttcttgcaccaatactccactgtcttaattccttcagttttataataaggcttgatatctgatgtgtaacctcaaaattgttcttgagactttcttggctattaatggcccttcacattcccatgtaaattttaaaatcagtttgtttccacaaaaaataaaaacaaacttgctgggcttctgattggaattgcactaaatctagagatcaatttgggaaggatttacatctcatcgataatgaggatttcagttcaagaaagtggtatttacttaggccttctttaataactctcagtaatatagttttttgtatgtcttgaacatttttattatattaattttaggtattgaagtttctgatgctgttgtaaatggtattaatagttttttaaaaattcagtgccaaattggtttttgctcacatatagcataccattgattttaatttgtatccagcaaccttgcaaatttacatgttaattcgaatagtttttctgcatggccttttggaatttctgtgaatataatctataaatactagttttattttttccttttcaattctattttttatttctctttttcttgctttattgtgctggctgggacgtccagtacaatgttgaaattgttcagatttccatcagatttttaaatctcaggtaaagatttaatatttcatcattaagaatgatgattgctctaaatatttttgtagataactcttcagtagataaaggaaattcttctctatttctagtattctaagagttttttaacattaggaatgggcatggatttatcaaatgtttttttttaattttgggacaatcatataatttttctcctttataatgttatgtgtctgccatattaaatgacttttaaatgttaaactaacctcatatccctggaacaagttcaacttgtgctttattattctttttatataaggctggattcaaagaccatatctgataactttgctatctggatcacctatgggtctatttccactacctgtttgttcccttgatttttccttgtttggttttatttcctggcaagactgctaattttctatttatgaaattctggacattaagaaaaaagttctagatactgttatctccttccagactagattcaatgttcttctgtaaggcagacaaaatatggccaaatcacctttttctttttgttccaggttaggcagggtttaaggatgtattaaggcttatctgtttatggttttccctttctcctagagtttagccctttcagctaaaagtctaggatgctgggcacagcggctcacatctataaattcagcactttgagaggccaaggtgggaggattgcctgagcctaggagttcaggactggcctgggaaacataaagagaccctgtctctacaaaaataaaaattaaaaaattagccaggctggtggctcatgcctttagtcccagctcctcaggaggctgaggtaggaggattgcttgagcctgggaggttgaggctgcagtgagctatgattgcaccactgcgctctatgctgggcaacaaagcaagaacttgtctcaaaaaattttttttaattttaaaaatcttagaaaaataaaaaaccataaaagtctggaatgtttacaagagcccctcttccttggtggactctgtactcgattttttagctcctcagcactgtgagactgccaaaccctctgctttgcttttgagcctctaaacagtttctttctacttgttttctcaactcctcgtcccatataaacacagcttaatatctggtaaatacctcaagtggaaatgttggagttcaaggaggccaggacttgaagagccagagtcctagaggaaagggactacacagaagtgacccaggcttctatgagatcacttttatgagctcatttccatgcagccccctttttttctgggactttagctcttctcacgcactagctgccttgaattttgattttctccccagctggtgatactgcgtaaagctctaggccgctaccaattgctgcttggtgtctgtgcctcgtactagaaattatcaaatgccctgaaaggaaaaggcagcagcaaacacaaggctcaccttaatgcatttcctttctccctgaggtcttgacccatctagtgttgccttgcttggttgctctaagagaacttcaaacaagtgtgttttttagttaattcagtattttttttagtgggaatgttagtttgatacatcatgaccagaagcttaagtctttgaagtatagtgtgttttatcattttcatttggaaatctttttaatgaatcccgacaaatgttgacatttgattcagtaatgaaatggcatagtcctggaaacaagatcgggacccaatgttgatccatttccaggatggaggagagtggtttctttagaaaaacattacctatggactgattgctctataaaatctgttggattttcagtgttgcctgctgaaatgaagacaaaagttcaccctttttagatacctgagacgggtttcttttttgaagagaagggcaaatttgagaaagccaggatgggagaacactatattatagtttgggcagaagaaaaccaaagccttttatccctgtgcccagccacacctttttctctttctgtgtctggctttcacaggcatgatccttagggactcctgaaatcttactgctgacttgataatctctggctccctctgtgtgggcctcgagaggcaagcagtgagcttttcagtatttgttcctttgcccctgaaaaagggataatacaagtgacccatggttcaggttatgtaactggttagtttcatcttcctagtcaagggcatatgacttatacctagaacggtctacttggggagaaaaaaaaaaagactgctcaaggagccatcagaccttcttgttcctcagcctatgttctgttcttggtaaggcacagggtagaagagaatgttatggagaggaattaaagttataaagaatcatatacactcaaaagaatgctaaaacattttatgctggcgggaagagccagtgggtggtgggcaggagacgctgttctttgggaactgcttatctacttggtaaacatgaagagaaaagaaaataggtttttatttctggaaactatgccttatatatttatcattcatgcctcgaaacagatcgctttggttacgtgtgtctccatactatgttgtccagctttgtgggaggcaggccatgccggtggttaagattactttgtaaccccataaataggtacatctactatatatacccataaaaactaaaaataaaaaacttttttaaaagattactttgtaaaacatctttttaaaaaaaaaaaatcaatagcacttttactgtttcatttccccaccttggacgggaatgtggaaatgtagggttggtgatgagaactaaaacatgtaatatttgcatgtcacatgtttaaaaggtagcgggggctgggtgcagtggctcacgcctgtgatcccagcacttggcgaggccggggcaggcgggtcatttgaggtcggaagcttaagaccagcctgaccaacagggtgaacccccgtctctactaaaatacaaaacttagtcaggcgtggtggcgtgcacctgtaatctcagctactcaggaggctgaggcaggagaatcacttgaacccaggaggcggaggttgcagtgagccaagatgacgcactccagcctgggtgacagagcaagactctctctcaaaaataaataaacagacaaactaactaaataaaaataacaggtgacaaactccgcacttgatcactagtgaagattagagtataccccagtgtatggaagcattgttgtgtttatgtggccaaagagagcagactgggtagccgtcagtttgtataaagtttccatcctctttccccctcttaccctgccttggacatatagaaccaagacttctaataacactgatactttggactcgatctcacctgcagttctgtttattagcctaattcgatgacaccctgagggtcatgcccatccataagacacactgacttgtggagcagcctacatttggtttgcactgttttagggagaggagcaagaaatcttgagagcagatagctttcaactctaagttcacaaaacaggcacaggtagtcctgctcatatttcatggagaggtagtctggctttaggtccttggctcacaaagtatggttcttagaccagcagcatcagcatcacgtgggaacctgttagaaatgcagattctcaggcccctccccaagcttactgagtcagaagccctaggggtgaggggcagcaatccatgtgttaagcccccgcaggggattctgatgcaggctacacttgagaaccactgataaaagagcacgtacaacacatgagccaaactgcctgggttcaaattccagctctgcccttgctggctgtgtgaccatgtgcaagccacttaatctcaatctctctctctctctctttttttttttttttttttttttttttgagatgagttgtgctctgtcgctcaggctggggtgcagtggcacaatctcagctcactgcaacctgcacctcccaggctcaagagatcctcccacctcagcccatgcccagctaaattttttattttttgtagaggcagggttttgccatgttgcccagtctggtctcgaacccctgggctcaagtgatctacctgcctcagcctcccacggtgctgggattacaggtgtgagccaccatgccctgcccacttaatctctttgtgcctcagtttcttcatctataaacctgtaacagcattaatagtatttacctcttacggttgttgtgaggcattaatatatgtgagagtacctagaacagtcgcatagtaaacaccatgttaaggtttgctatgttaatattctaacagcaaagtgatttatattggttttttaaagacgaaatagcccctacagaatcaaggtgcatttgatatttgaaacgtctcttcataccatgctagccattgggtgaaaattgagtaatatcaaagactgtaaaaaaaaaaaaaaaaaaaaaaaaaatgcaagtgtagccaaataatgttcattcatctttgttactcaaatttgtatgtgtacatgtatgcagcagtttactcttttttgtagtactttattttcaaatatatgatgccttttctatctttctaatggtaaaagtttaaacataatctatactgtactttacgtaaggaaaaagtaaaaagcatgagcttgactccttaattttctaaaatgaaaatggattttttttactttcattctatttgaaaaatgaatttttcttattgcagaaagtcagttcctccatgtatgaatgttgttttgtattttaatgtaacatcaagtccagacgtacaaatgcaaaggaatgtgttatggagaaataaagaacaagaccacagaatcaccttactgagtatttcataaatctgcttactttgaatatataaatgccagtttatcaagagcatttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggcctcaagagcatttttctatcaaaatggttagtagtaaacactgttgtactttgaccccggcattgtgaccttgatgggtgtgtggtttgtcaggaaagggtcgaagcctgtccaccaggagctcaggcacctcctgcccttgtccgagggcaaaggagagaaaggcctgctgtattttggcaatggtgctctctgtcagcccagtggtgtatcactgatgtgagcatgtgccttggaggctgtgtgatgggagggatatgcagggataaatcttgcccacaaacaccaattctactagtctttatgagtggctttctgattcatcaactctaaagccagggtgaatttttgaaattttccagaaatatcttactagcatattaatttgttaagaacctcatttgcccaggatgaccacaatgtgaggaatatcacgctctgaggttggaataacattgagaagagtaacactgttacatccttgaagattggaagcgtattcatcatgcaaatgtagggtctgagttagttgagaacaaaatagtcaataactgcattaaaaattatcttcccttgtttcaagattttctttcgtggtttgccaccttgagagtatgtcacctcaataggaaggtccaagtaatctaggcatggtgatgattttggccagtctctaggattctttatcagtgacacacattttaggtgagaacatctcttctgaactctgccaaagtgagatttagaagggaaagcttatttttcacgtggcaaaatcagatgcatcttcttcgaggctacacttttacagtccgcagactaggaaggccatgtatccctgaggaaacattagtacatgtgggtcagaccagaaccgttttagtgatttgtcatcaacagcatctcttcaatatctgagttgttggaagctttgagggtgagcccataaagttgtgtcttaaagcttcattcctttttcaagttcctctccctcgtggtgtgaacatattagtgatgttctcatgctgggcgcagcatattctgcttggaaggagcagagcaagattgggagggtcactggggctccaccactatgccaccatctacagctgacaccagccacctcgggcgccttcctgcacgcactctcatacctacctgaccctgatgggggaggcccactggtgatcgatttatttatttatttagacagggtctcactctgtcgtccaggctggagtgcagaggtgcgatcatggctcactgcagcctccacttccccggactcaggtgatcctctcgcctcagcttcccgagtagttgggactacaggagtacactatcatgcctggcaaatttttgtatttttttgtagaggtagggtttcgccatgtttcccaggctggtctcaaatttctggcctccagcaatcctcctgcctcagcctcccaaagttctagtattacaggcatgagccaccacacccagccttcccaaccggtgatttttaacctgtgcctgtcctgtgtatcttattgtattttctgtatccagctgactttagcatttgtatgtggtagactttggtcccttactttattctgagcccttggacagtactttcagcctctgccctgtctgcttcatgactctactttttagatatgtgacggctaaggacctgggccctgattaaattccatttgccccacttaacagccatgtgaccttgagactctctctgggggctcagctgtagaagagatgacataggtcctgccttttctggctgtcctgaggaataaaggctgttgacacagtcaatattcgctgttcctctgtcccacttggcccaatcatcttaagtccatgctctgcctcacttcccttccagaggccccgagcatcctagatctaaacattgaagtccaagccttcctcgctgccataggaccacatagagttttcatctttcaaggctcggccactagactgcacttgttgacctcacaagcttcttaagcagtgagaacagtcagtgttctcattgtacgattacaaaagtgtgccacagaacaacgcaaattcatggggccccagagtgactcggtagcagagtcgggatggaaactgggctctccacatccacgaatctgcactgaccccgtaggtgcaattgcttcatgtcatgatgggtaatcctcatcttccgcctttgccccaagtttaacttttgattcatgttctccctctttaattcattccttctctttctgctcttctctgttttcctcctcctccttggatgatgtgcgtctgcctcattccccacattctcttggacgaggctgccattttctttatcacagaccctgatctttaaaaataaaagctcattctgccagctgtgctaccctcacgctttgaactgtatttctctgtatccttattataagtctttaaaatgtaggtgcctaatctagtcatcagaggtaactcggcatgtgctcacgggccccgccttgagggcagccttacccccgagattcccactgggtcttggtgctagagagtgccagccacattctgcccgtgacaccgatgtgtgccgtgcttcctctgggaccggggctactttcccacagtgctgtctgtactgtctgtgttattgctggataagggtcttctgtgaccttccagaacagaattgatgtcctcttacatctgacttcaaagccttggccttccagtctctgcttgctgttttccatggacaccccccgcaccccccgcaatctccctgctcacagttgttacctcagtgatggggggtaatttgtcaacaggggatgtgacacatccacatcagagagagctttcaactgggcaggccagaatgtggcctcccgcagactctgttaagcagctgagtaaatgacttttaactgtgcctactgtttatacttgggaaagacgacaatagagttcccttctcactttaagtggccatggaggcaggagaaactgttcactcctcctctgagaaatctaaccatttgaacttgatgtttcactggcctcgtaagtatttgatggattaaagatgaagttcattcattcatcacaggtcgtctttggtaatcatctcaatgagacagtatgttattatggaaagctctttgaatccaagactaggtcctgttttttcacttgctagcttgagatcttgaccacatatgacggtagccttgtgtctgagtctcaggttccccagctgtaaggtggagaccgtgacactctgcctggcttttaggattggtgtaaggaccaaacaaagagaagtagatgaaagcactttgtaacttatgtaaatgtatgcttatcttaaacttagtatttaattttagtcgtttttctatctctgtaagatattgcagcaaaatatttccaataccaggagctttgagtctttccatggccaaaatatagccctccctgtcatgggaatcccaggccatctcattctagtggccatgggatggatacgcagattcagattgtccctaaagatgaccatctcctggcactgacctatcataaaatgcaggtgagcagaaggagaccctcacaccgtcatcccacagccccttgattatgttagttcaaaactgtgaaaaagtcagtcttccctgaagggcctaatggaaggaatggattctctgactttgcctcaaagaaccccagctgtagctcaccactgtgctgggatgaactttaaaatcactcagcatccaccctcggctacacagtccatatggggaaggactgggtactcactgcagaccattcagaggccttaattaaaatagtagatgattacttaggcatgcgatgtggcttcttgtttctccttatttcataggaacaaacgagaagattttcagtcccaatttcaaaacaagaaaaaatgagcaaagcccagtttataaatgctcatatggatcctgatttttatcttttctcaatcctgtttctcgctgtctcctactttccctgtttttagagcttattagccataaagtaagctagtcactaatagtatcataaataaatttttaaaacataatagaagtattaaaatgtaaatgccactgcactacagcctaggtgacagagtgagacccagtctcaaaaaaaaaaaaataaaaaagttttttaaaaaatcatttatttgtaatttatcctaattcgcaaaaagatctgtcataagcagcactagcaagatttttggtaaagttgagagggtctgccgtgtcggggtgaaagctgatttctatgaagcgccttatcagatgtgcctgtctctcctaattgtgtcatgcctgtgtcctgggtggtaccacgcctttcagggctatggcaagtcactgtgcttgtgcctcacaggtagatgtgatctgactcgggcatgttttatcctgacgctgagacaggaaagagtgggaaggagcttcaggcagtgcgctatttaccaggccattttttctttctttcagagactctgacctgtttttgttggacacccgtgtagtatgggcctcagaagaaggctggctggaatttgacatcacggccactagcaatctgtgggttgtgactccacagcataacatggggcttcagctgagcgtggtgacaagggatggtaagttattatccgcaagcctccaacgtccagcaagtcatcagtttcacacatttcccttacagcagttgtgatagaaccgtgggcaacaggcaagtcctcagcttcaggatggcctcatttactgatcccccatgacttgcattgagaaccaaaacctttcccggaggcctcctagacaggaattgaaaacaggcttgggcaacttggagacaggagagtggtaatgtttccaagaggatggcgatgggaggacagcttttctaggcagaggcaggttgcgggggatgcagcgagtaagagagaggcaggcgcatctgtttaaatcctgacggatgaacaggtttgcagtacccactcctcctgcagcatcagagccagcagcttgaggtccccactgctgatctgtccaccagggagggcagggtaactgcagattcataatctagcagaaacaggagagcccaggagttcacgccactccttcatgtgattctgaaactttgaaaggagtgctttgattctgccaaaagatgccatcccatgggtgccaggcaaggtttggggatacatgatcttcttcttcacactcattcttaaggattagcacttaggaaactaggaagtatcccttaactgttgtagctacaggaacaagtttctgtggaataaagagatgcatgctttgatttgcattaaaggagtccacgtccacccccgagccgcaggcctggtgggcagagacggcccttacgacaagcagcccttcatggtggctttcttcaaagtgagtgaggtccacgtgcgcaccaccaggtcagcctccagccggcgccgacaacagagtcgtaatcgctctacccagtcccaggacgtggcgcgggtctccagtgcttcaggtgggtttgtggggagcctgtgtttccagaaagccttgttggcctcagtgagaacaaaagttgtgtccacagtctcagatgtcgggcagcttctgcacagcaaatccaaaggcaaataggtgtcatatgcatgatggtaccttgtacagtcgcagaacatctgcgtgggttctgagggccctcagcctggaacacttgttacctgaagactcaggctgcccgcatcatgactgcctgttgatccagacaagcatctttctgtttggttacatttctccaactcttttttaaattcccatcaaaaccctgggagcacctagattcttttttctagttgcgttatgctggggggttatgatgtgcaagcgaacttggtacagttgtgtaatatgaacttgtatttgtcagtgctcttggctggaagggaaggaaggtcaactcagccctctaggatggatttctttggctcatttaatggagaggttgagggtttttttgttgttgttgtttgtttttgggagacagagtctccctctgtcgcccaggctggagtgcagtggcacggtctcggctcactgcaagctccgcctcctgggttcatgccattcttctgcctcagcctcccgagtagctgggactacaagtgcctgccaccacgcctggctaattttttgtatttttagtaaagacaggatttcaccatgttgaccaggatggtctcgatctcctgacctcgtgatccacccaccttggcctcccaaagtgctgggattacaggcgtgagccactgcgcctggccaggggttctgtctttaggcatggctggatccatgggctcagatgataatcaggaatctctctctttttctgtttttctatttttctttgttggtggaattcttagtaaaactatctctatatggtggccaggaaggcaaccagtggttccaggatttttgttacccttggcaacctcaacctcagacagagcccttcttcagcagaaatccagggcacgactccggttggcttggctggggttgcgtcctccaacctgaagcacactgctgggtggggagtgctctgattggccagacctgaactgtgtgctcacccgggagctaaggaataaggtgagtcccattctgctcagaacagacacattcaaagggcaagagagagaaaccagctctgctacctgagtgtcagctgagtggtccttcagaagtgttctccctggcagggtgcagtggctcatgcctataatcctcacactatgggaggctgaggcgggcggattacttgaggttgggagttcgagaccagcctggccaacgtggtgaaaccccatccctactaaaaatacaaaaaattagctgggtgtggtggcatgtgcctgtaatcccagctacttgggaggctgaagcaggagaatcacttgaacccaggaggtggaggttgcagtgagccaagattaagattatgcctgagtgacagagcgagactccatcgaaaaaaaaaaaaaaaagttctccccagtgtgtttttaggaagtggcatggaagtccacccatggaagcccagaggaagggagagtggatgttccctccccacagccagtcccgtagctagttaggattgaatggaaacccagacacttctgactctaatgccagtgcttgcaaattctggggtcctttggctatttaaatagcttgagaatcaaccataaaggtgaagattggcagtgggatttgcagccagagaacttgtttccctggttgctaccctgtgattttggacacatttaatctgtttcagcttccatttactcatctgtaagatggggatgatgaatgccttgcagatttgctggaattaaatgaaaagcatcaaaatctggctcataatagcactcaaagattatttatatgccattgtaggaagtaggttctcagggcatatgttgggatccctggaaaacaagtaaaataattctggaagatgcattaattcttccaggtaattgtacagaaatgtcatttttggtggccaaacatgttgggaagagttaatgcaacttcccaaagtacctatttcttctttgggaagcagtgtctccattttgtgttccgacttaaatcaaccatctattttaccagtaacttggatgtggagcttgaggatccaccgcccagcgtgatgtgacattttgcttcttgtcatcctggtgtttctcggaagcattgctcacagcatgggtgttcctgtattcaccactagaaacagtcagggttggggtttttgaaaaagagaagaaatgcttgctttcctttattcacttcagaggcagcctgctgaacagagttaataatctcagtgttttccttcgggctatgatgatgaagtctgccaatggtaggcttcaatttattaatggaagtctgccaatggtaggcttcaatttattaatgaactgtggtcagtttggtgctgggacctcagacacagaggcatctcttgaaatgttgattgctttttaaaattaaaacttcacttgattttattcagtaccccccacccaatgcacacactaatgtttttaaattgagaaaagatgttgtgtctgattttgattttagcaatatcaaccaattattattttccaagtccctttcaacttttttcaatttgatgagtttaaattaaatatggatattcaagttgatctaattagtaataggtgcaaatatctctgtttttcagtggtctccccccgcccacctcccaagccagtacttccaaatttgctttgtccctttcagtagtacaaaggcaaaagggttcatacgaaatctctccggtctcacctatttaaaggcccccaagaaagaatgacgatgaaggatgctccctccttctcattctcttcaaagatcctctaagtgatctgggaaattgctcatgtctggcccactgaagcgcttctttatatttttggctctttcttccttatctattcttccattaatgggagtggacatgctgaggaagagattcccagaaaagatttccagagagatggcctgctacctggagaaatggcctgtctggtgttcctctccctcggggtctctgtgaggccagatgttgctgggccttcatgaaccaggtagacattacagtaacagaaaagtggtgtactctggcgtgactgcaggcagactttctgcttgtaaatcttttggaagttggaaggaaaagattgcattgtctctgctgcccccttcttccatggcgtgctcccagggagttgatagttctccaccaaaacaaccaccaccagaagcagcccaccagggatcgtcctacatctgggtaaagaagttagcattcattcatcaaattgcctgtcatcagggtgaaacgtggcaaggaaataagaggctatttttggaattgtgctgtcagtgcctgagacggcaagactagtgcacagcagtggagaggccaggagccccaccacccaccaaaatctactcaaacatttgtacttggctttcaagctggactttccaaacatgtgcactggatagtggtttggatcgacgtctccctggatggctttcacttgcccttgcttctctgcagctggctgctctaaatgaaggctggatgttggttggctctgttatacttctccaggggcttggatagcctctgcatggtatcatttattgtttttacacatgtttgactagtcctggtcctagccgtctttgccccattggggattttaaccaatctaccaattctttttcagcctccatttcttaccagcctgctgctcttgcaacacctgtcctcaggttctatagctccagtttggtggtctccttctacttgttatcattcactctcttttatggtagctctcacttggggttcactattttatcttctgggggactgtgataccacttggccaatccatgacaaggtccatgaacaaatggccttgaagttccattgggtgattctaaattttcatttggctaattttccggatctttccaagacctcttttgagagggtgtagctaaagcaatttcaggtcagctggtaagtctgaagtctgctctgctgctgctgctgtgaggcagaattggtctttgttttgatagatgagtttggaaacattatctgcactttaatgatccatgtgaaattggagtagtctctttcagtcttgatgtttatgttgtcactacccagctctgccaaccatctatgacccagcagcctcttgagacactgtctgtcctttggaatgagtctgccattgtatcaatgccacctattagcatttcttttttgtttgtttgtttttaagacagtttcactcttgttggccagactggagtgcaatggtgccatctcagctcactgcaacctcctcctcccgggttcaagcgattctcctgcctcagcctcccaagtagctgggatcacaggcatgcaccactactcctggataattttgtatttttttagtagagacggagtttcaccatgttggtcaggctggtctcaaactcctgacctcaagtgatccacttgcctcggcctcccaaagtgttgggattacaggtatgagccaccacacctggccagcattttgtagagtaagttctccttccctccttttcccacccccaaacatgtatctttaaggaccttgggggaaattgtggctctagtacattcagggatactcctgaccttcttcttgatagtttatattttctgtcctttaagcttcccggttgggactattcaataggctttcagcgtaaattaaccaggagtcatctcttgcaaaacagctgtttgagtagtttattataactgtgcaatcttgtgctatacatttcaaggaaatccagtccagactgggggtctcattgttacagtgtcctcactacttcaccattggcttccatggattggggatagccagagctgactgggtcggtccaccatggacattcaaagcttgggaagaatagacacaggtcaagactgtgaactagcagtttctagttctccaggaaagttgggaattgtgatttgtcattgtgatcttaaacttttagggcctgcagcttggcttgcagatgtcttaagtagagtttggttcagggcttcctatatgaaatcaaaccttaattctccatagacatggaggacagtcatggcaaatagtgatctaaaagttagaatcaccaaaaaaaagttagaatcaaaagcttcacttctatcatgcacaactcttgttcgaggataatggctatcaaagagtggaacagactgtaaagttcccttctacctcctcccaaggttcactccttgcaaatgtgcaaatggcaacaattctaaaaggcaataagaagaagcttatgcaggtaccgtgagatgcctaagtcattcccgatcattgccaaccctgggagggcactggggccaggagactcagtctaggaagtggcagagagtatagaaggtgcttagagcacagagggtcttagagctaagtttttaaaggaaatctttgtctatttgtaggacagttccatattcttttagaatcaagacaaaggctgaaaagagaccaaagtcccacccagattaaatggggccttatgagatcctgaaatctcctggagcaaccaaaaaatagggcctcactgttgcttctcaatgttgaccatccaaattataaacaaaatctagactctgatcaaactgtccacccccaccccagccctatcaactgttaggagattattgacaccagaaatcaaaaccccagtgtggtccctggcctcccgtagtgtcggtgacacaaggagctggcacctgctgcgcgttcttcaatggctgtattgattctgctgggcgagtgggagcgagaggcttgttttggataagatggggccgataaggcccagagatatggaaagagcggccaggcccatgaagacagaggtgccactttaacgacctctatgtggccctcacccttgtcattctaggagagaagggaaattaaagtagtgaattattccctctaaaaaacaagtttcctttgggaagagtctgtagcctgagctcaggaaagctgggaaatacatgtggagcatgccgctttgtccagtcccctgccatgctggtattttcttggctctgtgtgacctgctgagcggggacacccggctgagctggcagggcctgcggggtcagcccagggcagccgagtggcccctctgcagaagccctggtgaggagacgactccctgcccacctctctccctctccctccccacctctctccctctccctccttctcacctgctttctgtggtgtccctgacattctctctcccctgcctttgtttcccttctccctgtcttgccctttgtttcgctgtcctcctctactgaagttgcaaagcacagcaggcagggtcactgggacccaggctggctctggctgccgtgactcaggcgcaccccccctgggagcccacaggcttgctgcagcgccctagccccgtcatactcacagcagcagctgcgtggtggccctccagccccgcggtgcagcctccccgcacaatgcctgcctgagagtcaggatggtggctgcgcccttcccttctcctctgggtctcatacctatgggcctctcctggcctccagtgccagggaagcctgcctgtcactggcccatcatggcatatagggattgagcttcagagctaaccaacagtgggctcctttgcacttcgctgtgtgcgtggctcttcaggagggccagataaaaaggatgctggatggaattaacccagatgttatgcttagtgtggggtatgacccctgcattgggggtataggcaatgtatacagtgcatgtgccgctgcctggggacatggcttctgtgaggaagtcccagcccagctagccgccttctgttggggccaagggtgccctgtcctcactgcactggatgagagagctattctgcagttttcagtttgccttgggacgattaggatgccctgccccgtcactgtcacatgggccccggcagccttcccatttgttttctcctgtagatggaatgtctcctcagtcatcacaggggagaccaggacttaaggtcggggagcagaggctatcagcaaggaagctgattgtcaggtccaaggcctagcaactgagatgagaactccccaccagaactgagcagactgtaggagctcagcagagcctgtgtggaacgtgcacctgcaacaggaggagcaagggcaggaagatgctagaggacagagaaaggggatcagccagaggcgtgtgtgctgggagctgcagcatgtacccctgatggcccccaggaagggagctatggcccctccaccaccaccctcagaacaggactctcagatgtgaaagctcagttgtgtctcaaggacaagaagactccatcactgtgtcctccctcccatccgctggactccagaaaaatgcacctccatatggctcctttcaagttagcccccaacccctcccaggtgtactggcccccaggtaacatggaggaatgacagataatgaaagacacacctggggcttgggagagggatttcagagccatggctggacctgatgctttattccgaggtgaattctggattggaacaccccggtctcttatggtagaaaatggcaggcacttccacatggtcccgccatcgggaatggatgggacacttctacctgtttctctaccactgattgcatcgtgcagaaggcctaaatgagatgcaagcctccctttggcaaagtattggaaaaatgaaggcaacgtattggaaacataaaggcttcataaagacacgctttgggcaccacagctgggacctctctgcccaactctgttctccttctgagggggatggtgcctgtctctgccaccttcttttccactacagatcatggagagtcttgctgaagaaccttccttaggggaaacaggcatgtctgtcttggatcttttttttaaaaaacaacaacaacaacaaaaaaaaacgggtctcactctgttgccagactggagtgcagtggcacaatctcagctcactgcaacctctgcctcccgggttcaagcaattctcctgcctcggcctcccgagtagctgggactacaggcatgtgccatcatgcccctctaattttttgtatttttagtagagacagggtttcaccatgttggtcaggctggtctcaaactcctgacctcaaacaatccacctgcctcagcctcccaaagtgctgggattacaggcgtgagccaccgcgcccggcctgtcttggatctttagagttcatctccatccccgaagggagttgtagaagcttcctgtatcatgggccccacttgcctgtcccacactgtgagaggaaacccatttacatctcatgtccaaagccatttttttcctacaaatagttttgtgtgtgtgtgtgtgtattgaggggttataaaggaaagcagaatattttatcatggtttttgcttcagtggctttaggacaaattagaactcaactctggtgctagaaaagaaaaatctccacttaaaacccatgttcaaatatctgtaatgttcatttggagaagagaggaaggatttgggctttttaatactaattgtacctgaaggtttccctgcggaagcagtttattaaatgggactgaaagccgcgctgctaaaggcaattaacatctgatacattctcaaagctcagaaatctttggtgagaggaatgtttctgcctgtgtaagagcaggccagggagttaccttctgcttatggaaggaattcgtcctgggggggcttttatgattgttggattttgtcatctgtgtcacctgatcactcaacagttttttgcccaaacccacctatggctgggccctgcttgtccaagttgccctggatgagcacctggggccttgtcttgagggggaaaattgcctctgggcggctggtgcccctgcccttgagggggaccagatttcactgtgtattcaactttgaaaaagccagagcccttgaaaatgtctctcaggaccaatattgggccttgactgcagctgtgtctggggatgctggggagccttggggtcccaagacagactttgtgtctcagcagggcagtagcgctacctgtgtgtgagcctcttgtctagagggcagcagttccaattctggtgtcacaggcgcatgtggacagccaggggcctgatctcagtggctctgactcatgggtctgggattgagctgagaaccccgcactttagagaaactccctgatgatccccagtattcggcacaggccacctacaagtcacacactgagagcttctgtcctggcggcgggggtggtgggggaggctcctctgtcttgggtcagcttctctggtttttggtttgtcgcctctctctagctgtctcacttcctttctctgccctgcccttgactggtgaatccactggggcaaagctgtgttacctctctttgtcccactggagtgaccatgttcctgttgaattgtcaccacatacatttccactggccctcttcagcccattcatcaaaaccaataccaagggcagtgggagtgaggggaaagttttttctgtaatctgtaatctgtcaatctgtttaaaaaaaaaaaaaaaagtgtgtcagtataattccatgcagaacccagggtactgaccctgagtggcagacacaagtattccaaggagcatcaaccttcataaatatttatacgttctttgccagcacttaacatggaattataaggaaatttaagcatggcctgagagtatctgtaggaagaaaaacaggagagttgaattcctccttttcctctctctggccctgatccttacttaatgacaaaaatgccagtgtctggcgctaaaagaaatagctgttcttccagagaaggttctctttgttgagcattgagagagtcaaatcaacagcaggttcacagaaacccagaactgctggtgaagttagaagcaaagccctttgactatgtcatcttggttccatccagcagaaaaagaaactggaaatccagacatgaagtggtggtctctgcctgtgttctgccagcaattcttcaacaccaattaagtgtcttgcaattcaatccaattctttttttttctttttttttttttttttgagacagggtcttgctttctcgcccaggctggagtatggtggcataatcagggctcattgcagcttcaatctccagggatcaagcagtcctcccaccttagcctcccaaatagccgagaccacaggcacacaccactatgtccagctaattttatatcttgtagagacagggtctgtgttgcccaggctgatctcaaactcatgggttcaaacagtcttcccaccttagcctccaatagtgctgggattacaggcatgaggcgccacatctggcctcagttcaattctgatgccacctggagttagcacaggcccaagtgaaagggcaaggtccccaaggagactgctgtcatttcagacaccaggcacaagtgaggtccacagggcagccatgcttctgtctgtcttgcctacaaatttgggagttcacattaccgcccttcatgtttgataatttgctggaacaattcacagaactcaagaaagtgctatacttacaatcataggtttattataagaggtatgactcaggaccagccaaatgaagagactcttaggcaaggtcaaggggataggcatgggtggttggagcttccacacccttttgggtgcaccgtcctcttgaaacatcagtatgttcaccaacctggaagctccactgagcctcagtgtctggagtttttatgtggggtttaattgctctgcacaattgaatcattggtcacatgattgaactccatctccagccccccagaggccaggctaagccaaagttccaaccccctaatcctgtgcttggcttttttggtaactagcccccatcctgaagctaatgaggtcctagagagtgtgtggggttcaccgtgtacaatctagggcctcaggagcataacaaagacactcaggaaaatccaagggttgtcaaagcttggtgccaggaactggggacaaagaccagagatatatttattattttcacactgcccatgtctgcttgacctgggaaagaaagttgtttgtagaaatctttgctttttacatgaccaaatgatgccaagatggtcttcatggagattttggtccctagcacgagacggtattttggaggaagcttacttcacaagcagaatgaggttggatggggaaaatcccaggctaagactgtaagtagtgtgatcatgcagtttatcatctaatctaacccaggacacctttaggagcgcagggcgttaggaccttggggtcttcaggagactcccctgctgcacccagctggcaggagaggaaagagtgagtggaaggctgatggggtagggggcaggtggttaggagggccaggcctggcagcaccacacatcccttcttccccacattcatgggcagaatccaggcacatggccacagctaactgcagtgggaaatgtcatctggctgtgtgctcaggaggttgatagaggatgtgggttgctaataaacacatcacagccgccgcatggttgttcctggaataggtgaagcaggctgcttcctcagggccttcacattgtcattcccactctaggaaattctctcaccccagatggcctcatgcctcactcccaaggctcctcttttgcttagaagataccttaacagaaagacaaggccaggcgaggtggctcacgcctgtaatcccagcaccttgggaggctaaagcaggaagatcacttgagcccaggagttcaggaccagcctaggcaacacagagaaacaccatctatacaaagtatttaaagaattggccaggtgtgtgatgtacacccagctactcggaaggctgaggtgggagcatcacttgagcccaggagttggaggctgcagtgagccatgatcacaccactgcactccagcctgggcaatggagtgagaccctgtctcaaaaatttcttaaaaacccacaaaaacaaaaaaatccagacaagcttgtcaacgctatgtgagatagcacacttgccaccctgtactctctatgccctaactattgaataataatttagctagtccgggtttttactagtcagaattttccagagagacagaatcaataggatatatggagatatatatatatataggaggagatttattatgggaattgactcaggcaattacggaggccaagaagtcacatgagctgctgtctgcaagctggagaaccaggaaagctggtggtgtaattcagtcttgagtccaaaggcttgagaaccaggtgagccagtggtgtaagtcctagttggaagtcaaagccctgagtactggggagggctgctggtataagtcctgaagtgcaaagccctgggaactgggagctctgatgtcccagggcaagagaagacaatgacccagctcgataaaagagaatttgcccttcctctgtctttttgttctctctgggccctgaaccgaggagatgatacctatccgtgttggtgagggcaggtctattttactcagtctactgactcaaatacttatttcttccagaaataccttcacagatacaccccaaaataatgtcttaacagttgccagactcagtagcttacacctataatctcagcactttgggaggccaaggcaggaggcttgcttgaggctaggagttcaagaccagcctcggcaacatagcaagtccccatctctgcattaaaagttagcttgtggtggcccgttcttgtagtcccagctgcttgggaggctgagtgggaggattgcttgagcccaggaggtcaagtctgcagtgagccatgattgtgccactgtgctccagcttgcgtgacagagcaaaaccccattgcagaaaaaaaagttttatcagctacttgggcattccatagtccaatcaagttgacacaaaattaactatcacagtgctctagattgcatgcagtagaagcagactgtaatgagagagaaaagcgtaccagggaacttacccaatcaacaaaaaggctggagacttaattcaggaaatcaaggctcagatctagtcatggaacaatgtgctttggatccctccaatgtggtcatcaccctagacactggctgccgtactacccattcttgatgtcacctttgagtcactccctcaggttatacactgcagggtggagacatttgattggctttgatgaagtcatgagtccgtacttcagatgctaggggacaaagaggggagctatctgtcgtgggaaatggggctctgagtcccacctatctaggcattcccccacatgcgaagtgttgccaaaagctgggtagcaaaagcagtaaatatccactacagctgggtatggcattctaggtttgatggcatcattttcatattatttaattttttaatgtgtatttttgttaagtttgctatccattttgtgtttcttagtaattttctttttatctctggattacttttaagaatttatgtgtttgatataatttcactacatgtggctagataagaatttatctgatcctcttggaactctttgggccttttcaacttaaagatgtttgcctttctttagttgtagaaaattcccagtcattatgtcttcaaatactactactccctattactgccttccgaaattcctattagaaatttgttggacttttcattctctcttccatgtctctttacaaagagacagtcatgtattttggccatttgattctgtgctatatttgaagagatttcaaatatactgttgaattctttaattctgtcttcagttatgtgtaatttgatgattatctgtttaatgtataactaatctgttaagtaatctgtttaatctgttaattagacaactaatgtttaacctgtttaatctgatctttagttatatctaatctgatttcattgttattttcaatggttatggtttttataaagttctatttgactctttttacatctacctgttcttttttcatgttttttccccataattttgttttaaggtttctagtccttcttttcttccttccattattttaggtattcttccttttttttcctctagtttttgtttttagttttgttattgttttgttttgttttggtattcttcctttagagcttagttcagatgactcttatccacagtctctggggtcctctgggtcttcccttgcattccagccatcctcttgagagactttgtgtggctgattcatttttgttcaggggttcttttcagtaggaagtttctgtcttatggtgatagttggttgattgtttttactgagagagtccttgtcctgcattgtgaaaatttccctccagggcttctctggggtccttaaagttacaggcagggtggttctgttgggtaacataggcaggtggagaggataaataaatttagaattataaaccacctaaaaaagttgccccatctcttctcccagtataggccactggcctgagtcactgtctcttttccttaaaaaatcatgaaatctggtggggcatggtggctcacacctgtaatctcagcactctgggaggctgagatgggcagatcacttaaggtcagtagttcgagaccagcctggccaatgtgttgaaaccccatctctactaaaaatacaaaaaattagctgggcatggtggctcgcgcctgtagtcccagctactcgggagactgaggcaggagaatcgcttgaacccaggaggcagaggttgcagtgagccgagctcgtgccattgcacttcagtctgggtaacagagcaagactctgtctcaaaagaaaaaaaaaaaaattaatgaaatctgcacgctctctcctgcttcagagccaggaagactgggagttagaagttagaaaatcaagttcaaacaggctttcaacaattaggtgacttactggcttatgtagttgaaaagggaagggatagcctgcaaatgacctaggctcttacacccactgacatcccacattagatgacctttctctaaagccttctccttgccttttctctctccgtcgtttctcgaactctccaacacaactccagatggattaatcctttcgaatcacagcgggaaatgctgctctgcagctcagaaccctgcaaaggctcactttgtgcctctggtgggaagtccgaagcattgtggttggcagcctaggccattcatttctccagctttatctcatccgaccctgcttgacacatccttaaatccattccagcagaactcctctctcttcctctcactcccactctgaactgtcccttctctgaagggacatttgcctatggcccttgcctgtgtgatatttgcctatggcctttgcccgtagcatccatgttctggtttgtattggagttatttgtgtgtctgttttacaccaccccttcattcactgagttcttggagggaggaaagccatgtctgacttaccgtctattggccgtggtgccaggcagaaggcatgtcacgtaagagtcgctccagtgggcctcagtgaattggggcacccccagtgctcttgctggtgattcagttaagccaggctagtggcccctgtgctgcacagggtgggtacatgcacttcagcagagtctcctgaggaacccctggcttagtgttattgcatcagcacacaagagctcaaccctggcagtgaggtgggagtacagccagagagagcattgcccctgcgtggtgtctccctctcccccgttcctgggcctcctggtttggccccactccaccattactcttccttcaggatactcttctggcccggcagctgtcttgaaagcccctgtgcagtttcaaaatgctccctgtttggactgcagcaaatcctgcctagtagcgttgtctgatcatgtgaatgtgatgccttcccggtctggcgcctctggggtgtactgggcaagtcggcccacgcctccataggccttgcatgcagcagggctcacaacacacctctgttgcttaagggtgtccattcaagtcaccctgctcccagtactgaccccagggtagacaaaacggattccgtaagacattcaagccaacagtcaggaacctgatgtagctgttgggtgaccatacttgtatctaggaggctatcctgagcctagcacagagcctggcatgtggtaaactctctatgaaggaattaatgagttgatgggtgcatcttttgatgggtgcatcttttgatctcctccaacagattacaacagcagtgaattgaaaacagcctgcaggaagcatgagctgtatgtgagtttccaagacctgggatggcaggtgagttctctggacacgggggacaaaggtcctttctcagcagtttactctcatctgaatggtggcagccattaccaaacacccagagcttgattgaaggctgagctgcttccttctgtggaagtcctgaggagccctcccaaatgctcaggctcctggagtaaggcagaggaagcttagtctgtggggcaccaggcgctccaacaccttcctagggtgcctgagctctgtgatccctcaaaaatcaatagccacatttcccaatattctcacctcatcctttcaaagcccataggacatacatttatttgggcatttaaacaaattttaattgagacagggttggaaaaaaattacctaatggttaacatctccaatggctgcaaaccagctcaccaaacgatgcagaagagcacacgtttgcctcgtacctgagaaccatcactagtttgtaagaaaggcagcaactttaatcacaggtggtgagcgataaaaggtagcttccatatgcaggtggcactacttccgcaggagcaccgtgggctcctggagaggcttgcttgggtccaagcacatattgctggcaacctacgtgcttccaggtagcagctgaggccctgtgggcctctgcaaggagcgagggttctggggtcagatggaccaggttcacttcccagcattgccacttgaatgtgaacttggacaaattcctaagccttcctgcgtctgtatccttgcctgtgcaatgtgaaaaataccttttcacagcattcctgaaaagcacaaatagtgtgagaagtgcatgctcatcttttgttgcttcctttgcatgaaattaaggactggatcattgcacccaagggctatgctgccaattactgtgatggagaatgctccttcccactcaacgcacacatgaatgcaaccaaccacgcgattgtgcagaccttggtgagctctcggagactttgttttgtaagtgggagtaagccaagaccaggtgtcatttctaaggtaccttctccccttctgttttggaacaggttcaccttatgaaccccgagtatgtccccaaaccgtgctgtgcgccaactaagctaaatgccatctcggttctttactttgatgacaactccaatgtcattctgaaaaaatacaggaatatggttgtaagagcttgtggatgccactaactcgaaaccagatgctggggacacacattctgccttggattcctagattacatctgccttaaaaaaacacggaagcacagttggaggtgggacgatgagactttgaaactatctcatgccagtgccttattacccaggaagattttaaaggacctcattaataatttgctcacttggtaaatgacgtgagtagttgttggtctgtagcaagctgagtttggatgtctgtagcataaggtctggtaactgcagaaacataaccgtgaagctcttcctaccctcctcccccaaaaacccaccaaaattagttttagctgtagatcaagctatttggggtgtttgttagtaaatagggaaaataatctcaaaggagttaaatgtattcttggctaaaggatcagctggttcagtactgtctatcaaaggtagattttacagagaacagaaatcggggaagtggggggaacgcctctgttcagttcattcccagaagtccacaggacgcacagcccaggccacagccagggctccacggggcgcccttgtctcagtcattgctgttgtatgttcgtgctggagttttgttggtgtgaaaatacacttatttcagccaaaacataccatttctacacctcaatcctccatttgctgtactctttgctagtaccaaaagtagactgattacactgaggtgaggctacaaggggtgtgtaaccgtgtaacacgtgaaggcaatgctcacctcttctttaccagaacggttctttgaccagcacattaacttctggactgccggctctagtaccttttcagtaaagtggttctctgcctttttactatacagcataccacgccacagggttagaaccaacgaagaaaataaaatgagggtgcccagcttataagaatggtgttagggggatgagcatgctgtttatgaacggaaatcatgatttcccttgtagaaagtgaggctcagattaaattttagaatattttctaaatgtctttttcacaatcatgtactgggaaggcaatttcatactaaactgattaaataatacatttataatctacaactgtttgcacttacagctttttttgtaaatataaactataatttattgtctattttatatctgttttgctgtaacattgaaggaaagaccagacttttaaaaaaaaagagtttatttagaaagtatcatagtgtaaacaaacaaattgtaccactttgattttcttggaatacaagactcgtgatgcaaagctgaagttgtgtgtacaagactcttgacagttgtgcttctctaggaggttgggtttttttaaaaaaagaattatctgtgaaccatacgtgattaataaagatttcctttaaggcagaggctggtcgagatgctgctgttatcttctgcctcagacagacagtataagtggtcttgtttctaagattcctaccaccagttactttgggccaagtatccacatccccttgcgtatgggaggtgggtgaagagtgttggatgcaaagtggttattatgggaagtagctcgatggtaaaaggacaaacacctatctatcttagagcttaagcctgtatgtgcttattcccaagggagatagaggtgtttaatcacaaggacagcatgagttagaggacactggcatcaacagctgccacagccgtgcacaccagggccagagcagcccactgacatctgtctttggtcttgagatcaaatgcatcccattcttcatacattagaaggtcgacctccttgaagcagaccaagtatagcaagcctctaaaaggactactgagaaacagaatcagaaactctagaactctagttagggcccttcagcagggctgcagagcctccctggatacccaggcctgggaaagcctgtctggtcttgtcaccccaggtgacaaatacaactggaatctttcaatgagttaatgagatactgagaatgagcctcgtggaattttccatgcctaccctttctaaggaagacatccaacagttcatgtgggctctggcttcgtgttaacatgaggaactaaagacatgtttcaccccgtgagaaacagaaggatcccctgaacagtaactgatttgacaagtatcgacacataaagttatggcatcagcattctcttactcaggcacggtcagaagtaacgctgctttcatcacggctaacctctcacactgagagaagtattcacagcaacagaagctccagcagcggccgtgaaggtatcttccagaggtgtgggtttttgcatttcaatctgctccatgctacggaccaacacagtattgagtcaactgtgaccttaagatcagaggaacgtcaatactgccacaaggccacctttccagaactcgtgggcaggtaaactatgctttggatgtgctttctttcaccaaaatcactcaactcaggagccacaaatagtccagcaatttcatttccctcaacgctattttagtctcaaaggaaaccatgtaaatttcatcaagagaaggtcaaaggggatatatcgccactgaaaatgtttacacagtgaccatgagttacacatttacttagagaaacttaacttaataaagaatctgtagagtgtgttggcttggaaaacacacacacaaagaagatacctcacgcttagtatgttctgctttctgaacagccaccactgggaacccagtggcctctgtgggactgaactcctaaacgcagggtgcgggagctgggcaggagaggtgacctccaactgtgttcctaaagttcgtctttcgcttggctcaggacaaagcggtgtaacgagtcaaggtctctgcctccactgtgctcactgactttcttccctcctcggaaaagcaataacgtggggtagcctcgtaccttaaaacaaaaaagaaaaaagtttgcaaaccagcggtccagatcacatgcaaattgcttcctaaataaaaccagatacactcctaccgttgtggctggaaaaattctgtggctaatttttaaaggtgtatattccattaaaacaggagcagactactgtttagaaagcacagccgtggggctgtgtgttcacttctgaattcaaaatgacatcattaaagatcagcctcaaaggaacg

SEQ ID NO: 11990 - DNA, 99748 bp, Human
tgggtagaggcccctccctggcatggggctcaagacctgttccatcccacagcctggggcctgtgtgtaaatggccaggacctgcaggctggcatttttctgctccttgcctggcctctggcctcccctttctccacccatgtggcccctcaggctgccatctagtccaaaagtccccaagggagacccagagggccacttggccaaactacttctgctccagaaaactgtagaagaccataattctcttccccagctctcctgctccaggaaggacagccccaaagtgaggcttagccagagcccctcccagacaagcgcccccgcttccccaacctcagcccttcccagttcatcccaaaggccctctggggacccactctctcacccagccccaggaggggaaggagacaggatgaacttttaccccgctgccctcactgccactctgggtgcagtaattcccttgagatcccacaccggcagagggaccggtgggttctgagtggtctggggactccctgtgacagcgtgcatggctcggtattgattgagggatgaatggatgaggagagacaggagaggaggccgatggggaggtctcaggcacagacccttggaggggaagaggatgtgaagaccagcggctggctccccaggcactgccacgaggagggctgatgggaagccctagtggtggggctggggtgtctggtctcaggctgaggggtggctggaaagatacagggccccgaagaggaggaggtgggaagaacccccccagctcacacgcagttcacttattcactcaacaaatcgtgactgcgcagctacagtggctaccaggcgctgggttcaaggcactgcgggtaccagaggtgcggagaagatcgctgatccgggccccagtgctctgggtgtctagcgggggtaagaaggcaataaagaaggcacggagtaactcaaacagcaattccagacagcaagagaaactacaggaaagaaaacaaacgtgcgaggggcgaggcgaggaaacaacctcagcttggcaggtcttggaggtctctgggaggagaaagcagcgtctgatgggggcgggaggtggtgagtggggagaggtccaggcggagggaatggcgagcgcagagacaggctggcaacggcttcagggaggcgcggaggggtcagcgtggctggcttaaaaggatacagggactgaggggcaagaccggctcaagggtcaccgcttccaggaagccttctatttccgcgccacctccgcgctcccccaacttttcccaccgcggtccgcagcccacccgtcctgctcgggccgccttcctggtccggaccgcgagtgccgagagggcagggccggctccgattcctccagccgcatccccgcgacgtcccgccaggctctaggcaccccgtgggcactcagtaaacatttgtcgagcgctctagagggaatgaatgaacccactgggcacagctggggggagggcggggccgagggcaggtgggaggccgccggcgcgggaggggcccctcgaagcccgtcctcctcctcctcctcctccgcccaggccccagcgcgtaccactctggcgctcccgaggcggcctcttgtgcgatccagggcgcacaaggctgggagagcgccccggggcccctgctatccgcgccggaggttggaagagggtgggttgccgccgcccgagggcgagagcgccagaggagcgggaagaaggagcgctcgcccgcccgcctgcctcctcgctgcctccccggcgttggctctctggactcctaggcttgctggctgctcctcccacccgcgcccgcctcctcactcgccttttcgttcgccggggctgctttccaagccctgcggtgcgcccgggcgagtgcggggcgaggggcccggggccagcaccgagcagggggcgggggtccgggcagagcgcggccggccggggaggggccatgtctggcgcgggcgcagcggggcccgtctgcagcaagtgaccgagcggcgcggacggccgcctgccccctctgccacctggggcggtgcgggcccggagcccggagcccgggtagcgcgtagagccggcgcgatgcacgtgcgctcactgcgagctgcggcgccgcacagcttcgtggcgctctgggcacccctgttcctgctgcgctccgccctggccgacttcagcctggacaacgaggtgcactcgagcttcatccaccggcgcctccgcagccaggagcggcgggagatgcagcgcgagatcctctccattttgggcttgccccaccgcccgcgcccgcacctccagggcaagcacaactcggcacccatgttcatgctggacctgtacaacgccatggcggtggaggagggcggcgggcccggcggccagggcttctcctacccctacaaggccgtcttcagtacccagggcccccctctggccagcctgcaagatagccatttcctcaccgacgccgacatggtcatgagcttcgtcaacctcggtgagtaagggcaggcgagggtacgcgtctcctttcgggggcactttgagactgggagggagggagccgcttcttctatgcagcccgcccagctttccgctcctggctgaaatcgcagtgcctgcccgagggtctcccacccacagccctatgactcccaagctgtgtgcgcccccaggtcgggcgcgctgggttcggtgagcctgtaggggttactgggaaggagggatcctccgaagtcccctccatgttacgccgccggccgcatctctggggctggaggcaagggccgttcaaagcgcggggctcggtcatgtgagctgtcccgggccggcgcggctcgcgctacctggatgtaaagggcccttcccggcgaggctgccttgccgcccttcctgggcccctctcagccctgcctggctctggcatcgcggccgtcgcacccccttaccctccctgtcaagccctacctgtcccctcgtggtgcgcccgccttagcgtaccgcgcgctccgagcgccttggggcccctctccgggccgccggatgccccattctctcttggctggagctggggaagaaacggtgccattgctaattttctttgttttctttctttgtttatttttttcttttttctttttttttcttttcttttctttttttttttttttgagacggagtttcactcttgtcgcccagtctggagtgcaatggcgcgatctctgctcaccgcaacctctgcctcccgggttcaagcgattctcgtgcctcagcctcccgagtagctgggattacaggcatgcgccaccatgcctggctaattttgtatttttagtagagacagggtttctccatgttaggcaggctggtctcgaactcccgatctcaggtgatcctcccgcctcagcctcccaaagtggtgctgggattacaggcgtgagccactgtgccctgccgctagtcttctattttaagtatttagtggtaggtcccgggccggcagaatctattttcagcatttaccacgtgtggcgcgcaaaccacaggttttggcgattgggttgcgcgggatctcagagctgacgccgcgggggcggctgggggtcccggtttccgactggagccgcgacgaccccggcgacgcgagcctggggctgcagcgagggccggggagctccccctccatatgtgcgcgcacattctccagacttgctcaaactaaccccccggcagcgccagcgcgctgcgggactgatgatcaaatatttggtttccgagataacacaccccgatagcgctgtttcctgagccgctttcattctacttgtgtaacttgctgcgaaaacccgaaccaagtcaagacagcaaactcacgcccacgggcgctgtgtcaacatggaaataatgatactgaagccccacgctgggcacctggggcgtggactgggggcgcgggggaagcgcagatccgccttcatgcttccccctcctgataaggtccctggagttcccgggaggccattgtctgtacttaataataactaaatccaactagtgaaccaagcttcagcgagcaaggggtgggaggtttagatgccaaaataccttcaaaaaagtttaaattatactaagcagccagttaagaaggaagcagcaacatatgacctgatttagaaccatctccaagatgtatgaggtggaaagaagcaaggtgcagatgagtgggctgcatgtgtgcttgtatatcatcgtgtcctcctggaggaagacaccaggaactggagagagattttactggaggggtagagaggcgggggcatagctggggcttacggagtgggaggtggggtctgatttttcgtcgtctgcacttctgtatttgtgatttttttaaaacaatgtgtatttattaactataccaaaaactaaaggaaaattccaaatacatacatataaataatgaacgcagagctctgtcgccctcctgaagcctggggttagccagggccctttctctggtgggggatttatagcatcttcccttctgttgggtaccccggactcccactgaatgtgcaggtcccagtggctgccttcagagcctggctggaatcattaaaaaggtatttgtaatctctggcttctgcagaaggccctgcaaaccaagagcaaaaaagcccccagtgcttatgggccggcagtgtgggctaggccccggggctccctgtccccaagagaaagaccaggttgctcggagggtgcctctgggaactttggtgcgggctatttgctccccccatggcggcaggagcaagctgggacttgtttgggaaggccacagctgggtggttttcctcctctggctgtacatacacctttcaatccatttctttcatcttgaaaggacaaagaccggcttgtctgagcctcttaatcagtcaggctggctttgggctttgtgggaccctgactttctcaggtctagctttctgggacatcactccaaattagatggcagagtggcttttaacagagcgcactgaccttgttttctttctctctctgtccctaaactcgaggtcattagttaggtgaagacctgggctgcagtttggcgagacacttcctgtagatgcttctaatgttggcctttaatttctgctaagcagcagcacacaaataaatggcctgtcccttctatcctgttgtagcttggaatttctccataggagggacttgggggtggcagtagggttggagagggttggggggaggtgtaggagacttgtctggccactgagtttgctgagaaagtactgctatagtgtttttccttggattgcaaatcatgttgatctgtagtattcgaagttttctaaaggcaagtttattctcacaatttacataagagtgagaaaatatcacttgcacatatcaaactattacttcttattatggtgggagtttggcggggggggcatgggtgaggatcttggcagcctctgctgccccttcgccctgcactgcagagctctgctgtcttgcaggcaggcggcctgcgtgcgcgggaggggggacccttgcctgaattctgaaggcttttgcagacctggtgcatttattcttccttctgtctgccgccaaactggtttttgttcctataagtcgttcttggaattcaagttttttgccaggctgagcgggatctaaactagaggggaaactagaggggaatttacgacaaaaccaggtggtgggaatgaggactaaaggccgcaccttatgacaaagcccagcctgtaccataaagccccaggcaatgtgaactgagctgcctgagtgagactcccatcttcccagcctgggccccttaagttcaatggcaagatttgtaaactggtttggattaacaaccccgactcctctttgtagacttaattttggaattcaaaacagctaccctctcttaaataatccccaggcaatggcgactccgcacactgcatctagccatagcccgttaccattctttctctgggaagatccagcagctctgttaggaatcttgtaaagtagccggctggcactaggggagtggaagtcatcatgtttatctctggtccaggtaatgaaggcatgaaatttgtgtaatctttgaaggaaaagaagagaaagttggaaacctatcattattggagtcagcctataaaagtggcttttgttaatgtagctgaagagtagggagaaggccgtgcagtttgatttttgctttatgccatctggctgtcctttttgttgacaagtgtttggcattaagacctctcccactgcccgtcaagagcaggccctaccactgtagagtattagaaaaagattctgttacagtttaaaaatttccttcagggagtgcttcgcaaaggggagcgtggactgcaggcatttgcagctgtaacctggcttgtgttaaaatttggaaggggctgctccacattccagcactcggagcgccggccctcactggtgagcagccaaaggttaatatagatgtcacacagctccccccttctttctttctgcagagcgcctttgctataggagtgcaccaacagctgtgtttttcgtaaccctttcaaaatcacttcttttaaacctcattttcctgcttatataaatcaaagattttcctccacttttcccaagcatgtatgtgacccagctttgaacttttttcattttctatgtattttccttctggaatcaaggcagggtaaggctgagccctggatgccaacttgggtggctgtttttggttttggttccagggttgtcattcggttgtggagcggtccccatggaaggggtaacagagatggcccacttgcaaatcagtttcagggcagcaagggggatgattgtctgaatgcacagacagacgaaaccgcttttgagatgcagccctctcaagctacggtttggggctttaccatggcgtagtaggctctcaagcctttgccgagataaacacagctggtgcgcgatcccctcaccaccggaatgcctgcgatgtgagtgaatatcacgtgtccgctgaactcagagacaactggtgacttcattccagggagagtcccatctaagttgattgatcactcctatcactttaatatctctccctcatttggtaaggtcatatttggcccattgcaagaatcagcgtgccctaagtctcccccgtctccacccttccccatctgcccatccgtgtaacagcctgaatattttgaatggggagccctttgcaccatgcttctggccacattaattctttcacgctcactcttcagtcttagcgggggggctgttggcacactggtttcttggcaagccactgcaaggcttcgccttaatgcactctggcactgtcaccggggttagggcacaggcagggatgtgtgggacctgtcatgttattgtcagaaggaatgtgcggattagcctttacagcgtagtggtgggagagcactgcagctgtgtacacttattataaaagatttaagtcccactggtaaaatcaatatattgaattgcacaaccctctgcttttaattagtttaaatcaaatgcgccggtgccattttgccttctctcgccttcatggggtgaggaactaccaatatttacatagaaactgttaatttgtggtgaaaatgataacacatttagctttacacactcaaattgctccaacttgatggatcccagatcaacgtggagttgagctgaggagatgacgtcaccaggagcggggaggagacacccgtgatgtctgttgcttggaccctggattccagatgcaggtggacatgtgtgtagaggcagtgactggggatgctggtccttcaagaagcgagctggttctttctattgcaggtcaaaaacaatgagatttacctacatcatctaaaatcctttctcggaagcattcttacaaaattgcgaagtgggcacttgctcttgggtcattttgagcctgttctcacagcatgcaagggtcatgtactgggcagctcaaggcacggtgctttatttattccagagcttcacatgcttttctttccaatccctgaaacagtttatagaggaagggcgtttgttcactgcaaatgatcccatgtacgaccgcggctattagtgagccgtttggtattagctgtgtgttcaagctgggattgaattccgggttttgcagcaaatggcatctgacaaataataattgacaaaaaatgtgacttggtatttcttaatatggaacagatagttcatttaagcttccccggcaaaaaaaaaattgctcaaactcaaactgaaatagcaatgccagggaatactaggactgctgctgtgtatttttttccgctccaaagtagagtgtttatgatttggggggatattagagtgcatgaagtttgacacttacttatgcgaaactcaggcaagcatgtgcaataccgccttttcaacatttgtgtcggaaggcattgtggggagccgcgcaaagcctgtgctgatccgcgtggagtggattgaattaatgacaactccgagagcaccagctttagggtaattgctttattgttttggagccagggtgcatataatccggttcctgtgcaaacatgttgaacgtgtgttaatgcatttccaaaccagagcctctcacacaaccctgcttttcattaattgatgtcggtagcatggtacagtatttcaaagggctggccaagtataaactgtgtttccaatttccttcctttcctgtgtttggaatgccaatgttaatttgttcccatgcaggagcgggggctgccaaccgcggctttctataaagggcttcacagtgaaggcttccagccctcgctgatgcttggggctgcctggccaagtctcctgacactttgcagctaattctgggtgatatatggggtgggggattgggggcttcactgccgtgtaacggaagttctcggtgacagcagtgggtgtgacttggcaagggagattggaacggcatccacagtgattctctttagacacagcctaaacctatgtgtctgtttccactatgacagcacattagctgtgtgaccttgggcaagttacttaacatctctgcatttgtgtcctcattttataaaggctacaagagaatctcttcctcaacagattctaaagaaatagaaatcatatcacccatgcgcagaggctgtcacctagtaggtgtaaaacaaatggtagctcttgtttttattgtgttggccagatgaagatttacgttggtatattagtccaaatttcagtttttaagtacttaatcttaaaatactgagattaaactgcccatgttattttaaatgtcaagaaaatggtccccagagtgtgaatatgtgtgcgcctccctctttcagagatcaatggaatttgaatgaatgcaccaaacttatttgaggatgaatagagtctaaggctgaatcttttccccaattttagcatctatggttatttaatgattttactacttgggaaactggaactcagtgagagggtataccggaactctctgtagtgcctttgcaactttgaattaaaaattaatttcaaaataaaatgtttcatttaaaaaattgcattattgaagtatttcttcccaatcctttctggaagatggtcaaagtacaaattgtcttttccttcaagggagtgacaagcccaaagcattcattaacagaactgcacaacttccccactttttattggagcaggtgcaaggctgcccaaggctcccgcagctggggttaggctgcaacaacaaagccctgtgtggattcagcatgtttagaagcctctagagaccagaggacgaaagagaatggcttcagggccagataccgaggggtggcgtttctcattcaagactttccataaattcccttcagctctttatactgtttgaaaaatccgactcaccaagtattaggtttccctgcatctctgaggtcacgtgttctatcacatctttatctccctggagtagctttcaagtttcaatcttttgttgcctggcttaattaaaattggccacgaataaaaacttgcaccgtttccaaaatcgaggacttgtgtgtttctaagcattgggtttaggcctgccctgtcttgtgcttccagcctgtcttctgctttcatgtagcttggactacatgaagaaaaagaaaaagctaagctcttagcatgacagttggcatataatggtccaagtgctcatccccctggcaacttacacacacaaaggcaggcaagtttttttttttttttttttttggtggcttgtgttttggccttcaataaaggacacttttcctgttttttttcagacagccttattctcctgcccatgcacagccttgcagaattctcatggcatagaaggtgctcagatattggttgtttcggtgcacatatggcatgaagacattctaagcagtctcttctaaatgcttttgatctccaattcccactactaccttttcaggtacataccttaaatagtaataagttgtataactactgcaggatagctaggatagcttgtgcttcataaaacatagacaaaaatagaaatttaagtaggagacactaaagctaaaagcaatacaaaattttggtgtttgttaattaatacaaattttaactaatgaatcattttaattttaattgttaacacaattttaattaacaatatacatttaattaaaattaaattttaatataatttaattaagtttgcagtcatgaaaatttgcggtgcaatggactgttctttggtgttttcaaaatcatgatttaacagtttagaatcactgatctaaaggcctggtcccaaatttcgatgacccttcatctggtcagtataaatgaagttattgtgtgtgaagaaactcacaatcttggtgcgttaaaaatcccagaagtttgtttttcatttgtatcacattatagctctatcgtgggttcagggtggaggcgtggagttctgcacattggtggcagcagagtccctgggagaggctgaggtcctcagaatgttacgaataaggtgccagaaggaaagataatgtgaactgtgcgttggcttttaatatttctacctgggagtgactttctaacttcaaaaatttctatttttgtctgttttatgaagtacaaatgatcctaactagtagttatacaacttatttctttttttcttttttttttgagatggagtttcgcttttgttgcccaggctggagtgcagtggcgcgatcttggctcactgcaacctccgccttctgggttcaagtgattctcctgcctcagcctccgaagttgctaggattataggtgcccaccaccacgcccagctaatttttgttatttttttttattttttatttttagtagaaatggggtttcgccatgttggccaggctggcctcaaactcctgacctcaggttttatccacccgccttggcctcccaaagtgctgggataacaggcgtaagccaccttgcccagccacaacttatttctatttagggtatgtaccccaaaatttactcttccacctgaaagagcttctgctcacatttcatgggccaaagtgagccatgtggccaaacctgacccaaggttggcaaggagatgacgataccactgcttgctcagaaaggcaaagcaccagagagcgtccaggaaatggcacagatgacaccacgctatcatgattgaagtgtctctcacaagattcaaagacagaaatgtgggaagtaagttgtggggtgtgttactgaaaccagagcttcatttttcaaccccacctgtcaattatgcagatatttttgttgaagctagtgaactcccatgattgtcagttggaatttgcataacaattataattgtaatatatcttttcctgactcccagtgggttcctcttgcctcctcccatcttgcgcttcattttggagactgatgttctggaggcttccatctcactgaagtactcaattggttcaacaacaataacatctctttccattcccacttgtaaagtgacttccctgtttatgacttgtctttcagcaaaggcaagcttcagcttttgtccggttcactatctagagaattaagaagcattactctgctcctggctaatgaggtgactgctggtgtttccccggaagatacaggttatcacttcgccatgaaatcttgtccacaatggaagagctgcttgctttctctcctgggccttagagacattcctttttctttctttctttttttttttttttttttttttttgagatggagtctctcgctatcccccaggctggagtgtagtggcatgatctccactcactgcaacctccacctctgggcttcaagcaattctcctgcctcagcctcctgagtagcagggattacaggctcccacaaccacgcccggctaatttttgtatttttagtagagacggtgtttcaccatgttggccaggctggtcttaaacttctgacctcaagtgatccacctgcctcagcctcccaaggtgttaagattacaggcgtgagccactgcaactggccccttagagacatttcttagtccaggcaggatcttgcataggctgaatctagacattaaattcagagaccccttcatcatctaaatgcatcactgaaatggattgtagacctcagagggctaagacctttctgtgtagcagcaatggattcagagtagccatctttatggggccctcatgcagttctctcagtattctgcagggtaagcagtgtcatttccattttagagaggaggatgctgaaggggcccaaacatgcacagctaggaagtgtggggcagatgtgtctgtccagctcttgctgggtgcagagctgcccattctttcctcctgaacctgtggggtatcgaataggtagcggggagcgtggaggagatgatgttgagaccattaaaacagaagccgagcccatggccttgactctgtggtcccgtgttctgataagtgacatagagataagcaggcacacacctttcccttctgttatccaccctgcttgtgatacctcccctctcctcggtctttatggtttaaaaataattgtcagggcatagggccctgagtgcctgtggggggcacctacatgtaccccataacccctccatggggaaattccatagccagccagagattggtattttaatagcaattcctcaagatgctgtataaaaaagaccacagaaacagtttttttccgtatgtcccagcatgcctttgtgtacggtctgtagtattgtaaactccccaaaatcaaaatgtgcatgaacaggggattcgagagagaagcaggtgtagctctgggaggggatatggaatagtcgccccagcgcagggacttctttttgtttttgttttttgtttttttttttttactgtatcaatgtagactggaaacaatgtcagaaggagaaagcaagtagcagaaggatgtttaggatgtaaccatttgttaattacacacataggcacccccgcccccaacctcccacacaaggggaccaactcataaatgtattgtttgtgggttcatacacattgcagtaataccatggacacatgggcaggaaggactccctaccttcagggtgagagctgcccgtggggaggagggaaaggatagttttgatgagagtttcaaataaatctcacctatttctgtcaagttttctgtcttttaataagaagaaaccaaaagaggctgggcgcggtggctcacgcctgtaatcccagcactttgggaggctgaggtgggtgggtcatctgaggtcaggagttcgagaccagcctggccaacatggtgaaaccccgtttctactaaaaatacaaaaattagtggggtgtggtggtacacacctttagtcccagctacttgggaggctgaggcaagagaatcgcttgaacccgggaggcagaggttgcagtaagccgagatcacatcactgcactccagcctgggtgacagagcaactctgtctcaaaaaaaaaaaaaaaaaaaaaaaaggaaagaaaccaaaagaaaatacaatgtggtatcctggactggatcttaggccagaacaaggacatctgtggaaacactggtacagtctgaaacaaatctggagtcgagttgacagttacacagcaatgtgaacgtctcggttttgtcaaatgccctgtggttgtggaagatgttcaccctgggaggactgggtgaagggtactcaagtattctctgtactagctttgcaatgttcttataaagttattctaaaataaaaagtttatttattttttttaaaggaagcaactatgatgctacctctcatcatttctctgttatgggtgcatggatgtccatgagctcatccaccagctgctctttgtggtggtcctgccatttccaaggctgggggcaggagagccagtcctagagcctgttcagtatgatgccctgaaggccaataacgaatcaatctacggacccattaacacgacagggactcagcaagtaaaagaaaaacccacaggacagtgccctgagaactttaaaactctcttttcctcattcataaggtgcccgatataaagcagctgttagtttatggtcaagaaagagggggtagggtgggaggagatctaaaagatctttcgattttcttcttggtcctgaattttgtaaaatgccccctactccattccccaatcttcccacttctcaagtttcagtttttgactgacttgacctaacatttcttgagagagaagcccttaaaaatggcagcagggcctcagaaccttccaggctagtaaatgtttatgggatggaggcactggttggtcatttcctttaggaggaaacaataaatgaagctacttgccttatgcctactcaggccctgagctcctaattatcttaatatactggtgggaagtggggatggaagggggtgggggacccagaaatctctgcgcctctggagcttggaagtgccctttttagtacgtttagtgtgcagtttctcagcctgggcactattggtatgtttaaccagatcgttctctgctgggagctgtcctgtgtattataggatgtttggcagcattcctagcccttcccccaggatctgacaaccaagtgtatctccagacattgctaactgtaccctggggggcaaagttgcccccagttgagaaccactggtttagagtaacttgcctcaaccttgggaattcatctgggagccttagcctcaaacgcactgacccacagtggtgagtgggaaaaacagcatttctagatggacgggttattttctggctgaaagaagcacagattgcaatcaaaactcgaggcttctcctgggaacacagctctacctggctttgaaacaccctggagactgaaatggagctcaagtctctaacgagcaagcattgtctcctgggaaccaaaatacttgactgcaccttttgctcgatgatgctaaaagtttattaaacacacatcgaggactggcccctcttttatttttatcttcggacgttcctcaggaagaatagggcagatctctctcttaccttgttcccctctcttggcaggtaacttactctggggtgggagagggaaggtgagcacagaagctatattttcccgtgtctccctgtagcttaaatgctgcttggagcagggagacctgcttgcttcagaccccagcccgcgggccaactccagcccacaacctgttttagtacagcctgcaggctaagaatggctggtacattttttaaaagtgtgataaatactcgagaagaatcatatttcatgacactaaaatgacatgaaattcaaatttcaaggtctgtaaataaagttttattggaacacatctatccacttacgcattcactctgactgctttactgccgctgcgacagggttgagcagttgccacagacacgatggtgaccgaggcctacaatagtttctgtctggctcttcatggggtttattgatccctgctttccacacgctatgtcccctacctgggaaagtgcaaaaagtaaaaaagcctgagttttgttttgttttgctttgtttttttgagacagagccttgctctgtcacccaggctggagtgcggtggcgcgatcccggctcactgcaacctctgcctcccgggttcaagcaattctcctgcctcagcctcccgagtagctgggattacaggcgtgcatcaccacgcccagataatttttgtatttttagtggagacagggtttcaacatgttggccaggctggactcaaagtcctgacctcaagggatctgcctgcctcggcctcccaaagtactgggattacaggcgtgagccactgtgcccggccaaaagcctgagttttttatctgtcccttttgtccttctgcagacagtgactcagccacacttcctgccccccctccatgttcactggagctcctctgagtctgcgaaagctgtaggttaaaggatgtcccctcggaagactcctctgcatctttaacatgaggcatgtgctctgagtccccacaagggtgatgtcgaacacagggaggcttttcctgcgtttgcttggtcccagcaccctgttctcctgtgtttttgaaaaaattctaaaatgtctcagatggtagttaagagtttgggtctgagtcagaccgtcagactgcagagcccccaccgctctgcccccacctccccgactcaggcaggttgttaaaccctgggtctcctgtttcctactctggggttaatgtgggtgcctgtctcctgggctgctgtgaagatcccatgtggggagacaggaagagggctgacctcgggccgcctgcagctggtgcctggggatgtcagtggtaggcagtgatgctgtcatttgctacaccatagccaatcaggaacccaccgtgcacgggacctgcctgtgccctgagctcagctgctctgttacccaccgtggtgggatgtgctgctggtttgtgctggggtccagagcaggcagtgggcacggtggcccccaagccgtgtctccacaggacttggatcagggcagctggccttctctttgcgatgatacctcagctgaaatgggaggcttgtcggtgtcgactggacacaggcaaaacaggaaactgggtgtattttgacgaatcctgttatactagaaaattgcctcctgctgattaagatctgtgtttattggtgcagagttttaaggagacacccagatctgcccacccttgccggctgggggcacaggcaacctgctgggtttagacagttgactgtgggctggcctactccaaaaaaagcacatcaataaaactttcacagtaaagttatatatttttcttttatttctttgaacaccattcatgtcagacttagtggggtggcatttctgtgtttccctcactttttgatatgggcaaatgaatttctcctttttttttttttttttgagtcagagtcagggtgacaggttctgtcatccaggctggagtgtagtggtaccatcttggctcactgcagcctctaccacctgggctcaagtgaccctcccacctcagcctcctgagcagctggaactacaggcatgtatcaccatgcctggctaattttttgtgtgtgtatatatatctatatttaatatagatatatattatatattatataaatatatttatattaaaataatatatttaataaaaatatactctatatatatttttgtagaaattgggtttcaccatgttgcctagactggtcttgaactcctgggctcaagcagtcctcctgcctcagcctcccaaagtgctgggattataggtgtgagttactgcacctggcccatttcttcattttaagtgaggaccagcccatgccagatgttcattaaatagcatgatttcaacatttatttttatgtatgtgaaaatagggtcaggaatgacaaattactcgccgagctttggggatggcaagtctgtctgtctttgggtccaggtcactggtgtgtgtcctcaggcaagttactgaaggggttggagtgctctgggcctcagtttccctctctggtgggtggctcaaggctcaggacactaggattgagtgagatcatggcaggaaggggctcagtcctcacctgcagggaactctcagtaaacagggctgctcctggctgccttgggggtccagtctcgctgcagagcctcttctaggctcatccgtgaacatgacagtagaccaatatcaatggagaacatgacaatggcctgatgatgttttagttcagcagctgtaattcattggagatgcctggaagtttgtgactaaatacagccctcatatccaagactatacacttccctgagtaccttcacatttcaaacattatatgtatcttatttactcaactcccatcatagattttgaaaagaatccgggacatttgaaaaagtgcgatgcagtcacccctgcatcaggggtaggctaaagacagcaggtaggacagacattgggtagagtgggaattacctttgaatttccatgggaagctgtttcgttatgcagtatctccatatggctgagttccttctcccagtttctctcccagtgttgcagcagatcactgcttcttccgttgcacatgggatgaaataatctgcttgagtgtaggacctgtatcataccaaaacacttgccttcaaacactagaaggtaagaagtttggtatgatacaggtcctacacttaaggaccctctgggtgttatacttacacttaaggacctataacaccctctgggacagcagatactataagagatacacatcctaatggccactacctgcttctgtggagaggaatggtgtttcatttagaactcgttcagcagtcagccgggcgtggtggctcatgcctgtaatcctagcactttgggaggccgaggcgggcagatcatgacatcaggagatcaagaccatgctagctaacacggtgaaacatcgtctctactaaaaatacaaaaaaaaattagctgggcgtggtggtgggcacctgtagtcccagctactcaggaggctgaggcaggagaatggcgtgaacccaggaggcggagcttgcagtgagccgagatcacaccactgcactccagcctgggggacagagtgagactctgtctcaaaaaaaacaaaacaaaacaaaacaaaacaaaaacaaaaaactcattcagctgcagttcacagaacacctgcctagcatggcttcagcacaaaaacatgtcattatctcctctaatagcaagtcttcagggagatgagttcacgtttgcaggggcagctcagtgatactgtccaagcatccatgagcttcccacctccccctaccaccatcctcaaattcctcatgtctcttacctcatgcttacaaaatggctgctgccgccccagccagttcatcctcatgcaatctcacattcaaggcaggaggatggggaatggcacaaagagctctccttgcctgcctgcctacctcttggtttcctagaagttccttggaagacttctccttgtctcttgggctaaactgtgtgtaagcccctgtcttgttacttcgagggagggtgtgaatgtatgcagctggcatctggccagcacagtgggaggcaggggagggaaaagtgggttggcagtggttgttgggtggccacattcaaatgattgaaatggtttctctctccctctttgtcgttgtttcctgtgttgtatacagttagatttacaaaagttatttgtacatgtgatgtggttccactgtatgcacatataaatagaggccctaagcaagcttccaaagcctccagatgatagtgttccactgtgaatatatacagaaggttggttgcacattgacattaatttaaccagaccctctgtagctcatagaaagattttagttattctttaaactcaaacctacctacaggtaggtacattagctctaactttgaggactatatagaactctagccaacagccagttgtttgctgaaaacaagctttgttttattaacataaccctcctgatctcctgagataggggcaaaatttcttgaaaatgacccgaggaggtcaggaattattgtcccctgggaggaagcagaggctggggtggagcttggtttgagttctgcttgtgggacaggcggctcctgtttcccctgagtggaggatgaacagagcaagagactcaaagcattttaagaatctgtgtcagtgtttgttagccaagggtggagagctgcttgaaagaaacgcctgcctgccctggtggaatggtggaacctcatgcttacactgggagcctgatcaaatgttttctagtaaagggttctgggcacctatatgccttctgcttattcccgtgggagactaacgtgatagggtctgggtgcctccttaagcccgttggttggaggagatgattaggggagaagctgagaggtggttctgaaaaatattttgctttctattaaatggctgctgagcaaacggaactctctgttctcgtccccattgtcttgccttgaatgtggttttgtgaagacatgttgcttggaaccacagcagccatcttgtgactgtgggacaagaggcctaagaattaagtcaacatgcagacaatgatggagcaaagaagacagaagaaattggggttcttagtcatatgtttgaactactacattcaactacaattgttggggggaggctcttaagcagtttgaatcacatgttcactcatgaatcagttgggtctagagggtagaccaggctgcatcaacacagttgctggagtcagcctctggccctttgtgcctgggctggggtgtggaggtgtgtctactatctgattacagctatgttagccattgtaataatcatcccagtagtgaacatttgtcaaaggcttactatgtgccaagcaccctttgtcctcttttggtttttttttgagatggagtctcgctctgtcacccaggctggaatgcagtggtacaatcttggctcactgcaacttctgccttctgggttcaagtgattctcctgcctcagcctcctgagtagctgggagtacaggcacgtgccaccatgcccggctaatttttgtacttttagtagggatggagtttcaccgtgttgaccaggctggtcttgaactcccaacctcaggtgatccgcccacctcggcctcccaaagtgctgggattacaggcatgagccaccgcacccagcctgtcctctttagttaatattaacatatttaattttcatgacagccatttcaggtggggcagttattatcacccctattttacagagcagataaatgagcagagagcggtagttggcccaagaccacatacccagttaagcatcattggatttggagatccagttcctggagacttccctcttacacttgatcctgaactgcttctcaagcctgaaggataggtttggagcaggccagtcaacagcattgctaattggagagtctcacatgagggcaggaggaagacacataggggttttacagttatgtgtgtcaggcctaatgccctgtatctttgcttatcaaagtttctgaaaaccaggatgtatttaaattgattaagatattggtatattttcccaaagagcttctgttgaattgattgtgcctcttagtatggtgacaagcgtgtgttgagtagacctggcaatgggtaaagctaacaacacttattatgaataaaactgctaattgagttttaatgaaactgcttattgaggtgtaacgtgtgcagaacagcacagaaatcaagagcacttgtgagtgtttacaaggcaatcacacagggtaaccagtgtgtagatcaagaagcagaagcgaccagaaccccctcgtacttgtacccagcggtaactattgtcctgttttctaatagcataaattaaccttgcctgtttctaaactttatataaatttaattgtacaataatactgttaaatcactaaccatggccgggcatgctggctgacgcctgtaatcccagcactttgggaggctgaggcgggcagatcatgaggtcaggagatcgagaccatcctggctaacacggtgaaaccccatctccactaaaaatacaaaaaatcagctgggcgtggtggcgggcgcctgtaatcgcagatactcgggaggctgaggcaggagaatggcgtgaacccaggaggcggaggttgcagtgaaccgagatcacgccactgcactccagcctgggtgacagagcaagactctgtctcaaaaaaaaaaaaaaaaaaaaatcactaatcacaggagcaatgatttggaaagaagaccccaagtagaactttttggagtctgtttgcaactcttccagttacatttcatataggatacaaaatgtaatttaaaaaccattctctgggccccgtagggtgcctcatgcctgtaattccagcactttgggaggctgaggcaggaggatcacttgagctcaggagtccaaggcttcagtgagctgtaattacatcactgcactccagttgggagtgacagagtgagaccctatctctataaaaaataaaaattaaaaaaaaacaccacttttttgttttgatctcatattctcctgcttcccacaccggaaagaggtttaaaggacaaccatgcaatttgaagggtgttttgatcgtttagcttagggatttaagtttgagttcttacaatgtgaacttgaaatgagtgaggctcttcaagatttccagttcccaccaaatctgccccatcagcccctggggcggcttttgtacgtctctgcaccttcctgttttcagaaatgaagctgattactgtggtccagggacagagtgtggctttaaagaagactcttattttgaaagggagacaggggctgggcatggaggaaaggcagaaccatcttttccttcactgcacctgcatctcctgggcctaatgagtttaggctgatggaacccaggcctcaggaaggattataaattctcatttgatttgatttgcctctaaaataccttaaaccagctgtgtctgcccagctgacccaagcctctctggctgctctggggggaaggtctgagcaggctcctcctgtcctggggaagggagggaggacggcagcttcacttcccccacctggctgctcttggggcctgctctggcctggctgggagcaggcaaggcacaggtctctgctgccctccctggtggccagcctccatgtccttgaattctcccaacagccccagaactgggggcctctgcctgtccccattttatagagagaaaaagttgagccttccagaggtgggttaacttgtcctgggtcactgctggtgattggcagagcctgcgtgtgaaccagacctccaggccccatggcccacgctcaaccccagttctctcctgcatcctgggctgagtaaggctaaggagccggtgtcttcctcctgatttgctcacggggagagtttcaaaacccacttcactaagtctccggagaagctgctgagtgcccagcaagtgagcgtgggaggtggtgtgtgaacagtgctaagcaacagagcaatcagagcgaatagcttccaagactattacatgtgccaggcactccatggacactctcctttcctctggttctcaaagtggggtttctagacctgcattatcaccatcacctgggcatgtgttagacattcatgctcttgggcccaccctagatcacccaccttagacatgctggaagtggggcccagtggcctgtgctgtaataagctcgcgtgtgactctgggcatcctgaaggtggagcatgcctggtctactttactcctgggctttaactggcagcccagtggagtcagtgctattactacacctgcatttcacagaagaggagtgacgcgccccagcaagtggcagagccgagactcgccctctcgcccggctctgctctggaaacctcctgagtcctgctcctttgctcagttcttactttcctggagttaaaatctagaagagaggacagtggagaaacaggtcagcaggtctctcaccaaaataatcccagtagttaggctatgggagggaaatgaaaggggctgagagggaaggaggcccagggagagtgtcagtgggggtgagaccaactcagccgtggggaggggctgcggtgcccgggcaggcctggagcaaagcctctgcggtcgtgaacttggcacgtctaacaattaccagcaggataccactcgccaggtgcttggtggggagtgtttgctccctaggtgaccccatgagcagagtgaggatccttgtacctgttcaacagcccccatcccaggcctcaaacccgtaagtcaggagttaaattcctgaatttctcacactgggaacgccatttcattaatttttttaattattttttttttagggcagagtcttgctgtgtcacccaggagtgcagtggtacgatctcagctcactgcaacctctgcctcctgggttcaagcgattcttgtgcctcagcctcctgagtagctgggagaacaggaatgcaccaccacgcctagctaatttttgtatttttagtagagacagggttttggcatattagccaggctggtctcccggactcaagtgatacacctgcctcgacctcccaaagtgctgggattatgggcgtgagccaccaatcccacagttttaaagaaaaactttctcctacatctctgagaacatagtcggggaccctcatttgcagtggccccctgcaaacccttggtgctacaaagcagtgtgggcgacagcacctcttcaatgatggggacacctgtgatctgggctgtccactaggaaggccatgagccacatacagctgtttagattttattttattttttgagatggaatttttgctctgttgcccaggctggagagcagtggcaccatcttggctcactgcaacctccgcctcctgggttcaagtgattcttgtgcctcagcctcccgagtatctgggattacaggcacgtgccaccatgcctggctaatttttgtatttttagtagagacgatgtttcagcatattggccaggctggtctcaaactcctgacctcaagtgatccacccaccttgccctcccaaagtgctgggattacaggcatgagccactgtgcctggcagctgtttacatttaaattaattacaatgaaatacaattaaacattcagatctcagtcacggaagccacatttcaagtgctcagtagccccacgtgtctcagtgtgctttaccagacagcacagatagagcctccaagctgccccgaggtgttagggtgaaccccatacaggtcaaaactggtagagtatcagcagctttttacatggtacagtctaataggcgagaaaagggacttcagagaaattcagtcctttcctttgttatgggaggaaactgaggcccagtgagcctggggttataccagccagctcacagctcagatgaggccaaaccccaggtttcttgaccctcttgagctctgcctgtctgtcggtccagatcaaggactctcaactcagcactagtcacatttggggttggatgggggaccatcctgagcattgtgaaatgtttagcggtgtccctggtctgtacccagtacatgccaggagcaccccctcctaagttatgacaaccaaaaatgactccagacaatgcccagggtgccttcatgggagtgaggggaggacaaagtcagctctggctgagaatcactggttcttttccctcaatttcaatgagctgaggatggggttggaacccagacatccctggagactgcgttcctccctctgggaggtgggaagccgtaggccagggggctgtctgggtctatagtagaaagagcaacatgtgcttgcggcccatttttcttttcagctctacgggcatctgggtctttttaggcaaagaactggcctcagctctagagataattaaacccatcttttttccctctccctgccccatcccctaaaccctttggttcattcaattcacaatgataacattgttcaagcaacactgcacacatgttgacattgaagtgtttaatcttgtggtacaatcattccctctggcccctaccccaacatctgtgcaggctgcaggctcagggctcatgacaagaggatggccaaggagatgcctgcctgtggtctcgcctccaggtctcatgtctctggacgcagccccccagcacctaacaaggaggcagtgtctccaaagaccctcttggagagccaggcgggtaggactccaggtggtattgctggcagctgaagcatttggtggaaagttcgagagttgaagcagttcaggaacaggggagacaatgctgcctgtgtgccctttgccaggcagggccctgccccccaatctgggggcctggggaggggtaatgaggagatgggtgaatgctacaaaaccttcaggctgtcagcctccctccctcaaggactggcattaggcaggagcaaaatttacaagtctgagagggagctgagtcggatgcagaaccttcactttgagtttagctttggagatttatgtggcgagtgcatcgagtgtgccaagagcagagcatggttcagctcagagctgtccttattgaatcgttgccacagctaagaggtcactggcagctcccatgtgaggaagagagttggtatggctgagtggggaagagtacgggcctttaaagattcagatcagctgtgtgaccctgggcaagagtcagtctgagcctcagtgtcctcatctggaaagtgagcacgatgtgtccccctgcctctgagaggggttttcataaggattcagtgagatgatatatacatgtgaagtggcagccaggccagtgggagggcttctaaaatgctggctgcccacctcacagccatcaggatggtcactgatatggtttggctgtgtccctaccaaatctcaacttgaattgtatctcccagaattcccacgtgttgtgggaggcacccagggggaggtaattgaatcatggagtccagtctttcccatgctgttttggtgataatgactaattctcacaagatctgatggtttgatcaggggtttccacttttgcatcttcctcattttctcttgctgctgtcatgtaagaagtgcctttcacctcttgccatgattctgaggcctctccagccatgtggaactgtaagtccaattaaacctttttcttcccagtctcgggtatgtctttttcagcagcatgaaaatggactaatacattaattggtaccagtaaagtggggcattgctgagaaaatacccaaaaatgtggaagtgactttggaactggctaacaggtagagattggaacagtttggaagactcagaagaagataggaaaatgtggaaaagtttggaattgcccagagacttgttgaatggctttgcccaaaacgctgatagtgatatggacaataaaatccaggctgaagtggtctcagatagagataaggaacttgttgggaactggagcaaaggtgactcttgttatgttttagcaaagagcctgacggcattttttccccaccctagagatttgtggaactttgaatttgagagagctgatttagggtatctggtggaagaaatttctaagcagcaaagcattcaagaggtgccttgggtgtgttaaaggcattcacttttaaaagggaaacaaagcataaaagttcagaaaatttgcagcctggctatgcgatagaaaagaagaatccattttctggggagaaattcaagctggctacagaaatttgcataagtagcaagaagcctaatgttaatcctcaagaccatggggagaatgtctccaggccatgtcagagaccttcatggcagcccctcccatcacaggcctggaggcccaggaggaaaaagtggtttcatgggccagtctctgggtccccctgctgtgtgcaccctagggacttggtggcctgtgtcccagccactcaagccatggctgaaaggggtcaatgtacagcttgggctgtgatttcagagggtagaagccccaagccttggcagcttccatgtggtgttgagcctgtgggtgcacagaagtcaagaattgaggtttgggaatctgcacctagatttcagaaaatgtatggaaatgcctggatgcccaggcaaaagtttgctgcaggagtgggtccctcatggagaacctccgctagggcagtggggaagggaaatgtggaattgggactcccacacagagtccctagtggggtgcagcatagtggagctgtgagaagagggccactgtcctccagaccccagaatggtagatccaacagcttgaaccgtgtgcctggaaaagccatggtcactcaacgttcaatgccagcccatgaaagcagctgggagggaggccgtaccctgcaaagccacaggggtggagctgcctaagaccatgggaagccacctcttgcatcagtgtggcctggatgtgagacctggagtcaaaggagatcattttggagctttaaagtttgagagccctgctgaatttcgaacttgcatgggccctgtaacccctttattttggccaatttctcccatttggaatggccgtatttacctgatacctgtacctccattgtatctaggaagtaactagcttgcttttggttttagaggctcataggcagaagggacttgctttgtctcagatgagactttggactgtggacttttgagttaatgctgaaatgagttaagaatttgggggactattgggaaggcataggtggctttgaaatgtgaggatatgagatttggaggggccaggggtgaaatgggtttggctgtgtccccaccaaatctcaacttgaattgtatctcccagaatgcccatgtgttgtgggagggactcgggggaggtaattgaatcatgggggtaggtctttcctgtgctattctcatgatagtgaatctcacaagatctgatgggtttatcaggggtttcagctttgcttcttccccattttctcttgctgctgccatgtaagaagtgccttttgcctcccgccatgattctgaggcctccccagccatgtggagctgcaagtccaatttaacctctttttttttttcctggtctcgggtatgtctttgtcagcagcatgaaaacagactaatacagtcaccatcaaacaaaacaaaacagaacagaaaatcacaatggtggtggacatgtggagaaattggaacccttcccgactgccggcgggaaggtaaaatgctgtagccactatggaaaacagaatggtgcttcctcaaaaatattgaaaatagagctacaatgtgacacagcgatttcatttctgggtatgtccctgaaagatttgaaagcaggatctccaagagatatttgcacacccatagtcacagcagcattactcgcaatcacaaaaatgtggaagctgcataccattcagggatgaataaacaaaatgtggcccatccatacagtggaatattattcagccttaaaaaggaaggacattctgacaggctacagcacggatgaaacttgaagacattttgttaagtgaaataagccggtcacaaaaggacaaatactgtgtgattccatttataggtgttgcccaaagcagtcagattcatagagacagaaagtagaagggtgggtgcctggagctggaggagggaggaagaaaggggagttagtgtttaatggggacagagttttggcgttgcaagatgaaaaaagtcctggagactggatgtgcaagaatggtatcccgtgtgtttaaaatgactgaactgtacacgtaaaagtggttaggatgttaaattgtatattctgtgtattttaccacaattaaaaataaaagttttaaaaaatggtggctgtttacctggcttaggtgttccataggttgtcagggctgcaatctaagtgagcttctatgaactactcttctacagtacaactgacggctctcacgtccatgctggggcagccagaaagtccttgttgaatgagtacagtggaggtgttatctgaacaatgtgtatcattgtcaacttctaggcgatgttctgtttctctgggcatagagcattctcctcccttctcccaagagctgtgtgtgtcagtgtggcctctccaggctgctcatgttattaagagaacattttcctgttagagtagtcaggtatgtctgttccactttccagaattcccaatttattgcatgcctctggcggctttttcaagctccttaatcttgccatgtaaatctttgaatgaatgaatgaagagccatcatcaaatttcacatccctgaaactgtgggtcgtaaactgcctcctaacagcagccgggataagtcagctccagtgagttctggtgtgtgccagaaccttccagatgagctgtagccctccagggaaagagcgagccagggttggtagtttcagagttaaatgggtaccggggacgttccgggatatggggccctgagcagtcctcgggtctgtgaaaacccagttctgacttctggttataatgtggacttcgattagttcttttagccccttgagcctcatcctcattaaagtggggtgtgggggtctgtccccggcccctaactggagctgaagaatgctttggactagtctgtgctcacagaaaccagactctgagtgaggaacatggaattctaatgctggacttgtggtttttgcctggaaagcatccctttgctcataaaatatttgttcctgcctcatagtttagcggcatctttgggggcagtgagagggccgcatagtctggaaggttaaccaaattttttctgaagaccataaagttttggaaggagctgctgggtgattatttactatccatttatcaactctttccagccctggctgggagaacggcttcaggaggaaatgaaggcggctttgcctgggctgacggttccccttttcatggatacaaatatctttcatgtgcaactggccacagtcttgctcgtcaggtgttttttttttttttatgcatggctgtccccatgagagctgcttcctgaggtctctgagcaaccagtgaccaaatccagtgaatggtccctggaagaggggtctccctgccccctttctctgaatctggccactgttgcgccatcttgccctgccagtcctctggtccttcccttcctttggaccaagtccttctggtggcatcgttctccccctcccaggtagccccaaatattgatccaaggccatgctagtctttctcatcataaatgcatttttcgtgcataactttatccataaacccaattcaacagctcccagcttgagcattcttgccagggttatctaaacctctttttccaactgtccagttgaacattctgcaggtcatctcaagtttcacctgtctgcagccacacgtgtttcttccctaccacttcacctcctgagcgctctctcctgtgttgatatctactgatggtgttatcgccctcctggcattccaggccggcagtgggcagcatcctctagttccccctcttcatatgcttgcttttaatcaattgtcttgttccttcccctagagaagcacttctggtccattacacttctggggtcctgacaagagatggaaaatgctgacatcttttctcttgagccagtcaagattgatagtggctgcctgggtgccagaattaagaaaggagtgttgccattgtttagtgatgcctacctcgggtgccaggagggaggaggagggtgcatgtactgggtatgcatcatctctgatcagagcctcctctgagctccctgcctctgtcctcactccctgcctctgtcctcactccctgcctctgtcctcactccctataatccactttccacagggtcaccagtcctctatctaaaatagatctggtcagggcactgctttgtgtctaacaagggaccaagccatcatggttgatgacatcaatgatcaaccccttagcttgacattcaagcattttcccaatgaggaatttgttgcttttttcttgtcgttctcagcaaacttcttacctaaactccccagcatgccctgtttcttgtctgtcgagccctcgatcatgctgttgcctctgcctacagtgcccttccttgtcctctgggactagtgggcctccgttcttccttaagagtccattcagcacctctcctggaagaaccctcacctgcagagctgcctcgtacctgaacgcaggcactgggatttgccaaagtcaacaaaaatgaatgatctctttagggactgtgtctcctttggcctcataccctgtttccccaaaattgttgacatggaaacagtcagatgtggaactaaagttgaacgtgcctaccctctgacccagaaatcctgcttcaagacatttacccagtggacacgtgttcaccaaaagccatgcacaagagtatgcattgcagcacagcttgtctcaaactgtaaactctccaatggctcaaactggaaactccccaaatgactataaaaaaatgagttgtgtcctattcatacgatagggttctagacagcagtgggaatgcatggaccactggtacacagaaccacatgagtgaggctgtggaaggctgcagacacagaagagaacacatctgtgattccatagtcaggtctcatggaggcagagccagtccgtggtattgggtgttaggaaggcagtcagccttaggggaggagggactggtgtttgggagggacccctgtcgggacgacttcggagctggtaataaatgttttgtgtcctgccctaggtgcattcacgttgtggaaattcatcacacttcgtgaatgcttgtctgtgtgccttactgtgtgtacgttatcaacaaagtagtttacttaaactagaaaggaattgcgtgaagagtaatgtgttcaatgcagaagatttatgaggccctgctaagcatcaggctgtggagggcatgcgatccagagctgagacagtcatgggccctgttcttacagagctcagtcaagggggatgccttacatttgggaatgatccaagtctgaagaaagcggttttcatggtgaatggtcatctggagagaacacagctacctgggagtgtttcctgcccatccatttccacttctgggtgtgtatacaattgggcttgtgtgtgttttgctcagaactgccttggttgcagtcaggcagcagtctgactagagttagcttaaaggggacttctttgaagcatctcaacgtaactcatagattggaagagctgaaaccccaaacttcaggaagggcagggactaccagaccaggggatcaacccagcaggtctctctcctcaattccaacctcagtcctccgtgcttggaagcttctttctcacagaccagccttccctgcaaggtgctggcaaggggcttcccagagcactggattacatccttagagatcaaggcggggagagcgaacaggggctctttcataccaggttccaataaaaataaaagaaggcctatgtgtggccaaggttaaggctggcttcctcccatccctcaactggggagaagagggtcatggaacaagatggtggctcccttggagtcccatggctcaactgggacagtgatgatggactctccaagagagacagatacacgagggatgggagtgggggtggggggacatgggcaaggctccttaacagttgtgcattgtaatgagccatgccccaactttgctcatcctgatgagctatgcccagcacaaaatcatccctcaggaagcaggagaaatatatcttctgtatctgttttctcgtgtttgtaacaatgtattgtgttcgtttagttttgtgcattatgatgtacgactgtacatatgcatatatttgggttcatacccctaatttttagggtgttaaatactgtcccacggctctgaatactgcaggttctgtttaagcaccagctgccctttgcaagtctacagagtgggttgccaatttctttggttgtggccctccctttgtatcagacaactataacttagtgaggggtttgcctgagtatgtctcataactgtaggtgggaggaagaaccccagatgttagggagaggcaaggtactcctgagtgatgccgggggcaggtgtgactcccatctgggacagaagtcttccctggcatggcagaggatcatgaagggggggcgcccaggtgggcagcttcttgttcctacctggcctctaacccattattgacaccttccagcccagaatttcccctcttagggctggttttggggctatttcgggtttttgtaaaaggaagacactggacttgtctttgggacagtgatgggtctgcttgctgtcaggatggtgttttctggaatccattttctttggacttatcttttggtcttggggatttaggcccttttaattttttgaagatgaaagtcctttgttaatgcctgtaagctctctcagcccttggggtgctgggatgtaactggaggtagagggaggaaaagctggaatcctaggctctgggcttccttaggaagcttttctctgtgggcatggggagatgtcaactctagacatttagtttaaaactcaagtcttgggtaatcaactatatacagtaactttagaagaaagtataaagacatattttcacctgaaaaatacatgcaagcttctacctcttgtagtggtaacaattcaattatcttgatacttgagttgaaatggtgtagatttcacactgtggagtggcttccatagaaaagggaaaccttggaaagatgagatttggaagttggtttggactttgaattatccactgcttatttgtgtgtgtgtgtgtgtgtgtgtgtgtgtgtgtgtgtgtgtgtacttcatgactgttctttctttgataatggatacaaaattattttcagaacatgtgacaatgtgggtttcagggagaatagagtaacattgtcgttcctgcttctcatagtctccaactaattaatgaaggaaatcctctcagaaagccataccaaagagcccacaaatgtttgcaagaaatttagttcctcactttatccctgagtttctttttagaaaagaaccttgtaactctgataccttaacagttaagatacagttcatcttctatattaaaaacagttgtacctgcagctgttgtaacaaaccttgtgtttgtgattatgtgtcagtgttttctttcttcattgggcatgactctaatgattgtacctgtgtttatgtcatgcttattcaaacgtatctttattgttcggtctattgcactttttttttcaaatgtaatcataagtgcactgtgtaaatgcccacagcacatgttgcttcttctgcattgattgtcattcttctggctcattgttttagaggccctgtaacaatggcagactcaaatggctcacctgtggctttctcctgtcagcaaatggcttctgtaatcttcccaacaactccatgagaaagggccattgttactatctccagggggaggggaacacacagggattaagtagattggggaaggtcacacagctggtaagtggcacagccaagatcaaactcaggccacctggctctagagagtgtgaaggtcaagagggtgagctttggagttcagccgctcacctgatttgtgacctttgaaagttacccggcctccctgagcctcagtgtcctcatctgtaaaatggggatcagtcctgtctcatggggttccatcagatgatggcaaagagtgcttgctcagtgcaggactcacagagttagcactcagcaaacatgtgctttgtacttccgggctcttcagccatccttagttgtacatcctcagatgttccccagcccctttctctgctcaggctgattgcgtatctgccagtggggctgctctgaagctgggttcatccagcactgggagcagggaactgaggtttgcggggagccactgtgttcaaggcattggactttgcacctgtgcatgattgtgggagcaaccctctctgctgaaagttgaatcatggcacgactcaagggctcttcctggtctttggaggtctggctgtgctgcagtggagaacagagatggttggaacaggacttcatctgtgcttcaccgctcctggtcccctggagaaaagcactcgagaagccatgagttgtcccaagactgtgccacctccttcagggggcagacctggtctcttccacctctctcctagcatactcatgaaaacctctcagatgcaatgctttgggagaacagcttccagggtgattaaagctgcaatgcacaatgccacttctaggcatgaaacacgtgtcctgtgatgttcatagcagcactgctttcagagccccaatctggaaactccctgaacgcctatgaactgtagaatggatacatggattgtggtctaatacaacgatggactatcatatgacaatgaggatgaatgaacatgcacggtgacgtggatgaattacacaagcactgtgaaatggaagaagccagatacaaaagatgatatagtgtatgaggccctgcagcgactgttcaaaaacaggcgaagctaacctatagtttgagaagtccagggtgggaaagggggttggtaatgttctgtctcttgacctggaggaatctccgtgactgggtttactttggtttacacacacgctacacgtatacaacagtgcagttaaaaagttctggcaaacggccaggcgtggtggctcacgcctgtaatcccagcactttgtgaggccgaggcaggtggatcacgaggtcaggagattgagaccatcctggctaacatggtgaaaatcccatctctactaaaaatacaaaaaattagccgagcatggtgacgggagcctgtagtcccagccacttgggaggctgaggcaggagaatggtgtgggcctgggaggcggagcttgtagtaagccgagatcgcgccactgcactccagcctgggtgacagagcgagactctgtctcaaaaaaaaaaaaaagttctacaaacaagcagaggaacggcccttgttgagctcttcagctgttcacgcagccacagagatgcatggtggttcaggcctctggtttgggcaggacctgggcttgaatcccaggtctttggccctggggaggtcactggacacctcctgggtctcaggtgcatgcctcacctacctatgcgggattgtactcacttcctcgggctgctcaccttttggggctggcatgagggttgactgagctggaaaggtgacagaggactggccgggggcagtcccacggtgacacagtcaggccctttgccccgccttcccacctggggtcacctcccgaggctcacttggttcccaagtggctgccctttacggagactcctaccttctctgtaaatcaaagcagattggtgacatccccatggccttctctcccattcatctggcctgtcccatagattgggtcaggagagaagggttccttgtgggcgtgaggggcgtgttgtgacaagcagagctgtcatctggaaggaccccggaacggtttctggagagtccttccctcccgccagctctccatatatggcccaggattctagcagctgtggttcaaaggtcatcttcccgaggtctctccaaagacagggatgctcctgtgcccagccagagaccccagcctcagggacttcatctgccccttcttcctgagagggaacagcctgagcgggtaattcccccatgcttcctgccctcaccctgctctctttttggactgttgttaaggtttaaaccagattgtttttaatggagctgcgcagccagggtcttggggctgccagtgctgtgaacttcttcctcaatggtgttcccgtcctgctgtcccacttggaaccgggcagccataacccagcctgagagctgaagattgctgatcgtatttctcctttcttctgaccaatctgctggccaaactggttctgctctttctccctctctctccagttccccacccccagacaggaagtggagatgggcttgtattttcctgcagatgaaaggtgtctggaggttcttctcactggcctgagtgtggtcattctgccccttccagcactctgtggctcccattgtcattcctgctccatgttggtccagagggggcatgatccacaggagccacaggtccccacccagaaacaccattcctgggctttcatcttggtgcttatcatctatgaaatggacatgacatcttagtctaataccgctgccaggagaagggagaaaggtggaggccttttgccttattttgtcctgagtcacgttcaacctccaccccaactctgccattcactccttttagtgctgttagtctactgctgtgactgtaaaccttggcacctcattagaaatatctgggggtgctttaaagagatatggattcccttggttcaggagggggtcggagtagctgtgtgctggagcctactgtgtgcttctcttcccatgtccagcagcctcacgttggtagcttgaaatctgccaagatggcagtatttacacggtgtagtcagcaggcgcttcagatcaggtccctgagagccaattgttaaatgtttaccatcccagacttgggccaggacatcagtattttctaaaagtttccacagtgattttcatgtgcattcagggctgagaacccctggtcctagagatgtctcatactaggcacagtaaggtttatgcttaccaacaatagctaacagttatccaaccctagcagatgttaaactatttgtgtgaatgagatcattcaaccctgaccataacccatgaaggaggattacaatccccattttttagatgatgaaattgggttccatagaggttttctgttaccttatctagggccactctgttggttagtggctgaggccagattccaacccaggcctgagcccctgggacctgagtctggccaggacctcttggatggctgtggttagtgccctacttttcccagcaggttggatgcagaatcatgctcttgtcgttcaggatgaccatggggaccatggggtctgagcctgtgaccctccagtctacagtgtgttggtgaggaaggagcagttgtcactggggtcactggcaatgggcatgcctccatctagcttaggcaagatgcttggactcagagccagagagtgaaacccagacactaatgagctgtcggtgttggtgtgtgttctcttcctcttccagtggaacatgacaaggaattcttccacccacgctaccaccatcgagagttccggtttgatctttccaagatcccagaaggggaagctgtcacggcagccgaattccggatctacaaggactacatccgggaacgcttcgacaatgagacgttccggatcagcgtttatcaggtgctccaggagcacttgggcaggtgggtgctatacgggtatctgggagaggtgctgagtttcctctgggggcagaggaagaaggtggtgagggccagaggatgggtcagattggcacaaccacgtgccaggccctgtaccagattatcccttctaaagaaggtgtatggtgtatgtcacttccttaaaaccatgaccgacaacaaattcaggaatagtagaaggccagggagcccagggatgcgtggtgccttgtgggtttttataggcagtctagatctggctgggtgctaagggacatagaagaaaaggggaaggggaagaaacatttttgaagggctacctctctcccgtttctcactctgaaacccagtgcacgatgtcaggcaaccaattaaggtggccatctaaaataaaatgttaggggaagaaaaaaacccaaaccaaaaaaaacagagaactcttagccttccaagaatcactaggtcagaaaccaaacgtttgtgttgaaagtctttaatttatcgagatccattaatttcaaggtcttgtgagaggtaaggaggctaagaaaaagggctgggacatttagcaggtgcattctattcagacagtcccgaggcagaaatgaccaaggtcctattactcagtggctgggttgctggaccccgcaggctgtcagacatctaccgtccccactgggcagggaaattgatggaagaaaggtggtgtgggcacctccttgtgatgtgcaggcttagcatcttcagctagaaaggggacttgttaccatagacagggacagaagaaccatcacagctacgtttgccaagcactgctatttggtgctggtggggggtgggggtggggatggtcatctaagtaccaagaaaacaaaactgttcttgagcgtttccagagtgttttgcacttgatatcttgtttcatattcacagtagccttcagaagtggtggcttatctgtaaaatgaggagaactaaagtgacctgaagccaaagaatgaggctacccagagagaatgtggccacattaggacgtgagcccaggtttgcaaagctggagcccatgcttatgaaagatatttctttccaaaatttgtttttaggccgggtgtggtagctcacgcctgtaatcccagcactttggaaggccaaggcaggtggatcatttgaggtcaggagtttgagaccagcctggccaacacggtgaaaccccgtctctactaaaaatagaaaaattagccaggcatggtggcgggcgcctgtaatcccagctacttgggaggctgaggcaggagaattgcttgaacccaggaggagaaggttgcagtgagccgagatggtgccaccgcactccagcctgggtgacagagtgagactctttctcaaaaaaaaaaaaaaaaaaaagtttttgagtaggcaagacatgttcatggtataaaatcaaaaggaaagaagaggaaccacagtgaaaatgaaggcttccagcccctgctgaggtggtccctgatgccagtttcttgagtctcctgaaatcagcgaaggaatctgtgttgctgttttcacctgtggaaccccacagtgcactcactcctgcctctggctttcatcgttggatgatgaaccttggcagccctttccaggggttcacacggggtgccctcatcctctgagtcacctcactgttccacggcttgggttgtgctgtgtttcacgtgtgcacgctggctcctctgttctatgatggatggtgccgcagggcaagtaccctcgctgacatacgtgttcatgtctatcagtcagataaagttctagagatagaattgtggggtcagagggcccacacatgggtggctttggtagacactgctgagcagctctcctgggaggtgacatcgacatctactcccagcagccagggagcttcttgcttaggatgaaaccacagcctctgtgtccaggctgttatctggattctccactcagctccggcagctcttggtccttcctgctggctttgtgggcacctggtcccatcatggtctgtggtgcctctgctgtcttgcctgagatccatggggtggatcctgagggctgcagggttgggcagcaggcctgagcactgtgtttggaggagggatgggcgttccaggcgtcctccctgccaggctgccggcaacaggcaacttgggctgggggtgcccattctagtgctggggtcctgctcctgggggcttctgggctgctgagtgactgagtccctcctcagcacaggtacctgctgcatgccatgcctgagggcatcgaccagaacgaaccagacacgagtccctgccctctggaagctcacgttccagcagaggagaggacatggcaggtgggagcattgagcaaggaagggaatagggtgagaagcagtggagggcaagacggagctgctttctttaggtttctacatgttcttcctgtgcctcctgcagcaaagcctccattcttcagaagttaaatggttaaatttaaaaaatatattatttattcatttttctggacaggttgttttgtttttgaacctagaaccaagatgcccctatgatgtaattccccagctattaagagcatggattcaaatcctgccaccagctacccatgtggccttgggaaagagtcatctctcagagcctcagtttttccctctgtaaaatggggataataattgaatctccctcccagagttgtgctgtggatgaaagggggtgacatacttacaacagtgtcttacacacaggaagtgctcaataaatggtcacctgcgttagtatcatcatcatcacagcaggaagtggagcaagacctctttaggaagacaagagccctgggtggtggctgtggcactgccttcccgtgtaggtccaccgagccaattcccctaattctgcaatcttccagtaggaacaaagccctgagcttgcaaatgctcttcaaatcccccacgcttcctccagctcgcctgttcagagataggctttttctttgcatgtccccaacctggttgcatgtccccaacctgggcccgcacagcttcttccagctgaaggcctcctgcagacctcagcccgggggagcccagagcctgccctgctgtccccgccatgtggctgcctctgtctctgtgccgccagctgcccagctgtgcagggctgggacatctgacgagctgtgcctgagctccaggaaagccccgggggtgccgaggattagccggctttgggtcagcctcagcgtctctccccttgtgggagtcactttccactgactcctcttgatctctcggaatccagattaaattccgataatgagccgagctggaggccttccatagccctgcggctctgcttaaagcgcggccccagacagctggaaagacatgttggagccgcccttggcgggctgtggagcgagtgggggctcagaggcaggtctggggacagtggccttggctccagaggccttgctggggtgagagggggctgcgaaaggatcggagtcttatcctcattttctgaaccccaggcctgaggccaggccagctggggcctggcttccaggagctggacttgctcctgtctccattggtgcagactttggttccaggtgaaggtgaggatatttggggtaggggttgtgctgtttgccctgtttctgctgtggagctgggacctggcatcttccatcccagtcttccccgtctctccttgagcatgtgtcaggcttgccccactccacagcgctgccccacatgtaggcgacacacttctgctttgggagctggcctctgagaacctccctgggaggccaaggccagccagggcagcagaatctgctccaagggagtcggccgccaccaaggtcgagatgatgttggcagctggatgaaaatgtccctgggttcatctcagtgattttggctgccaggagggtgacctcagcgtggtctcgagggccaagatttggatcagctgcagcctgagtcactctgaggaagagggagctgccccctgcctgtccccaccacacaggatggattggcagaggaggcctgggctcagtttcctgggtcccttcagcccaggcagaggctcttgccctcgactagccctgggatgggggccctgagtttctgcctttctgagaagctccctggggacgccgtgatgattttggtccataaacctgagaaggtaggtggggctggatgtggtaggaggaacgatgcagccccctcacagggcggccctcgggcagtgggccaagggctccttgcccagtcctctcctggggatgctggggtggtggcaacttatgatgtgcggattcatgacttggtagcaagactctgggcgggttttgccctgccgttagcccccatgagcgtgtttgggcagagagccatggtcacgttccagagcatgtctccaccctgtggttgaggcttcttgttgcgtggtgcttactgtttatgactgtgctggacacttcagctttgtttcatgccttggaaaggttcctatgaagatgtatcatccccattttacaggtgcggagcctggctcagaggtgggaagtaacttgcccaaaagcacacagctacaaagtggcagaggtggggctcaaacccaggctcttagatttcagcagtcaccatcttagccatggccgtgcctcagtgattcccatagtgctgattccctcacctggggctcagatgggtccattgatgagtcctgagctggttttcagccttggctgtgcaatagaatcacagaggcttttaaaactcctgatccgtaggggttgaactgtcattggtgtgctttaaaagctcccaggtgattccctgtgtgctggggtgtgaacaggtggctaagatctctctaatttctcacccatgagctgtcttacatgcccaagaggaaggaaagagattccttttttttttttcttttttgagatggagtctcactgtgttgcccaggctggagtgcagtggcacgatcccagctcactgcaacctccacctctcaagttcaagtgattctcctgcctcagcctcccaagtagctgggattacaagtatgtaccaccatgcctggctgatttttttatttttagtagagatggggtttcaccatgtattggccttctgtgacacattccatgttcccttcagcttggtgtctcagagaagactgttcttcttcccatgagactgagcccaaagtgtagtccagaccacaattgtcagtctcaatggcacaggaaagggactggctaagggtgaagatccctttggactctggctccagaggcttctggaagcttctggaagcttccagaagcctctggagtttcttgctgctcctgaaggctacatgcctgtttcctcgtctcctggcttctaccccttgccactacacctcagccccagggcatgagttctggttttgagctgccttctcaggatgtgccaggtcagcttcctgagtagccttttcagagggcaaggaggattccttttggctgctgggaacttccaggatgtcctggaaggtcagaggagagcagccctcatcaaggagccttggcatttttcctcgcagtccctttctctgggcctcactccagaaccgagactgaagctgcctgagagggagtggcaggcccttaatgcctttggttccgcttggggtcctctcatggatctgcaaggatccctctggaaaaagccacccagctgggcagagatggcaaaccactgtgttcaatccagttaatgccagagacacagccagtatcccctactcagcatctgggggccaaatgcccgttggcttcctgtcctgtggcctgaggccatctggtgggccttggtggcttttttttatctctgtccctgttatttcttcccataattcatcccgagcctggcttcacagggagcatacgggtggtggctgggaatcgatggcaacagattccgtttgctgagtgtttgcggcgggcgggggctcagcaggttgcccacattttccctgattccccgtaggtgttatatcacgttcagtgaagccgagcgggtgtccccacgaggtggtcagtcctgcccctcttgtagaccacctgtgggaaaggtctgctctctttacgtttccatcgatttagctgggtccacaatgcgatcttggagcctcctctctcccatgacacttgtctatgctgggagaagggatggctgcctttgggaacagtcatgatgacaaaagctaattgcatgcaatgggggctctttactgcttcccacaacaaccccccatggagacacccttatccctgcccacccctctttttttttttttttgagagatagggtcttgctctgttgctctgctggagtgcagtggagtgatcacagctcactgcagcctcgacctcctgggttggagcaatcgtcccacctgagcctctcaagtagctaggaccataggaacacaccactatgtctggctagttttttacttttgtagagatgaggtctcactgtgttgtccaggctgatctcaaactcttggcctcaagttgttctcctgccttggcctcccagagtgttgtgattacaggcatgaaccaccgtgcctgctcccacaccctctttcacagacaaggaaatgaaggcacaatactgggttggggattaaggatgagaagcttccatctttccccagtcgcatatgtttttcttccttggctggtggatacacttttttctttctcctcgtggcagtccagtcctgtaaattgggaaatggtggggcaattcatattttccacacaaggaaattgaggcagagaccagtgacctgcccagcctgtcccagtagtgtgtagtgaggctttgcagacgcacctggagccgcctctttttccacccctcggaagttgcacggacttggacagcatgtggacacttgctgaaccgtgtggggctgcatagtgaagatctgagtggggcccagcagagacagtgacagggggtccacaaggggaggagttttgttcgttttgctcactgtggtatccattttgcctagagcctggcacatagtaggtgctcagtaagacaccaaatgcacgaaaggatgaaagcacgacccagccttccctttgaagatgtgggctctctgaattcacagaccacatggtctggtcctgtgtgcctgagcgcatgtacaacagatgcctgctggatgagtgagtgccggccacagtatctttgccctggagctagttcgtcctaccaaatgctccaatgtgctttctcttccagaattgaaactcgagaatgccttgcttgcaatctttcttcagcatctgagcccaatttccaaaaagtgaaaattgcctgtaattatgatactttctgatcctatggatgtttccctgtgatgattataattacgttatttacagctgtgtgccagtgggtgcccaagggtaggtcggttcttgtttgcaaataggggagacatcagcgtgtgtgcggcagcctggggttctttacactgggatgcatttgggaagaatgggctttcgtggaggcagctctctggataacttgatttggcactttgattccaaaagcacttcatgcttggccctgggcctctgctcgcctatagaagctcatttttccaaatgtattaacatctatgtttcgaatcaggatctgtaattgctttagcttttttggcaggagacaaagagaattaatatttttcaatttggtcacaagcagtcatctgtagctgggaagaaaagtgtctgctcaaatactaactctaagggtggggaatacaggcttaccaggaacatgatgatgttttaaaggagacaaccacagttaatgaagctagttcaagttcagattggaagtaggcatgtaggtaaatactcaaggttcttccaaaccctgcttcttcctttgtcttcctattgcaacctctgtcggtgccatgttcttctttttcctcaacaatgcccatggctttccattttgccaccccaagaaaggaggaaggaaagctgacacctggtcttgcattccagcacgcatgccacccttctcctcctgggaccaaggcaggcattgctaatggatccctttccctccctttccctggatccttggtacaggtctctaaataaggcagccactgccagttgagtgaagctgccatcaagtgaaacctgttggccactggtttcaggtcaggtttctccaaagctcaccctcagctgaggattgtgtggctgtgagagtgaaggattagaaagtgtttccaggaaaggcctttaggagcatcgggcagtggggagatggggaggccaggtgagggagcggtgctgcgcagagcaccccgaagggtgactttggctcactcttcctgctagaggttctggagacaaagttgcaccctcatcctagtcccgtcaagagagctgaagtgtttataccctgtcatttgaggcagggtttcggtttccgagcctccgcagtagtgacctttgggggtggctcattctctggggttaagggccatcctgggcatagtagggcattcggtagcagccctggcttctgcccaccagatgccaatgacacatccccacactcagttgtgaaaccaaaaatgtcaccagatattgtcagggtcccatctttaaaagggcctctaactaggccctgactgagaagcacagggtggagggagggagggatgtcaagtacctctgggtgacacagccgaagttgaacatacttaagtgggaagtccctcgcccaccctgtcttcttcccaccttcccacttaccttgctcactgctacctaccaccaaacaccacctaccagcaaacaccagctaccagcaaacaccagctaccaccaaacaccacctaccaccgaacaaacaccagctaccactgaacaaacaccagctaccaccgaacagctaccactgaacaccagctaccaccgaacagctaccaccgaacaaacaccagctaccaccaaacaccagctaccactgaacaaacgccagctaccaccaaacaaatgccagctaccaccgaacgccagctaccaccaaacaaacaccagctaccaccaaacaaacccagctaccaccaaacaccagctatcactgaacaaacaccagctaccacctaaccaacaccagctaccactgaacaaacactagctaccaccaaacaccagctaccaccaaacaccagctaccaccaaacaccagctaccagcaaacacataccagctaccaccgaacacacaccagctaccaccaaacaaacaccagcaccaccaaacaccagctaccaccaaacaaacaccagctaccaccgaacaaatgccagctaccaccgaacaaacaccagctaccaccaaacaaacccagctaccaccaaacaccagctatcactgaacaaacaccagctaccaccgaacaaacaccagctaccactgaacaaacaccagctaccactgaacaaacaccagctaccaccaaacaccagctactaccaaacaccagctactactacaaaacaccagctaccaccaaacaccagctacctccgaacaccagctaccagcaaacacacaccagctaccaccgaacacacaccagctaccaccaaagaaacaccagctaccaccaaacaccagctaccaccaaacaaacaccagctaccaccaaacaccagctgtgcagctcctcacacacatctgtccgaggtggtgctcaaacccagctgttgtcagaacctcctggaaatatattggaagagaaaaatacaggttcccatgtttaaccccaactagtcaggtgtaggggctaggagttttcatcatgaatgtttaaaaacaagctcccaggactggttgtgtcaccttctgggcccagtgcaaaatgaaaatgtgtcaaaaatgtataaaggatttcaagacagcaacagcagagcatgaaaccaagctcggcgtacttctgtgtgtcgggccctgtgtgactgcacgggtcagatgcccatgaagccggccctggccttgccatctccctggatacagatgtctgttgatatctgtgttgataggtatctttatacagatacctttcagccccagcctcatttccagctgtctcctgtacacgtaaacacgtggaaacacagacagatccacagaaacacagacacagacacagcacacagatgcgcagacacgcctggtttcccctgttttaacacctaacatcaatagggtacagttttcataattaaggacccagcatctgcatttttattaatgaaagtcaatcatttattccggacccctttgcttttacttcttgtccttctgtcctgtccaggacgccacctacccttcagtggccacattccctggggctcctcctgcctatgtgtttctcctgctttgcttgtttctgaaagtgacagtcacccagcgtttggagggagttgatgcagagtcctctcccactatcactccgtctatctcagccccacctattttaaaattcaacctgaatccctacgctctggctgtggctcgatgtcttctgaacttgagtgacgtgggtcacagccacacagggtccccagactggagtccttgtaacccctgggctttcagctatggcgacctcagtgcctggcacagagcactccatgtggctttgcttcttgagtggaaatgagattataagagcctttttggggtaagggttctttgtctcctaactcttccccagggcctagttaggggcgctttaaagatggcacttgaggtgtcctcaatagcaggctctttcccctccatgctgtgggcttagggagcgggctcagcctcttgctctggggttgaacccacaggtcccggaagtgggagagggtgggtggggtggtttgggagtcaggtttgcaagtgggattgagagctggaaccaggagcctcccaacaaacctgtcatggtcattctccttggaaagctttctccagctgagtcctgcctccatccctttccccttgggtgttccacatgcgggggctcacggtgcagtaggaaaagcatctctgaggccctagtctggctcctggacataagagggatcctccagcttccccagcatcactggtgtttgagtcttttctctgcagatgccaccacaggttgtcctggcaggggtccctgccatgagtgtagacagcatttctcctccagcccatgtctggctgctcaggtggtgactcccaccatgtcagcctcaccaactgccaccttggacagggcctccactcctcctcggagagatggacccgctgagccgcagacctcgaggcttcccctccccacacaccttcccctatgtgggagctctgtggggaactttctctgacccactgaggagtcggagtcaaggtctatggggaattccccagccccctcaccctcaggagacagtccctcaccctcaggagacagcccctcgccctcaagagacagcccctcaccctcaggagacagcccctcgccctcaggagacagccccctcgccctcaggagacagccccctcgccctcaggagacagcgccctcgtcctcaggtgcacccctctggagctgctccaggaggttctgacgggctgaagtcccaggcccacagtgttctgttttgacgatctccaagcttgccttacttccccgccctctccaggtggttcctggggtcacctctcagacaaactacttgcattcaagtccttgactcaggacctgcctctggggtcactgaagcatgacagaggccaagtgtcaaccacacagggcagccgggagggcttcctggcaaggggcagctttggcaccggcacagcttctgggacctggtgagggcctaccaagtgcaagctgatgtcctcagcctgcccccttcctggacccccccggcttcaggatgctaccgtgagaataagtcttagaacagcccgctctggccttctctagatgttccaacccagcctctgtttttgagaatcttgaatttggaaattgcgtcacttgtttctgtctgcaaagcactgtcaagtttctttccccttgtcgccctgctttgctgcactttttctgtctctgggtttggaatcttaaaacagcctgtggttctcttaaaaaaaaaaaaaaatgaggttggaaagatgacccagcccgaagactgtatttgtggtgcttgtttattccttgagtgtgctgcaggaaaggggctgaatttacctcattctattttggtctggacctggaggctggaggaaatgcggtccccaggagaagtctagaaagatgagtctccccatcctccatggctgcccgcccacctccacagtgccagatgcaggcagctgcccatccgtgtgggatttcccccagagccgtgtcagaagctctgcagtgccccccagatttttctggggggaccccccagagttcttgatgtttcaccagagttcttggtgtgttctgtgagctggaatccagctcgcggctcagttccactgggtttctggatggatcatgcctgggttgaatggaacagtagagcctccagttttccagaaattctggggctcaaaccctgatatcttaagcaaagagggacaagagtcaggtccaaaaggaaatgtgagatgtgctttcttcccagctgttgctttctgcccacctgagtcctcttgatttttgcctgatgtggggaaaggaggtggctccgaagaggtgatggggacagtaaatgggggcactcaaccggaagcccatgcagcctggcagtttccagtgaggggtcaatttgaggtaatttgacagccccctggttccatagccaggcctgtgaaggtggggggtatggaggtgcccaggggctgatgagggtttcccttcaactaggatgtgcagctgggtgcccatggcctgggagtgtgggtgcccagtgggacatagagtgggctgggtgggctaaggccccagtgaactgtgagtcagagccatttctggagctacctgaataatctgaaaaagtatttaccatttctcttttaataatgtaaactattggaagtgaaaccagaaaaccttactggccataaggatgcagaggataccagcacatttgtccagcgtgcatctgaggcctgctttgtgctaagctgtgtgcctggtggagaggccgctccagggctgaataaaatagggctggttcttgctgacaaaaagcttaaaacctggcaggaaaagaggagaacccaaaaaactatacaaacaaactgaaactccagcccagatggcgcaggggagaggacttgggcttggagcgtgtccgacgtggatgcaccattagggcatcagtggacgcttccctgggatgctcaagaacaggcaggtgtgagggaggtgaaaaggcagggaacagtgttgcaggcagcggaaacagcatgtgtgaggggctgtggtgggctggagactggcacagatgaggagggctgggtgggaggaggctgtggagacaggggccggaccatccagggccttacaggttggatgacctggagttgacaataatgcctcctctctctccccagtttctcggtttggactgtcagttccatagtcttctttatcacagaacacattagagagctttggctttttatcctaagagctgataaagggtttgaggcagggaagttaattgctcagcccctgcaagctgctggggcagggggagtgcggggtgagaagagtggaaggggaacccccgggttctctgggtggtagctctccctccaccatcaaaccatcaccgtgcaggggtgacactttgctggaacaaggctctggggtggttccattcactacctgcatatctctgagcctcagtctcccacctgtgagaggggacaacagtgctcgcctctcaggtaccatacggttcagagggctcgctccgcaccttgttctaagatggttccatcttgagttggggtcagctcactgcagctgtgatcttactttagagccaaggcagcttgaatcccatggtggaagattcacactgacattgaggtttgctccaaccagctgcgaaccttgagtctctggctttgcgctggcatcttgagcatatctttccatttaactcattctcagaacaatcctcatggctacctccattttacaaacaaaagaacctgatggacagagactgacttgctcagggttacttcactgaaatttaactccaattttcctcaactcagagcctggagccctacagcctacatccctgagcacccactgtgggacccgaggaccactctggggatttcatcacaaagaggattccgggcctctcaccccctgattgtctctgctggtggctgtgtctctaatgagggagagccttccatttgtcgctgtatttctcttccctcttgacccccagcctctgtgatccacaccttgacacaagtttgaacggctcgttactgcgctccattgccggagcagacatttctttgcagcaggacttttcagagcctttaaagagctaaggtgcattatgacatctctaaggagcaatgtgtcatgtggtgcttcccaacctcatttcaccacagagcattttggatttttgatcctctcattttcctctcttagctatcctattaataagttgcagtttttgagaccttgataaactccaaaccctttgtcttgtggatggagaaactgagggctagaacataagggccactgactcgccttctgactgtgacaacgctggcctccgggtgctggacgggcatcttcctgactttcccatgagtggctgggttggtgctgtctgcagtcagctggccctgcccagagggagacagacagccgtggggtgggtgagagggccgtgggtggccacccgagctctgtctggggcaggaggatattgtgcctctttgtgtatttttccaccttactccccaaagctttaattttagccttcctggatatgcaccgtcttcaagaaagtgtatttttaaaaagccttggacctccctgacttcctcttcccgtctgggggatgccagggactgttctatgatttggcaggaaagcagggcattccctgaagctgaggtgggggagcctggggcccgggctgagtcctccccagcctgcagctcagaaggggcaccccttggacccgggagctggctgccagggtggggccggcttccttctgggctcctttgatctccttcccgggcttccctgcaggctggggttgctgctgggctgactccaggtgcacggcgggttgcagtttcccggcctgactcaccgcagccgcaagcctgtgctccctccatgacatcatgctagcctgggaatgctctggccatgctcgctggctcgctctcttgctccttttcttctgaggaatatccttgcggcccagcaaccgttcacaacatgcaggccttcagaatgtccggcctgcagttttccaaagagcagcagagtgaggcgagggcgagggtcagactaggggtcggggagcgagtcagctgggtctgcgagtggcagagcccgtcatctccactcctgcttagaactcctcccggcttcccagcgctcagcaagacctgacctcccgcggccagaggccctgcaggggacatcgtgcacctgtgccctctcctcactactttctcatcatgacttccgcattcggttctctctgccgggaacgcttttccctgcccttttagctgtgttagttctgctcatcctctgacccccttcgggagatgtttctataaaacgtcctccccgcacaccctcacacctcacatctagtccttttcttttgtcttgctcacccagaggcctcttccctccttcacgccacttaattagggtttgaatgaccctcttgtgtgctacgcacgcccagcctctggacccggagctccatctctggctgccgctgtgtctctggctcctagcagagcacctgtggagaggaggcgtttcagtgtggatctcaggagagaaactgtattcattcctccagctgctgagcccagtgaccgccaacttagtggcttaagacaacacacatttattctcttagagtttgggaggtctgaagtctgaaatgggttttactaggcccaaatcagggggtccatagggctgcatcttttctggagagcctgggggaggatctgtttccttgttgtttctggcttctaggagacagagccccctttcttggctcaaggttcccagccgcagtcacaccaccctgacccctgctttcgctgtcacagcttattctctggcctcctgcctcccctgttatcaggacccttatgattcctttgggcccatgaggataatccaggataatctcccaactcaaaaatctttcatcacatctgcaaagtccctgctgctgtggaaggtggcatacccacagcttctgggatcagggcctgggaggtggcatacccacagcttcctgggtcaggacctggatgtgtctgagggggtgttattctgcctaccacatcatctgaagtgtgttttccttttttttgatggtgggcctgggccagccccgtcctctcctgccctgcctcctctaacttgggtggggctcctggagatggctttctgtgcttcgagtaacctctggcctggggcctgttgctcccagcagaggcgtgtcctgagcctccctgcccctcagtttttgtacaatccccatccccatgtaataggtggtattaaggtgatattaagtggggatgcggattgtactgacctcattggaggagggaggaggaggtgggagagtgtcccttaagagcctagtgtgcagtaggtgcccagtacgaggtgtcagggtgctgagggcccccggccaccagccgggtgattccacatgcggcccttccaaccctggcttgcgcctgctccctgaaggtggtggggggctgtgtctgaaggtagcagagggggatatcaggctggctctcaggctgtgatggcgagaacatttttcattacactgccctaaattatggcccagaactggtgtctaatcctcgttcagccaccagctgcccatgcgcaagacaaaaactctctcatctttccaagctgaaaattaaaatgaccagaatggatttccaagggcctgttctgctcctaagaccctggatggctgggcccaggggcaggaggctgaaggagccccgatggtgggcgcagacaggatggggactgtcccaggtaacgagacagtgtgcactgtgtggccatgttggaattcgtgtttcctgtggctccaacgcgtgcctgggtgcctcagggccagagagatcctcagactcccaactccgctctgttttgccctggggcagtttcagggccatcttccctggatctgtgtttgcgctgaggccgggtcctgcatcccacatgggagtcttactcccctgggaggcgggtggtgggtgaaggcccatgaggatcagtctctaaatagcctctaggtaggtagccagaggccaaaaaaaggacttcctgccttcccacgtttgagattttaaaatatccccttttccattgtggtagaactttccaggggaaggtgggctgggagacactggaaacgagcctggggatgtgcggttcctcgtcctgctcccctagaattagatttcagccgattcacctgggcgtccttgggaggaggcacctgaaagcccagcagcacgctgtccccaggctggtggttaaatattaacgcctcttagtgcggcggcattggggtcaccagcggttcatgccttgcagagcagggctatgggagaacccagtttcagaagagaagagaagacgacttttggggtcttgctgtttctttaatcagaaacagcctgagaaagtggaaggatcatcaagtttatagacaacagacgtgtggcctgtcccctggctctgctgcctttctctgagattagaggagtggaaaaaactgtccaaacccaggaaagaagatgagagccaggcttgccccctcacctaggtttgttctgctgttcaagtataacatggaaatatgttgccccatacagatctagctttttccagaaatagggcatgcttactaaattgagacaatattgacgtacatgtgttagcttgtaaagggaagcaaaatacttcacagtgaattgttgctaccactctggtgtgtatgcgtgtaaatgtttcatgcagctgtgtgtacactttaaaacaattgttaacataatggcaccatactctatatttggggcttagattggccttatccattttcaaaaaatagctttattaagatttgaagtgtataattcagtggtttttggtacattcagagttgtgcagccaacaccactgtctaatgttagaatgttttcatcaccccgaaaggaaactccatacccactaacagttacccccattttccctacctgtctagctgttggcaaacactaatctactttcttttattttctttttgtttgagacagggtctcgctctgtcactcaggctggagtgcaatagcgtgatcacagctcactgcaacctccgcctcctgggctcaagcgattctcctgcctcagcctctcgagtagctgggactacaggcatgtaccaccacgcctggttaatttatatacatatatatatatatatatatatatatatatatatataaaaatatataaatctaggtatttgtttattcatttatttttgagacagagtttcgcccttgctacccaggctggagtacaatggtgtgatttagtagagatggggtttctccatgttggtcaggctggtctcgaactcccgacctcagggtgatccacacgcctcagcctcccaaagtgctgggattataggcgtgagccaccgtgcctggccaatttttatattttttgtagagacggggttttgccgtcttgcccagtctggtcttgaactcctgggctcaagcaatctgcctacctctacctcccaaagtgctgggattacaggtgtgagccaccacacctggccctactttctgtctttatggatttgcctatttgggacatttcatagaaatggactcatatactatgcaatcttttaagtctgactgctttttcttagcataatgatttcaagattcatctgtgttgtagcctttatcagaacttcattttttaatgccaaataatattccattgtatcaattgactgtattttgtttatctgttcatgagttgatggacactttggctgtttctacctttttggctgtgaataatcctgctatgaacattggtgtataagattttgggtggacatgtattttaattgcttctgtgggtagctgaattactgggtcacatggtaattctacatttgaccttttgagacaccactatactgttttccagagtggctgccccattttccaatcctaccattagtatatgagagttccactttctctacatccttgccagtaacactagttatcatctgtggttttggctctagtcatcctagtgggtgtgaagtgctgtctcactgtggtttcaatttgcgtttccctaatggttgctgatgatgtttagcatcttttcatggctcactggccatttgtgcatcttctttaggaaaatgtctgttcaaattagccttctctattttgggagtcagtggcgtgctagctttacaatatgggtttcaaacactccttcttccatgttcttgatcaaattatataagaaagaattatctgttgataatttgcaaaatctgtggttataaaaccaactgggggccgggtgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccagcctgggcgacagagcgagactccgtctcaaaaaaaaaaaaaaaaaaaaaaaaaaaaaccaactggggtatggggatgggaaagaccttcctatttcagtttcttttgggcaaatcaaaattttcatttctttttgcaccaatttttgcattttgcattttcccagaagtttcagtcctacaaattctgtttcttagcaccttcctatcatatttccaccttgtcaacaagtgtagatttatacggtcctttgaagcggctgtgcagggctctgttgccttggatgtgccataatgtttttaccagtccctctcactggatggttagtgctcagtttttctgttataaacaatgtgactgttgtttgggttatctgtctctgaaactaaccactcatatgtagtggcttaaaacaacatcgttttattgctcaggaatttaggcagggcttagctgggtggttcttctactctttctggtatctgctgtagtcactgatggagctaggagcttgactaggtctggaaggcctgagatggcacctcactggggactggcttggtttttctctctctctctggtttatagacccttatcctccatgacctgtgcctccttcccctccatgtggtctcttccttcagcagtgtagtcagatttctcgattcagtggcttccttcccagagggcaaaaatagaaatgataggcttcttgagtcctagtcctgagcctggcaggacctcagttccactgggtcctactggtcacagcagatcacatggtcagtccagacttcagaggtggggaacagactccacaagtttatgggacagcagcatgtgcatacagagacaaggaattgttggtggctgttatttgcagaaaatctaacactactgtgaacataggacacttttctgacaaattttggagtccaaggtaaacattcttggaatggacaagtggtctgttgactggagaatcatgggcaagtcacataacctctgggaccaagacatgtaaagtccccatcctaggatttcctgaagtttagcagagaatagacaccaacactgacataccttgtaataagtatagatgctcttccaggagtgtcttggagtttgctgccaggctggtcttaacctggctcttcctaatcattgaagaagatggcattattctcattttacataagaggaaaccaagacacgggaattatctggcgtaaccttgccttatcccttctccatcacctgggtttcatccccctctagtattttctctgccccacacaacgctgtgatgacaacacgtatcatacaggatttgacatcttcctatgtgtctcttatccccaggtgagtgaaggaggtggcagggtttaagcgctcaggctcttgagtcaggtttcctgcgctgtcgcctggttctgccacttatcaggtgtgtccctggagacaactggcttcatttcactgaccccaacttttctcatctgtaaaacagtaacaggactttgatcatttcatagggctggcggggagattcagagaaccgaggcgtggaaagcaccgagattctcagcagtggcgaaggtgaaagaacgcatttaggttcctcagggcctttcaccctgagccttccttacctcttctctcacctgggctgggccggggaggccagtgtgttcaaggtaaataaaaatgtcacaaagggctccttcagtgctctcctggttgtaagaaccagtgttcttttacgatgctcaaggtggcagctagaaattccccctctccgagctgtcagactggacctggctgctgagtaattccttccttgtcctttccatgaggtccaacctcatgcctgggctctcagtctgaaagcaaagcccgtgttagcatctcacactcgacccatctcagcaaggctcccgtctcccagtgccttctgatgaagatttggctctcctaagtgtgcctgggacaaattgcaaactatgacttgaaggaggggagttgacacgttcacgttgattcatggatgagtcagtgctggcctgtagcatctggcctcagtgtcatagcctgcaataagagaatgctcagtatcgtttggcgaggcgttctctgtttaaaggtctcactctgttcctttggttaccattcattgttttactgtcctcgagggcctgtccagatatctggtcacattttcctgctaataacaattttccagcaaaatcaccatctgggtttgtgacttctgtgctgaggtgtggatatttcctacaggggccttgggagcctgattcagtaggagaagttgtttcgacttggagtggtgcttcttgtctcatctgttaattgttgagaatcgctaatggttcattgacaaccttggtagcttttcaaagccaggaaagtcatccaggcaaactggagataagacagcaggaaattcttgtttataagtttaaaatctgtgtagacatccccgaagccagcctgaaactacctctaaaagagcatggggaagaagaagtaaatgagtcatgaaaaataatctcatgactttaattcagtttggatgtgaaaggtaaacttagggtcttcaaagtcctgtgtggctctaaaaagacttccttgcttctgtcatctctctgtgcttgagagaggaatgagtcctttacaatctttaaaaacaaacaaacaaacaaacaaaaaacaaatacctcattccttatagtcctggagactgggaagtccaagatctaggcgctggcagggtcagtgtctggtgaaggctgccctctgcttcaagatgacacctcgttgccgtgtcctcacatggccgaagatggaaaaacagaaagggtccagactttctccctcaaacccattcataaagacaccaatccatccccaatggcctaatcacctcctaaagggcccacctcttaataatgatgcattggggattttcaacatgagtcttgggaaggacaaaacattgaaaccacagcaataacagaattaagcattttctgaatcaggttctgggggtcattgaatattacttaaaaaggagactttgaggtggcatgggaggaggtgactcctgcgcccatctgtggtcctggtgatgcgtccattgctgtggggtgcccaccctcccatggctaggagtgggcacatagattgactgggccaactggattctgtcccccagagttttggatggagagaggcccagagggaaaagcagctccgattcgttccttctgtgcttgtgcctgagaaaattgcgctgtgccctcgcacctgcctcggttcctgtctgtttctgaccctggttcttcttccctgtgtaggcttctccgggtctgttaatctcccaatacttgctaacattacaggtctgtttcccgtgtgtcttctctgagccttgttcacattgatgtgcctgacgaatgtctaacatattatggcatgcagcagaagggtgatctagcagacctcacaaacctagagttgtccaggtcagacaggaagataaatagcggtggctgtctgcagtgttagtacggagagctgggggctggagccaaccggagatgtgtgcctcatcaaaggggacatgagtggctcggctcctgcccgtggcttagtgggttacattccaacgaggttgactggtgaaaggctctgaaaaggcagtgtccagaagaactgtctttgtgtacagttgcaagcttgggcttgcaggtagcctggttggtttccagtcctgcctggactgtcctagtggcataaccctgggcacacaacttgacctttcggatcctgagttttgagttctgcacaatggcatggggaatattatctaccctacagagtgttgtaagaactaagtgacatgagactggtcaggcatttcaacctggagcctggcatatggtaagtgctccataaaggatatgcctgacatctttacgtgtgagcagacaagattcactataatcaccaggaagattagataactccaggtatgatagagactgttgttgccctggggcagggaccagtgtcatgttgttcatcattatgccttggtttctggtacaacacagaggtataaatattctagttgactattaaaggactcaaagtattgaaactttgaattcttattaaaagtgtgcaagaaatgttatgaagatctttcatactagaattctactatccagaaatgtaacaatccacttatttaccctcttattcatctactcatctacccattcatccatccatccacccatttacccatccactcattcacctacccgcccacccatctactcatccatccatccatccatccatccacccacccactcatctacccatccattcacttatccatccaaccatccatccatccatccactcattcacccacgtacccatccattcactcacctacccatctacccatccatccaaccacccattcaccctccatcccctgtcaagttaattatgattttacccattttgctactgtaaaaagtaaggaagagagaatgaaaggattttcactattaataccatcagtccagagattcacctcctaactcttggtgggctcataaagatggtgcacgtcctggaaatgaagagtatctgctctggtacacaggtaaatgggctgaaaccccagcttggcaacttcctggttaaatgaccttggaccttgggcaaatcatggctttaccataaattgagtggaaatgatattcccacagcttcgggttgtgggaattgaatgagatagtgtagtgttgagcccgtgggacagtatctggcacatggtgaatagttcagtcactatcaacttctgctctctgagactcttccagcaacacggaggctgcataatccctgtcttcctatactctgtcccgctgggatgcccttaacaatttatggggtgagattgccttgtaacagctgccttttccctgcgtgtatctctttgtagctcttctgcactctctttcctcaccacagctactgaggggtctttgtgcctggatcttggtctgatgttcccacttgtcggggaccagtggactctttccctcccctcccaccccatgaggctctgcttcccatctgttggggtagtggagctgtgacctggctaacgcgaagcccgtgtctctcctcctctctcgcagggaatcggatctcttcctgctcgacagccgtaccctctgggcctcggaggagggctggctggtgtttgacatcacagccaccagcaaccactgggtggtcaatccgcggcacaacctgggcctgcagctctcggtggagacgctggatggtgagtcccccggccactgccagtcctaatgcagcctgtgctcctggacttcaggagggtctcagcagtgctcatgcttgcttcactacaaacaggcttccccgcccctcccaaccagtactccatgttcagccttttgatccaaaccagaagcagccccttcccctcttttcacaagaagattacatgtttggtcatagcagaattgggtaaggcttcattacacaaagggtggtcccatatcagcaggggtgagggcagccctcttatgagaaatgcagaatcctgggcccaccccagacctgctgcatcagaacctgcactttaactagagccccaaggtgacaccacaggacacaggacattctggactgttccgtgcacggcagggtgtttagcagcgtccccggtctcttactcactagatgctagtagcatctcccagttgtgacaccgaaaaatgtctccagacatcgccagattgtgccctgtgggacaaaattgcccttgtgcaaggcattggtcccttccacattagaacctgaatgtgcgtctgactctccagttcctggagaatccattgtgagtctgccctccccaacacttctcattcccactacagttctgcctcctttgagaagggaagaaggaaggatggtgagtggagaagtgggaatggacttctctatgctaatttttccccaccccaaacagataagaaatgatatcttgtagcttgactttgcttaaaattcagtggtgatggtttccagctgtgtagcttcttccttccaccagttttatgaacaaaacaattttttcatttatttttgaataaacaccttcacaatgtttgcctttggagctatgaacaatacatgtgtaacactaaatagtttccctcccactttcttctccagctgctgagttccacttcccagggacaactgctgtttctgtcttttcagagatgctctctgggtatttcagcaattacatggagattcggctttctgtttttcccctctcccataaatggtggcctggcatatacagtgttctccagctgacttatctcggagactggtcctgtcagccgttaaagagcttccttgttccatgtgttttgtgtccatgtagctctgccacccacacactgtgtgacgttggacaatttccctaacctgtcagagcctgggctttctcatccagcatgcaggtgatgagaggatttgggccattgggttgttacaagatgtaatgggttattatgggaagagtttttaaaaatagtgccttaatgtacgtaggattttcccaggcatcttggtaaaatgcagattctgactcagctggcctggggcagaggagtctgtgttctcagacagccaccaggtgacagaagctgctggtccctggaccgtgctttgagtaatgaggcttagaacaggacctaactgtaatacacatgtaaaggagagcagtcatcatcctcgtcatcatgatcaccaaaactgacatacccagctctcctgggatggatgcctaggtgttttctagtcttttggtctcacaaacagggcttcagtgggaaaccttggtgtgtaggtcgtttttcgtttgagtgtagctctaggaccaattcctgaagtggcattgtctatttgtagttttatttttttttgagatggagtctctgtcacccaggctggagtgcaatggcacgatctcgattcactataacctccgcctcccaggttcaagcgattctcctgcttcagcgcttgagtagctgggactacaggcgcccgccaccacaccggctaatttttctatttttagtaacacatttctgtggacttgtagatgttggggaaaccttccaactgggccccagtgggttctgtgcttctctgtcttgcctgttctgctggctcaggtgattttgtcttaattgacgccagccctgtggccagctcctcttactaccagtcctgccctcatcattccccccagacacagtcagagtccttttgcccctttcacctccagcacctactcccccattgtccaggttatggagaaaggctcagcattggtggaggcagtgctgcctgatggttagagctcgggctcccgagccaggctccccaggttcaaatcctagccctgctatttccggccttgtgacctagggtgagtcacttaatgtgtctcatctggaaaatggggttaataatagtttccatctccaagggcggttgtgagggattagatgagctcatgcaagtgaagagtttaattgctcagtgtgtggttgctacgaagcaccactgtctcttgtgatcctcacaattacccagcaaggtagatgctgtggctcacatccccgtggtgcaggcaggaaatggaggctcctgagaacccgccggggctccatatttcagagcccacctgagaccctctccattccttgcagcctagtggctgcaggttgctatctagagtcagatcaaggattagatgctgtgtccctgtccccctctgactccgggacaccatctttgctcctcctgggcagggccctgggggccgggtgtggtgccaccgcccagtgacttggcttgtccaggtgctgtgcgcgcccaggcagtgagttttgtgtggttgcccaagtcgggggaggatcacccacttggattgtcagggaggggcaaagtgtataatggccagttggctgtgtggagttttggacctcttgggggtgagctaaagagcaagtgagtccgggattttcgagacatcatggctgtgaaaatgctttgttttccctaccgtggaggatctcaagcctggcgtccttcagggtcaccctagggggcaaactgcacatgcaggtgcctgagctccatttcagacccaccgtgggggatctcagaggatgcgcccaggaatatgccccttttccccagtagctttaggggtacatgtggttttgtttccgtgggcaaatcataaagtctgagattctagtgctcctgtcagccaagtagtgcacgctgcacccagtatgtagctttttattccttagccaccttctaaaagaagacttgggtaacttgaggcctggcccagtgacaacactctggcaaagtcgtgcacggtgcctagggcagcctgtttacaagatggtgcctgggctgacaggtacccctcgggttctgggtctcaaccctcccctgccagatcctgcacggggaagggcagcagggcctgtgggaggcggtgtgcatccgacaaatcagtgcacacctgctttgtgcctggccccgagctggctgcagagaccctggtccctaccctggggacctcttactgatattaactcagaggatatcctgcctgcaccagcacccagagaagacaggtgcccaggcagcagcgcccatgtcatcatccagaaggggtagagacagggtcacctgaaccttgcaaccactaggcagttacactgtgcgtgggtggagaggagcccccagcagctgctggaatttggagcccggacacctcctggggccttgcttttctcatgcacacaatgggcatgtggaggatagtaatttgggccagcgtgtttccattctagcggggcgcagccatcgcagaccttctttcagaaggctggtgtttaaccccacatgagcccctgcctgccagtggtctccaaaactccaaagcccagatggcgtcctccttccctcccatctggccacgggtggtggggggtctcgaggtcaaagtgcggaggtgcccttctgagaccacccaggaagcgtgcgtcttttccctcttcctcccagctgggccctcctgtgagtcaccatgcggagcagccgcagctggggctctgctccaggccagcgtgccctcgcggggagaagcctataaactcccaggcacctgcagctcatcaggaggaggccgagcggggagcctggtctcatctccctggggatgggctggtgctacaggaatgagggctggagtctgtttgtctttcccttaatacagaagagaggagaggcagcctctccacttgttccagcccccaggctgtgcttcccacccatggactggctgtgtcctacagcccatgctggatgctggtgtcagagacccggggtgaatctagcactgcccagagccctgtgagaaaggagaggatagagaggagagcgagaggagaggaggggagaggagagtgagaggagaggatagagaggagggggagaggagagcgagaggagaggatagagaggagggggagaggagagcgagaggagaggaggggagaggagaggagagcaagaggagagaagggggagaggagagcgagaggagaggaggggagaggagaggagaggcaaggcacctttgagtggagggaatcctgcagctcggggctcctcccaccttgtggccttaaggcaggggaaccctccctacaagccaggccctgagcttccagtgtgggtgcagcttttagaagcaggatggactagcaacccctgcacactcatactctggcacccctgcccctgtcatagcacagctcctcagtcacctttgtgtggtctcagcagctactccaacttcttggggtcttgttcctttgtctgttccatgaacataataccatcacggattctgtaggcggctggaagaagaaagtgagttctcagaacatgctgaatcctgggcccagcaccctgtctgtgctcatgaatgttagaagttctaattgttgatttatttagttctctcaataatcctgcccaggtagcacaattgatatcaccaacattttatagatgaggaaatagaagctgagaaggctggggaactttctcatgactcccaggtgtagatctgggctttggccagaggattgtgactccaactcccttcctctttgctggaaaatcttccaaggaatgtgttcaccaggctgcagcctcaggatggggtttggaggggcagatgagcccctgcaggggacccagcctggccatccggaggtagagaccccaggaccctctaacatgttaggtcttacctggcttttcacctgggaaggaaagtgtttctaaaaagcactcagaagacagtaggcttcttgcaggactcactgtgggagccccctttgcagaagtgaccagggctgcccttgacttctatgggctcctccctccattacaaaaaaaaaaaaaattagggccgggtgcggtggctcatgcctataatcccaacactttgggagactgaggcgggcagatcacgaggtcaggagtttgagaccagcctgggcaacatggtgaaaccccgtctttactaaaaatacaacagttagccaggtgtggtggtgtgcgcctgtagtcccagctactcgggaggctgactcaggagaatcacttgaacccgggaggtggaggttgcagtgaaccgagatcatactaccgcactccagcctgggcaacagagtgggactctgtctcaaaaaaaaaaattaaattaaaaagtatgttttatggccatgttgatatcaagatgaatattataattctgggtgaattaaaaattaagattatttttgagatggggtcttgctacgttgcccaggctgtccaggctcaagcgatcctctagcctcagcctcctgagtagctggaattgcaggtgcccagctttgaattaaaaaccaaaactttcttagacactaaaagttcatgttttatcttccgattttaagagacattatagtgttttcgtgggccctgcatcccagcatggggagtgaatgatgaatgatggtcttcccccacccccgcatctggttgttagaacaagtttcctacagcaaatagcctctccacctatgttggaagcacagttattcactcaacaaacaatgagccaaggactgttgtgcccctacaatgaggcaaggactgttcgaagcagcaggggcacagccttgaacaaaatgaagatttggctgttgtgttgctcacattcttctaggaggagtccgaccaggaacgagagaccatgtactgaagggtaggggtgaagccatgcagatgaggtctgaggctctgagtatggttcagaagggcttcctgctgctctacaaatcaatacgcccattttccttgtgccgtcttctacccgcaaagcctgctgcagagagatgaagactggtttgggctggggagactgtcgtccttgcagacatggaagcaccaggtcatttgtcccaagaaagggactgcagccttttgtcctggttcatggtgtctccctcctcttccttgtttgcagaagaaatcactcgcgactcaggagggccatgtcaatcagccctgcctctcagatccaagaagatgatcggggagcccttgtctgcctcatgttatactccctcgttggggacccttttctccagctccagtaagcgctggctgtccataccctgagctccaaggtcatagggcacctctctccctcctgcaccccatctttgtttcctgaagtaagtctgctgggggtcaggagcatgtgcattttggctatctgcatgcagagagccctgagcgtctctcctgtgacacacgagagcacgtgtcttacttcatgctcactccagattgaattggatgggattgcagagcatttaaaggattgaagggcatgtgctgtccaagtgtgacactcagctgtggcagctgaggaaggagccaggaggtgagccactcgcctgcggcggctgtggaaactaagccccacaaagccaaggctggtgagcgatgccgcccacggcgcagctggctccaaggtgccttcgctccatgcgattgcttcacatcctgtttgtccagaagccggagagggagagaaaagagaaagcctgatgacccagtggcggggatcggtccttccagggctgggacggcaagaatggggagggcggaattgggtaattggggccaggcagatgtcacaagtgttaactaagttctcacttgtcacttgggccttggtccacccagagaaatggctggagtgaatgtgtttttcacaattaatgagaaacattcttgtgctgtgggtcttggaagggtagcctgtagccctgggcctggaaaacaaaaaagccacaaggaaaccgagatgccacccctgtgcggcgtgggtgggctgcatcccctcctttaccaaggggcctcactgtgctccctgcctgctctccagggtctttccgcagagttcgctgggttcctcgggctggccatgccgattttgctcaagtcgtctggggtttgccagcggtgccaggatgcacggctgggccctgtcctcagctcactctgagtcctatctccaccaggctccttttagaaggcctttccctctatgcctcagtgaatccctcctacctttggggtccccgtaagtcacctacatctatgcctgggcagtctctctgaattttgggggatccttttccctgccatcgcctggactcattggcagatggtgcaggggtcgagctcacaggctccagtcggctgggccagggtgtggactccatctctgtactccctagcattgggtccccggtaggtgactttgcgcctgtgaccttgctttcctcctttgtaaatgtggggtcacagttctaccttgggagattccagcgaggagcgatgcatggaacgggcttagcacggtgcttggtatacattggtgggttttcatttttgttgagaagcaacgatggaatcaactgtacccagaatacttatactggcaaataatagaaaataatgatgtcttatctcatgaggacactgatggttttccctacaagtctggaagtgagtggatctagggttggttagagtcagggtcagcaaaggttttcatcttcagtaaagtaccagagagtacatattttaggctttgagcgtcaggcgttcgtttttgcctgctgtttagtgtgagagtagccacagatcatgcgttcctgactgtgcatcgactgtgttccaataaagttttatttgcaagaacaggcagtgggctggatatggcctgcaggctgtagtttgttggcccctgggctagagtatcaacagactcgaggctttttcccttccggccccatcatcttgacagtgttgacattttgtcctgaggctctctcatcatggttggcaatgtggctgcctccatgtccacaagcatggaaggaaaatgcagtaggcaaggaggaaggatgtttatctcatcatgtgcctgccttttttggggagaagacacttctgagaagcctgcagcatccatccccagcaggagctgcaggggatgctggaaagggtctaatgtgcagcgttcatggacggaggaaggtcaggcacgagggggctgggcatggctgtggggtccgcaccagccacttctgcctcacctccctgcaacgattgggccttctccaatctgctctggaccatcggagcaaaggtctggtcagacagctttcctggcctcttcagacaatagtagctgtgatgctttgtgaacagagggcgcctacagcgtgcaaagggctggttttggcaatgtaaaggactcaatttctgctttacatcagaaaatgccaaggtaagttcaccccaaaacctgcacatgatgtctctcattatatgagtaatcaccaaagctggaagccaccagatggatggataaacaaattatgctacttacatacagcaaaaaggaatgaactattgaaatgcagctacgtggatgatctcaaaggtattgtgcaggttggaataagccaatgcaaaagagtgcaggagtccattggtatgaaatatctagaaaatgcagttatagtgatgtgagtgggtcagtgtcttgccagaggccggcggtcggagccatgtgactacaaagcggagtttcccagccttggcactactgggtagttctcagttgggggccgtcctatgcatcgtaggatgttgacagcttccctggcctccacccactcaatgccagtagcaactgctcagttacgacaaccaaaaatgtctcaaacattgccacatgtctcttggggagcagcatcaccccagttgggagccactgagctaaaaggcagctcagagagttctttgtggcgtggagctgctctgtatcccgattgaagctgggtaccggcgtctgtacacgcgctagtgcttacagatgggcataccaaaaggggtggattttactgtatggtaacttaaaaactaagacttccaaaagcaacaaaacacaccacagagagacaagcactgagtcccaatgaagaaaccagcaaagccatgacctctgggcccctctacctgcctgtcaggtaggccgggcccctttcccacctggcagctgcagcctgcagagagctcagttattataccgcaggaaagcctttctatcccacccttaaggagaatctcttggagatagaatacaagatgccgagttaaatttgaatttagacaaacaacaaagaatcgcttagttcagcatgtccctcgtattgcaaacattatatgtttatctgaaattcaaattcaatcaggcaccctgtttttgtttttttttttcaaaatctgctattcttgggcaaatctgcaggctttaaaaaaaaactattaaacctctgctaaaatatattttcaaactttctcaaagatacagattttatggttaaaatatgatgcaggtcctgccttcctgcctacatcaatttgttcactcacctcgcccctatgccttacagatgcaggctggctccctagccagtgtgacttgtccgggacatttaaatacaaataatcaaagtaaatagttacgcgcactgactaaatctgatattttataacataaaatgaaaaggaattgttctcctgcaaaataacctttctcagcccttcctggggtattagaacaaaatacatgttacatctgtacacgagcacctacgttagtatgtgctttatatatatatacacataaaaaatacataatatatattaatatgtcttctatattttatatataatatatactatatatattatagtatatatactatatatactatagtatatatgctatatactattatataatataatagtatataatatgtaatagtatatatactatatataatatatagtatatattatatatctatgtataactatatattatatataatataatatatagtataatatgtatatattatataaatttataaatataaataaatatataaatttagatataaatatatattatataatatactataatatgctatattatatattatatataatatatattacatatacaataatatacaattatataatatactatattatgtggtatatactatattatataatatactataatagaaaatatataatatatagtatgtatactatctatactatatatactatataatatatagtatatgtatattttatatctataatatataaaatatgtataatatataaaaacatatatatactataatataaaaatatataatatatagtatattatatatattatatattatagtatatattatatatatatgttttaggtggagtctcactctgtcacccaggctggagcgccgtgacatgatctccggctcactgcaacctctgtctcccgggttcaagcgattcttgtgcctcagcctcccaagtagctgggattacaggcgtgcaccatgacgtccagctaattttctttgtgtttttagtctctactaacacggggtttttagtctctacaacacggggtttctccatgttggccaggctggtctcaaactcctgacctcaagtgatctgcctgcctcggcctcccaaagtgctgggattataggcgttagccaccacacctggcctacatttctttcttcctaggtgtaatcaggctaatttgcatgctcctcctcatttagtggctcatgggagggaactttccttctgttggccccaccagagcctgcgcctgtcttgcctctggagcaccccagagcacacggtagtgctgggctcagtacccgaggcatgaacacgtgttcagtaaatgaatcttcaggcactggttgatgcttcatgatgcaccttctaagttcattaatctcttcttgataaagcactacattctctcttgggttttgtaggtcagactcggctgcgatgactcacctttacacatcttcctttcttggcttgtttagggagtgtgtttgtacagccatggctcttgaccagggatggttttcctcccaggggacatgtagcaatgtctggagacatatttggttgtcatgacatggagaggtgctactggcattagtgagaagaggccaagggtactgctaaacatcccaccatgcccgaggcagccccgatgcccactgcgctggagtgggcaggcccaccatgctggctgtggcctgtctggtgaacaagctttggagccagcgttaaagctggcttctgtgcaggagcagtgggtgcaggagaccatccttcccctaagttgttgagcttgttggaggaggagggtagtatgtgtgaggatcccagggaggccggccctgagcgtggtggggcctggaggaggggcgggcaggagcggacgcgcttctggaccaccactctctctcccagccttgttggttccccacacggcattcagaatgggtctcccaccacagaaccctggccacgtcgccccctgcccaaatcccccactgggctgggagaccccaggtgacccagccccatacccacctcggcttcacccccttgggctcctcactcactctctccagcctcaccccctcgggctcctcactcacgctctccagcctcaccccctcgggctcctcactcacgctctccagcctcaccccctcgggctcctcactcacgctctccagcctcaccccctctggttcctcgctcactgtctccagcctcaccccttcaagctcctcactcactctggcctcacctcctctggttcctggctcactctctccagcctcacctcctctggttcctcggtcactctctccagcctcaccccctctggttcctcgctcactctctctggcctcacctcctctgattcctggctcactctctccagcttcaccccctccggttcctcgctcactatctccagtctcaacctctctggttcctggctcacttctccagcctcactggcctcttcactgtgctgacacacaccgtgtatttctcatgaacctggcatgtgccattccctctgccaggaacatttcctccccaaagcctcccatggctcactctgccctgtacactgtgccccactgtcatgtccctgccaccctgtcctaggttcttcctagtccttgccaccatcagacacagcactgtgcacccctgagctgatctccctcgccagtcagctcccagggtggtcgtgttctcattcaccgatgtgccccagcccctggcacacagtaggtgctcaataaacagttgctgaatgaattaatgaaaaaacaagttagttgttcaagcctgggacacagaacctacgttaggagaggaggacgaggcaaaggatgcttctatctcagtgtttccagatgggaagctcctctgtggccaccagggagaaggtcagtgtgtgtttcatcgacgtggaaatatgtctgcaatatattacgtaaagggcagagtgatatgaaacaggattgacggtgcagtcccaatcatgtggaatggcaccctgtctctgcgtcacgcgtgtgcgatggggccagcctcacaggtgtgggtgaacttagaagggccctgtgctgggtttgcttctgctgcccccaccttgaaatgatgaatcacttttgaacaagaggccccacattttcattttgcaccgggccttgcagattgtatagccggtgctggcgcctggggatggatgggaggtcgctgcccgcaaatgggctctgagcaagatgttccagggcctacgttcttctctgtgatttcctctgtttgcagtcatcaggtattgttttcagagccccctgtaccccaagaaaaagtcagataactgagttcagagtatttcagtccaatttcttccaaatgactatagtcaggcatttgacatttcaaggaataacagggacaaaaagacctagctgttggaagaagttgtcccctccccacccctggggtgctgacctccaagctcatgtgtaggtcccacccccttctggggagctttgaccctagttgagaactgactgtaaacccagacggaagggaggccttgggtgtgtttgcagcacgagagcttgtggttgtcgtggcagagaatgcaggctttggttttgacagaccagggttcgaatcttggccttgccgtggaccagctcaaaggccttcctcactcagagtcttgttcctcctttgcaaagtgaggttgcagcatctgccctggggctgtgttgaggatggggtgggccatgagctcccagtctgctgctggtgaggcaggcatttattgggtaaacagccagacactgcggtaggcatccttactgtttatttatacaaactgtccctctaaggcacagtgagtgggtcattcccacccctgttttgctttttagttttttaaaaaatgtgagatctaattttcctaacataaaactcaccatttcaaagagtgcaatttggtgattttttttttttttttttagtatattctcattgttgtgcagccatcccattgtctgattctagaacgtttccgtatcactccgaaatatcccttaagagccactctctgctcccccaacccctagctctaggcaaccagtaagctactttctgtttctatggatttacctgttccggacatttcatagaaataggatcattcaatgtgtggcttttgtatctggcttcttccatttcgtgtaacgagttgaaggtttgtccgtgttgtatcatggatcagaaaatgactcctttttatggcaaacaatattccactatatggattcaccatattttgtttatccattcatttgttaatggacatcgggttgtttccactttttggccatcataaataatgctgctgccaactcttgtgtacaagtttttcatgtgaacccgtgttttcagttctcgtgggtacacgcctaggagtggaattgttgggtcacgtgaagactacatattaaactttttttaggaattgccagtgtattttctgtatccctttgttgttgttgttgttgaaggtgaataagtgtctgctgtggtgttgttcagcctttaggttaaaaatctgaacctttttccaaacttggtgacaaaggggaagattccatacctgtcctcagagtacctgttccacgtcaggttccagatggctggcaccatgctccctgtccccaagtctctaggaaaggggcaagaacaacccaaaataccagttcagactaagaaatcgaagggtttttcatcttagtggctggggtgggaatgcgggcttcagggctggcttgatccagtgacttagcaatgtcaggagagacccggtctctgttctgccttctaccagggtggcctctttggaaacatggtcacctgtggttgccagatggtggctgtttctgtggctccatctatccctcctccctcaatcgtgtagagagagagagagagagagagagagagagagagagggcaggcttccttctggacactagagtgggaggcttcttttccagaaacctccaggatacttctccttcatttattggccagaatgggtcatgtgctcatccctgaactaatcactgtagccagaggattagttgccttttattaaaccacaggccccacctctaaggccagggtggaggctatgtaaggcacaactgccttaatgaaaatccggttggctatcacggaaaggggggacagatgagtctcatggcatcatccccattttacagatgaggaaattcaggccccagcatacaacttgcctctctcagcccacacaggctggttagtggcagatgcgggtttaaacacccttgagactcacttcttgcccctctgtcctgacatttctcagctgaggctgtggctccctggatgtggctgtcctgacagctgcccaaggcaagccagacaccttcactcagaggtacagagagactttttgcagcgcgtggatttaaggtatctggaacagcatcagcttttcaggccaggcatttttattttgccctaaaagccttctagtgggggaaacacaattcctaggggctcagctttaatggtttcttttatagaaccattcaaattatagatgggtgaactccgggaaaccccgctcaagaatgcaggaaagccaaacgttaaagggagttaaggtaaaatagcggcgggtgggggaaaatttgttcttttaaacactagttgttaaaaaaccaaagtgaaccccctggtgctgatctggtcctgggaggctgggtttcttgacttctggcccgtctgggggactccaggtgaagttaattccagatgtgaacaggcccatcgcttttgctggcctctgacccctcccatctaacttgggggcaccgtatctgcagaggctcagcctcccaactccccgtcatcctcacctgggttcagattctactttgttgcttccaagccgggtatccctgggcgggttattcagcctctctgagcttgtgctgtcatgagtaaaacaggctttgtttccactggatgctttatttttggctttgaaatactcatcacccccagacatggtattacatatatatttgccaatgacctcatcattgtcaaagccagtggatagatagtgtgttcttaggtccatctgcagagcaacggacacggagtttgctccctctattttcctcccctgttttccgggaccccataccctgttggtgtccccattcttcctgcccaagcgtcttccagatccttccttaccgggtactcctgcacagtctccgtttcattcccctgacctctcagtggaacacagaggccaccttcacattgcttgtcaggctgtacacactttccccaggcgagctcatccagtcttctggctttaaatgccatctctacactggggacacccaagcttacattactgtctggaccactgccctgagctagcatttattgagcacttagggtatgcaaagctctgtcctgagctagcatttattgagtacttagggtatgcaaagctctgccctgagctagcatttattgagcacttagggtatgcaaagctctgccctgagctagcatttattgagcacttagggtatgcaaagctctgccctgagctagcatttattgagtacttagggtatgcaaagctctgccctgagctagcatttattgagtacttagggtatgcaaagctctgccctgagctagcatttattgagcacttagggtgtgcaaagctgtgtcctgagccccagctgtgcattaagtgacagaggcagggctttgaacctgcctgggccctactccctccctcactagcccagagctcatctcttccaactgatcaattgatcaagcctaggccagacctctgctgcccacctgacaccttccttttggtgtcaagtagggatttcatacaatatctgctaaacgaaactgcattttgtcttccaccctctatttcccagcttatgctccattgcctcagtttccctaccttggtaaacagtccctcccttcttccaggggcttgggccaagagcatgccagtctcatgagactcccctttttctcacaccttttataatcccttcccaaattcagtcctaaatctgccaccttcctggtttggaggctgtgttcttgttattcgagacatcacctttgggggaaactggatgaagggcacttgggacctccctgtacatcgtctttcaacttcctgtgaatctataatcatttcacaacaaaaagttaaaaccaaaataaattctaaagattttaaaaatgaactcttgaggatctggccttttctcaccagcctccctccccactgccctgggtccagtctcacgtcacctcccacgtggaccattctgttgcctccacctggtctccctgcttccaggttgacccctgccatcggctctccaggggcagcctgagtggccttataaacaccactgaaagtcccaccccagtggttcttgcttcttgtagagcgccttggtgtcctgaccagggccctggatgcgaagtcccactcactgggtggcttgaaacaatagggctttattgtctcacagtctggaggcgagaagtctaaagtcaaggtgccacagggttgtcctcttacaaaggctctagggaggaatccctccttgcctcttctggcttcagaggctcctggcaatctttggcatttcatggcctctgtcttccccaggctgtctgcatctgtgtctttatgtggccttcttatggggacactagtcactggattaaggctcatcctaatccaggatgagcttattttaactgacgacagcacatctgcaaagaccctgcttccaaatgaggtcacatcctgaggctctgtgtgggtgtgaattttagaggacatcagcaacagaggacactgggctgaggcaggtgctcgtgttgcccataggacccgacctgactcgtgcccctactgcccctcccagttgtccctgctacttgcccctgccccttgaacacaccctccttgctcctgcctccgggcattcacctctgcagttccctctgcctggaatgcactcttcccaaacatccattgggccccctcactcactgttacccagatctctgctcagatggcccctatagtcattagggttgtttgcaattgttcccaccttccctggcacggagcaagattgccccccaactccctgaaattaggcagataccacgacctgctttggccaatggaatgtgagtggcacttatggggttcgctagcttgccaccttccgcacccctcagcctggttccccaccccttatatttcctgcctgccttccccacttgcatggaaacccagagaacaggatgttttcttggctgctttcgcagttgtgttccaagttccttaaacagtacctggcctagagtgagtactcaataaatacttactggatggaggaataaggagttcatgaatgaaccgggaggcatagcatctctgcagccctgtcccgctcgtggccctcctgtaactactcttctgtgcacttggctgcttcctgtccagggcagagcatcaaccccaagttggcgggcctgattgggcggcacgggccccagaacaagcagcccttcatggtggctttcttcaaggccacggaggtccacttccgcagcatccggtccacggggagcaaacagcgcagccagaaccgctccaagacgcccaagaaccaggaagccctgcggatggccaacgtggcaggtatgcttaggtgggagggatcacagacccaccacaggaacccagcagggccccggcgggacccggcaggagactgactcaaaatccattcaggtgctcaccagatggctctggaacaaatacagcaggaagaaaacccccaaatccacccctacacaggacatcttaattctgtaaaaataaactagcttagaaatgcaagtagcaaaacattcgtataacacaacaccaagcatgtagatatttaaataaacagaacaatggcggcacttgcagctacacagagatgaaggaagaccctgaaacatggatgggaagacccctggggggcttaccccatggaaggagggggaggaagaaatggggaggtagaagagtttgctgtatctttatttcataaatgaaaaatattttaaattcatggcaaactttaatacttgataaatattatatatatacacacacacacacatttttttttttttgagatgaagtctcactctgtcacccaggctgcagtgcagtggtgcgacctcggcttactgcaacttctgcctctcagattcaagtgattcttcagcctcagcctcccgagtagctgggactacaggtgtgcaccactgtgtccagctaatttttgtatttttagtagagacggggtttcaccatgtcggtcaggccggtctcaaactcctgacctcaagtgatccacctgccttggcctcccaaagtgctgggattacaggcgtgagccactgcacccggccaggtggtaggtgttttaagaatatatgatgtgcgatacttttcagtttgtttgaaatgtttatttacgataggttttaaaaaaattaaagataatatttttattgcaagcaaatcaaacattaacagtaaatataagtaaagttaacgcattgtgcgaaggagacttccaggaggtcgtgctctgcaggtcctctaaagcagacagcttttagcccatcatgttgtgtggttcttgaggctctgaggtagatggcctcccacttcacagaggggaaaactgaggctcaaagagggtaagtcgtttgtctaagggcacagtgtaggtaactggcagccctgggattgggtccctggggtctgggttgtcccttgccccaggccctcttccctgttgggcattgccggggccatctacctggcctggatgagcttcggtgtccccagcaatcccattgggtgctttctgacaattcaccaggcattcgtggagcccccacaggagcctggctttgtcccgggcactggggctgtggctggggtgcaatccctttccccataggctgattgggaaaccgacattgacagcctctggtggcctgggggtgctgggatccccagaaggtgcattctggttttgagctttggaggtgggctggcctggagcagccctgctggcaccgtgggcatctgtggacagccctcccacaccccttgcctggctcatgccccctgcacatgcagtgtcaagtccgccagaagatgcatcgggactcctcccagactaaaaccaaagcttcaaataatgaacctcacaacaaaccattttccagtggactggaggggtgacacctcccagatccaaggagcccagtttgctccccatccccaatcccatcccgccggccaggggagctgctgcccgggggtgccgtttctctggctcttcaggaagccatttgcaatgagcagggcaatagcctctccaagatgccagtgtcttaatctctggaacccgtgaatgtgtcaccctccagggcaaaggggagttacgactgcccttggaatcacaggtgctaatcagctggccttccaatacgcgggctctgtgtagcagggtggtcccatcagtccttataggagagagcctttttgagctgtggttggagccatgtaagcacagagcacagaggggtggagatgagtggggccaccagccctgggatgtgggtggcctggagaagctgcacaaggcaaggaagggatcctcccctagagcccccagttgcatttacctgctaagactggtgttggacttcagagccacagagctataatccgcttgtattgttttgataatttgcttggttaatttgttaaagcagcgataggaaagaatacatctttgttggcaaagtgattttctttttcttttttcttttcttttttttttttttagagacagggtctcacgccattgcccaggctggcgtgcagtggtgtgagcatggcttactgtagccttgacctcctgggctcaagcaatcctcctgcctgagcctcccaggtagctgggactatagatggatgccaccacacctggctattttttgtagagacagggcctccctatattgcctaggctggtgtcgagctcttgggctcaagctatccttccactttggcctcccaaagtaccgagattacaggcatgagctactgcccccagcctcctcagagtgcttccctcatcctgctaaggagctgggacacaaccatctgggggccggctcaggagttgcagccttcttggctccaggttgatcacaaggcagaaaaaggtctgaggtgcaaacctgccctgccaccatgtgggaagctattagctgcttatcacctccggggcctgcggttggtcccaggaagcacccaaggggagcaaggggctattgagaaaggtcctggcgaggggatagcagcagccccacccccaaattaaccctctagtgccaatagcttcttcctccttacctagcctagcttgaaatttatgttcattttacttttcaagggagaaggcaggtcagtggggttggtggcctttttaagacaaggcttcctgacccctggcgggtgtcctggggcccccggatggacctcagtgggtctgtgtggcccagagtgtgtagggattccgtatattttcttttctgacagtggatccatttttccaggtttctcaaaggggtctttgatctcccaagtcaaaaaccaaccaaattccttcatttgtattcgaagcctcttttatgctggactcttgaaggctaggattcaatgtcgaacacccacacaaaggctgcccttgggggtgttaatttaggacaggaaggagggggttgccattcacatccatacatagtaacagacccagagtcagggtggtgcctagggaacgcagcccatcccgagggctgcagacaacatttcgtggcgagcgagctgagagctctgggtccagtgggtgcccacgaggccaggctggtccggagaggatgctctgggctgtgggacctgcaggggcagaggcctgtgctgtggggtttcctggcgcctttggggagtggggaggaggctgtgggggctgaagcaggggaggggagtgagggtgggcgggtcaggcattctcttgggagtcacgtcttgagtttgaacttcatgccaagcatgttcagaagtctttgcagagattcaagctgtggtgtggggtgcaggtgataagatcattctggctgctctaagaaaggtgaggaacagggtgggtgccgagggggtgctcggaggccggagactccttagaggatgtggcagatcatccaggcaggaagtgtaggcaaactgcatcccggcagagacttccgtgtcttggagctccatcgggtgcacctgggtaatgagggggagaggaactaggcatcgcgggcttagaattcactctgattttccccaccgcctcctcatcaaagccccaccaagtctccatttacacagcccccaggacggggctctcactgtttcccgtggcagaaattcattgctgggaacctgcctccttcccgcggatggctcgtggccctgtttgcagctcttctaaaacctgcctggaagttaagaaaaaaataaaataaaaataccgaggcctgggccccaccctaggcttaggccagagtccttgagtgtgagtgtgtacgcctgtgtgcctgcccctttgaatcgctcgtccccccggttttgggctggagccctgccgtggagccacacaagttgaatctctcggcagccctgtgtgtgctggggcgggggcacatgctccggcacgctaccccacgcggagctcgctttcctgcccgccagccccctcccccggggcttcacgtgctcttcagatggtgcggtttggggttgagaaactgggtccctgcacttccttctccccacccacgtttggacccagctccctggtaagcagccgcctttgccagatgacccgtggaggcgggagctgagcctaagcaccagtcctgacttgtctgcggcccaagcagggggttgaggaggtggatgaatcccggtgctggcgtcagggctgtctcctgctcactttctgttgcttgggggcgggtggggcaggcttggacggacaggggagctgggagtccctccttcgtttcctttccttgttttcctgctaataagtcctaaggatacacaggagctccggccactttctgctgggacagccgtgatcaaagagccctggaagcacagagcagggtctggagtccctggtggcagggccagtgcccacgcctcactcgtacaccataactagcttcatgagctgtgctcggccttggtctgtttggccttgggtttgaactaagttatgccaaatgtcgtggctttactttaagacagggttggggaaagtagcactcaggccactccttgtcccttctgtgctcatgacagacattgctaatagatcatggcctctcctgtgctcatgacagacattgctaatagatcatgggacttccttctgacggagcctgaacacagcttcagaatcctccttgactcaggacaccaaggagtcagcaatgtccctggctcgagctagcagcttcacctgacacatccctgagctgaggggatgttccttctcctccaccctgccttctacccccccacagggaagagggaggaggctcgtggaggggcatggctacctgtggccctgggcattgccacagccatgaaggccatcttaggtttctgcttggcatcgtgtgctctagagggcaggctgtagagtccagctgtttgggctcctcccagatggttccttgaccttgaccttcctgtgttgaggacaccctggccctggggaggttcctgctgccccagagctggttctctctctcccagccctgctactcccccacggagggtggggaccaggggcctctgggctccccctggctgcctccatccactctgagcacccccttgcagcattgagccttggggctggttccagccacgcagatcttccctccgcccacactgtctgctgacccaggccccagcttcctcattccttgccaggctcagtgcctgcctctgatcctctatccgatgctactccagcggcctcagacatggagggcgcctcgtccccactgctcagcatcgtcatgcaggaatgcctcgcccttggatgcctccccaccctcctatctcacttccttttggttcttacccacatgtcacctcctcagaagagcgcctgctggcacccgcggcagcatgcccgctcactccagcttctcctgccttgttttcctctgtagccctcatctccgtgtaagtcatgtgcactcacttatctatgacccgcctctcgttctggaaaagcccctgagtggcagggctttgctgtcttacacctgggactcatctcatgcctgcacaccaggaagcagcccctagcaatggctgaatgaatgagtgactccacaaggcatgcaggccgcgagggcagggcacccaggggcaagcgctcctgccccaaagcctggagcccaccagccccgccccagccttcagcgagttcacttcaccgaaagtctcaagtgtctcctcaggaatcacacatgtgattcggttataatcaattaaatgtaatttcgttattggtgtgcatatctttccacattgcttttctgaactgtagataaattttatatctgtataaatagatatattcaaaaatggcattttgggaggccaaggcgggtggattacctgaggtcaggagtttgtgaccagcctggccaacatggtgaaaccccgtctctactaaaaatacaaaaattagctgggcatggtgatgagtgcctatagtctcagctactcaggaggctgaggcaggagaattgcttgaacccaggaggcagaggttgcagtgagccaagattgcaccactgtactccagcctgggcaacagagcaagactctgtctcaaaaaaaaaattgctgatgaaaataaaagcagcctgcttttcagtccccagcagggagcatggtgctcctgtctcagcctgagccttggaggccagttcctgactcctgtgctctccatgctgttctcctctctcctgcctccttcctcctcaaccctcttctttctcctttctgctttccactcttggcttgctgcttctagcccatttcattccacaattgttctcagccatggggtagctaaggcacactgaaggtttccaggaccaacagaatgtccagtctgtgtctgaggaggtgtcctaatttgcagtgtgtggtccatgggaggctagcttactgcaccactcctgtcccacccattttacagatgaagaaagtaaggcttagggaagggagttcggcgatgtccttcttatcttaccatttctcattatcctagaagctatgcagatagaattctcatgaatcagagaaaagccaaaaattgagtggtgttccactctttgacatataccctaatggcatgtagtgggtgtggaggaaagagccatgcattcaaacagttaacaggtgtgtgtgtgtgtgtgtgtgtgtgtgtgtgtgtgtgtgtgtgtgtgaatggagaatgtgcgtagtttcaaatttccctaacaagtgggctagaagaagaagaataaaatatgaaactgccatgaacactcaagcctaccccaggaggtataggagctctcttcattttgcaaaccaggagtccaagatctaggagagctggggtttgactccagagctagagcagtccccaagacctggtcttgactcacgagttagactccactcagaggctgactgtgctccagggtctacacctctaagggcgacacctgggctcaagcagactgccgttttctatatgggatgagccttcacagggcagccagttgggatgggttgaggtttggctgtagacatcagaaacccaagtcaaatgcgcttcaaccagtagaaaattcaccagcccgcagagctaaggttgggtggacattagggttggttgatccaggagctcaacagtgtcctctgagccccagctccttctgccccaccccaccatcttcagtgctgcttcctctcaaggccacagctgtagttggccaggggggcttcattattttttgctcctgggcagtaggaggaagagaatgaatgtctctccatgggtctttcttaggaatgtgggaactttttccagaagtctctatgtcttttagtttgtgttgggtcacttgcccttcctgaaccacttcctgactcctggacaggatgtgcactgatgagcttagctttggggatctaatagtgactttacaaagcctctttgagaaggtgacattggaaccaaggcttgagccagacacaacaaagattgcagggaggggcattgcaggtggaggaaacggcacatgcaagagccctgcggtgggagtgagcttggtgtttggtcaatcagttgtcagagcacaccgggccctgtgggccacaggcacagcctgggccctgctctgagtatgacagagagcccctgggaagttgtaggtggaggaaagacaggtcatgactaggaaaaaagcaatccctctgttgtggggtggaaggaaggttgcagtgtgtgtgagagagagacaagacagacagacagacacttctgcaatgtttacaagtgctcaggccctgacccgaatgcttccaaatttacgtagttctggaaaaccccctgtatcattttcactactcaaagaaacctcgggagtgttttcttctgaaaggtcatcaggttttgactctctgctgtctcatttcttcttgctggtggtggtgatggttgcttgtcccaggccctgtcccgcatcctcttgcccctgcagagggatgagtgtgttggggcctcacgagttgaggttgttcataagcagatctctttgagcagggcgcctgcagtggccttgtgtgaggtggatggggtttgattcccttatggaatccaggcagatgtcagcatttaaacaacacacgtgtataaaagaaaccagtgtccgcagaaggttccagaaagtattatgggataagactacatgagagaggaatggggcattggcacctcccttagtagggcctttgctgggggtagaaatgagttttaaggcagttagaccctcgaactggcttttgaatcgggaaatttaccccccagccgtctgtgcttcattgctgttcacatcactgcctaagatggagggaactttgatgtgtgtgtgtttctttctcctcactgggctctgcttcttcacttccttgtcaatgcagagaacagcagcagcgaccagaggcaggcctgtaagaagcacgagctgtatgtcagcttccgagacctgggctggcaggtaaggggctggctgggtctgtcttgggtgtgggccctctggcgtgggctcccacgaggcagcgggtctgtgctcagtcttgtttctcatctctgccagttaagactccagtatcaagtggcctcgctagggaaggggacttgggctaaggatacagggaggcctcatgaaatccgagagcagaaatgtggttgagacttgaacttgaaccaggaacccaaacactttggactctgaaccccattctctgcatgcacctcattcccatcccttggctggctgcttctcaagatgatgccgggccgtgtgtttgaatgtagatacctggggagccatctccccctctgccctctgacttcatttaccccattcccattcccacgggagggacggatctgcccagcttggttcaggcacttgttcctgaaccagtcaactgtttcaggggtggggtcatgttactggcacatggctgccccctctggagccatttgcatggagtgaggcaaaaggcaggggatgaatcctaggagaggagtgagggtcatgtgatccacctgccgtgagctctggtgtgattctcattcagcagtcatgcagcatctgcagcgttctgggccctgttctaggtactggattggagatgcagcgatgaacactgcaatgtgtctgccctgtggggctcaaatatccctggagagggtattgtcatgaggtcatcagggcaactggtggtattctaccctcagggagcttgtagttcagtgggagagtccagaatcttccctggggattatgcccagacacactcagggcgtacgtgcacacagccagctctgagccctcctgtgagcctgccctcaggactgatgaccacatccacctgcagctgggacagaacccaaactccaggggcctctgctggaagattccatgtgcttaagcatcactgaggagtatattgattattgggcaacatttctgtgccacccagaccctagaggcaaggatggcacatggatcccttactgaccagtgcacccggagccagcatgggtgatgccattatgagttattagcctctctggcaggtgggcaaaccgaggcatggaggtttgtttaaggtgaactgccagtgtgtgaccacctagtgggggtagagctgatgattgcctcacaccggaggctccttcctgtgccgcgttctgtccagaagacacagccatggatgtccattttaggatcagccaagccccgtggggctttccttcatttttattttatgtttttttagaaatggggtcttgctctgtcacccaggctggggtgcagtggtgtgatcatagctcaccgcagctttgagccgtcttcccactcagtctactaagcttggactataggccaagactatagagtggtccttctttccattcttttgggaccatgagaggccacccatgtttcctgcccctgctgggccccctgctgctcagaaggcatggtctgaggcttccaccttgggtcgtgagcctggcgtggtggtttctggccagcatgggggttgggatgctgtggctcaggccttctgcatggtttcccacactctcttctcctcctcaggactggatcatcgcgcctgaaggctacgccgcctactactgtgagggggagtgtgccttccctctgaactcctacatgaacgccaccaaccacgccatcgtgcagacgctggtgggtgtcacgccatcttggggtgtggtcacctgggccgggcaggctgtggggccaccagatcctgctgcctccaagctggggcctgagtagatgtcagcccattgccatgtcatgacttttgggggccccttgcgccgttaaaaaaaaatcaaaaattgtactttatgactggtttggtataaagaggagtataatcttcgaccctggagttcatttatttctcctaatttttaaagtaactaaaagttgtatgggctcctttgaggatgcttgtagtattgtgggtgctggttacggtgcctaagagcactgggccctgcttcattttccagtagaggaaacaggtaaacagatgagaaatttcagtgaggggcacagtgatcagaagctggccagcaggataatgggatggagagatgagtggggacccatggggccatttcaagttaaatttcagtggggtcaccaggaagattccatgtgataatgagattaacgtgcccagcacgtggcgacactcagtaggtgttattcctgctctgccaacagcaaccatagtgataagagctgtagggattttgttcttttgcttagaatccaaggttcaaggaccttggttatgtagctccctgtcatgaacatcatctgagcctttcctgcgtactgatcatccaccctgccttgaatgcttctagtgacagagagctcactaccaggactactccctcctttcatttagtaatctgcctccttcttttcttgtccctgtcctgtgtgttaagtcctggagaaaaatctcatctatccctttcatttgattctgctctttgagggcaggggtttttgtttctttgtttgtttttttaagtgttggttttccaaagcccttgctcccctcctcaattgtaaacttcaaagccctacttgggattgaaggtccttaggctggaaacagaagagtcctccccaacctgttccctggcctggatgtgctgtgctgtgccagtatcccctggaaggtgccaggcatgtctccccggctgccaggggacacatctctatccttctccaacccctgccttcatggcccatggaacaggagtgccatcgccctgtgtgcacctacttccatcagtatttcaccagagatctgcaggatcaaagtgaattctccagggattgtgaaatgatgcgattgtggtcatgtttaaaagggggcaactgtcttctagagagtcctgatgaaatgcttccagaggaaatgagctgatggctggaatttgctttaaaatcattcaaggtggagcaggtggggaagggtatggatgtgtaagagtttgaaattgtccatcataaaatgtgtaaaaagcatgctggcctatgtcagcagtcacagcctggaggctgtgaacagagtgccagtcactgatgctcttgcctggcacctacagttgctggaaacccagaagtttcacgttgaaaacaacaggacagtggaatctctggcctgtcttgaacacgtggcagatctgctaacactgatcttggttggctgccgtcagcttaggttgagtggcggcctcttcccttagtttgccttagtccccactattccctattgtcttacctcggtctattttgcttatcagtggcactcacgtggcactcataggcatttgagtctatgtgtccctgtcccacatcctctgtaaggtgcagagaagtccatgagcaagatggagcacttctagtgggtccaagtcagggacactattcagcaatctacagtgcacagggcagttccccaacagagaattacctggtcctgaatgtcggatctggccccttccttccccactgtataatgtgaaaacctctatgctttggttcccttgtctgcaaaacagggataatcccagaactgagttgtccatgtaaagtgcttagaacagggagtgcttggcttggggagtgtcacctgcagtcattcattatgcccagacaggatgtttctttatagaaacgtggaggccagttagaacgactcaccgcttctcaccactgcccatgttttggtgtgtgtttcaggtccacttcatcaacccggaaacggtgcccaagccctgctgtgcgcccacgcagctcaatgccatctccgtcctctacttcgatgacagctccaacgtcatcctgaagaaatacagaaacatggtggtccgggcctgtggctgccactagctcctccgagaattcagaccctttggggccaagtttttctggatcctccattgctcgccttggccaggaaccagcagaccaactgccttttgtgagaccttcccctccctatccccaactttaaaggtgtgagagtattaggaaacatgagcagcatatggcttttgatcagtttttcagtggcagcatccaatgaacaagatcctacaagctgtgcaggcaaaacctagcaggaaaaaaaaacaacgcataaagaaaaatggccgggccaggtcattggctgggaagtctcagccatgcacggactcgtttccagaggtaattatgagcgcctaccagccaggccacccagccgtgggaggaagggggcgtggcaaggggtgggcacattggtgtctgtgcgaaaggaaaattgacccggaagttcctgtaataaatgtcacaataaaacgaatgaatgaaaatggttaggacgttacagatatattttcctaaacaatttatccccatttctcggtttatcctgatgcgtaaacagaagctgtgtcaagtggagggcggggaggtccctctccattccctacagttttcatcctgaggcttgcagaggcccagtgtttaccgaggtttgcccaaatccaagatctagtgggaggggaaagagcaaatgtctgctccgaggagggcggtgtgttgatctttggaggaaaaatatgttctgttgttcagctggatttgccgtggcagaaatgaaactaggtgtgtgaaatacccgcagacatttgggattggcttttcacctcgccccagtggtagtaaatccatgtgaaattgcagaggggacaaggacagcaagtaggatggaacttgcaactcaaccctgttgttaagaagcaccaatgggccgggcacagtagctcccacctgtaatcccagcactttgggaggctgaggtgggcggatcatttgaggtcaggagttcgagaccagcctggccaacatggtgaaaccccatctctactaaaaatacaaaaattagccgggcatggtggcacgcacctgtaatcccagctactctggaggctgaggcaggagaattgcttgaaccccagaggtggaggttgcagtgagccaagatcgtcccactgcactccagcttgggtgacaaaacaagactccatctcaaaagaaaaaaaaaacagcaccaatgaagcctagttctccacgggagtggggtgagcaggagcactgcacatcgccccagtggaccctctggtctttgtctgcagtggcattccaaggctgggccctggcaagggcacccgtggctgtctcttcatttgcagaccctgatcagaagtctctgcaaacaaatttgctccttgaattaagggggagatggcataataggaggtctgatgggtgcaggatgtgctggacttacattgcaaatagaagccttgttgagggtgacatcctaaccaagtgtcccgatttggaggtggcatttctgacgtggctcttggtgtaagcctgccttgccttggctggtgagtcccataaatagtatgcactcagcctccggccacaaacacaaggcctcggggagggctagactgtctgcaaacgttttctgcatctgtaaagaaaacaaggtgatcgaaaactgtggccatgtggaacccggtcttgtgggggactgtttctccatcttgactcagacagttcctggaaacaccggggctctgtttttattttctttgatgtttttcttctttagtagcttgggctgcagcctccactctctagtcactggggaggagtattttttgttatgtttggtttcatttgctggcagagctggggctttttgtgtgatccctcttggtgtgagttttctgacccaaccagcctctggttagcatcatttgtacatttaaacctgtaaatagttgttacaaagcaaagagattatttatttccatccaaagctcttttgaacacccccccccctttaatccctcgttcaggacgatgagcttgctttccttcaacctgtttgttttcttatttaagactatttattaatggttggaccaatgtactcacagctgttgcgtcgagcagtccttagtgaaaattctgtataaatagacaaaatgaaaagggtttgaccttgcaataaaaggagacgtttggttctggctctttggcctgtgtctgtctgtgtgtgttgtgtttttctctcagttcttggacactgaagttctctcacactgctaagagctccctgccttcgtctccaccgtgaacgctctgtttagcatccaggccttgcggggaagtggccgctcgtcaatatttggtgcagctgtgtggggctccgggcaggagagatggaaccaagcaacacatgtgaatttggtaggctcgactacaaaggtccttgattgaattaca

SEQ ID NO: 11991 - DNA, 35256 bp, Human
aggcaggtggtgacacagagcagcccatagcagaaggaacagcccaaatatgggtgatatgaccatatttatacttcagacctgcactgcctaaaatagaagccaccagccatgcctttactgagtacttgaaaagtgcctggtacaagttgagatctactctaagtatgcaacactggatttgaagatttaggattaaaaaacaaacaaacaaacaaaaaaacagcagctgagcacggtggctcatgcctgtaatcccagcactttgggaggctgaggcaggtggatcatttgaggtcaggagttcaagaccagcttggtcaacatggtgaaaccccatctctactaaaaatacaaaaattagctgggcgtagtggcgcatgcctgtaatctcagctacttaggaggatgagacaggagaaccgctgtagcctgggaggcggaggttgcggtgagccaagatcacgccactgcactccagtctgggcaagagagtgagaccctatctcaaaataattaattcattagttaattaaataaaataaattagccaccacacctggctaatttttaaaattatttattataaataaataaatctcattaatattttttatattgattacatgttgaaatcatactatgtattactaaaattaatttcagctctttctttttatctttttaatgtatcttctggaaaatttaaaattacatgtgtggctctcattctattgctttagaaagacggctggtttatatgttacctacatatgcacatttgttctagttccatgaaaggaactggccacactctcttaccctggcttttgtcactgaagtatcttaaatatctctttctatgggcatatgactatctacctcattttttttcacttttttgaatgtgcttttaaaaattgataggaaattcacggaacataaaattgattatttgaaagtatacattcagtggcatgtagtacattcacaattttgtgccatgtccacccctatctgactccaaaacattttcatcatcccaagagaaaattccttacccattaaacaatcattccccatttcccttcccccagctccagacaaccaccactggggttggagactcctggaatagaccacattttgccccattgttctcaaaggctgcataacattgggtgcccacagcttattcaacctgtcgctgctagcggacatgtaggctgcttcctttttttttttttttttttttttttgctactgcctatgatgcttcagtgagctgccccacaccacgcgtatatcttggcaggaagagctacgggataaaggcttagaagttaaattactgggccaaagagtatgtatgttagaacgaggagagatctcactgatttgtgtttcagaaagcttgtgccaatgtgcactctcccagccacagtgtctgggacttctgtttactcgtacattcaatagcattgagtactaaaacttcaaaagttttttttgaatctgataggcgagaactggtgtcattgttattttcatttttaatgacttttacatgcttattttgtactgcatttcctgttcatatctttttttttcttttgagttgttctttctttccttgttaatttatattggcttgttctttgtatattagggaaataagctcatatattaaggaaattggctctttagatgtctcatactgcaattttttttttactttacatatggcattttttttgtccactgaagttttaattttctatgccgacaagtttatcaaggatttcctttatggcttatgagacttggatattgcctagaaaggccttcatccagccctgcctggaaatactggatctgggctttcttctagatcttttatggctttatttgttattcttaaatctctgctcagctccatgtatttggaggtcagaactgagccttctattttccccacaaatggtggcagacccctggtctaggaactaaccatggcttctcttacctcctccagcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtaggtctccatcggggcactgccagctggactcctggttgcagctcccggccaatccagcgctcagcctggcctccgataattgcaatgatccaggtggcttgcacaggcacttgaagatcattctctggggaaccctgttgagatgaacagacttaagccaggaatattggtgcatcattttcattaaaaaaataaactttcattcacctgacaaggggacccttgtcaggtgaatgaaatctggctatttggaggaacacagaaactttggttgaaggagagtttgcgaaaaacatacaagtccttggacaagtcatttcatctcttctagtctcagtttccttgattagaaaagtgtgaccgggtgtggtggctcacgcctgtaatcctaacaatttgagacgccaaggcagaaaatcgcttgagctcaggagttcaagaccagcctgggcaacgtggtaaaacctgtctccacaaaaaaatacaaaaattagccaggcatgatggcacatgcctgtagtctcagctacttcaggggctgagttgggaggatggcttcaggccaggcgacagaggttgcagtgagctgagattgtgccactgcactccagcctgggtgacaaggtgagatcctgtcccccacccccccgcaaaagaaaagaaaaatgtggattctcaagccgcttccccaaatctgctgaatgtgatcatgcgattgggtgccgcaggcactgggaagccagacacaccgaatcaggctggatgtgctgggacacagcagggcgccgggaaggggtggagagggctccctttgtggactggcctgaccagggaccagggcctggctttcccaggcacccggccatccccaagttcagtggcagactgtgcttctctccccaggtggctgttgaacctcttccacaaccagattgagtccaagttccagaaagtactggagagcagggtaagaaggtccaagcctctggcctcccccgagcttggcgagggctgaatggaagacctcactgaccaatggccctggaccaggccatgggggctggtttagacgtacttgggcccaaagcccagggaggacaaatcatttgcccaggtcatggagctgttgtggggcacgctggggacaaagctccaagtccgttcggttgggcagaaaatggtcaactgcttgaccaagggttaaacagcaggggctaaacagagactccagcccctccctctgctccaccttgctcagtgccccacactgccctgcattccaccaaggtccgaaaggaaaccattcctcaggcgcctgcaagagaccaggcaggaaagctcagcgagggcgtgggccaggtgggaactgggcgagctcatgagcaccagccctggatggggaggcagcaacactgtcagactggcctgttaaaaaggagtatgtgaaatcttcagagtgtatcatctttgactaaatcaaaaagatgtcgtgttaactttcagttcctctaaacactcattcatcccaaaatcccgtttctgagatattagccaaatggtatctgtagcaatgactgtgggaagggagaaagtgatggaggaggaaagggaaaaaaacacacacacaaacacacacacaccacaccccacacacactccctcccagcacacacacaccacacacacatcctacacacaagcaccccccacacaccacacacacacaccctccacacacacacccacacacatcccacacacacacacaccccacacacaccctccacacacacccccacacacatcccacacacacaccccccacacacaccctccacacacacctaacacaccacacacatacacagcacacacatcaaccccctcacacacaacccacacaccctgcatcccccccacattcacccctcacacaccacacctcccccatacaccctccacacacacccccacgcacataccacaccccacacaaacacaccccacacacataccataccccacacaaacacacacaccccacacacacaccctacacacagacagcacccacacacaccacacgcaccccctacacacacaccacacacaccctacacacacaaaacacaccacccacagaccacccacaccccctacatgcacacaccacacacaccctccacacacacacaaacacaccacccactcacaccccccacaccacacacacgcgcacacacacacacacacacacacacacacaccctcgtctgtaggtccaacctctggtttggctttgagtgccccctcgtggttgaaacaggaacagcaggcaaaccccgcattttgggtgtggccagctgtgctctttcttttctggttctgggtccctgggattaagtgaccctgagaaatatgccaatctactcaggcaccctgttgccatattgctgtgcataacaatagtaatgtagcacaattataattatcacagtaatcacataccataattattgttttgataaatgtatataattaatgctgtacagaatatattattgtataactattctgatttataacaaaaatggctgctatttcttgagcctgtagcttggccagggataatgggctcagcagttcacgtgcacagtccctctggatctctctttttttttaattgagacagagtctcactctgtcgcccaggctggagtgcagtggcgcgaccttggctcactgcaacctccacctcccaggttcaagcaattcttctgcctcagcctcccgagtatatgagaccacaggcacgtgccaccatgcccagttaattttttgtatttttagtagagacggggtttcaccatattggccaggctggtcttgaactcctgacctcatgatctgctcacctcagtgtcccaaagtgctgagattacaggcgtaagccaccacacccagccagtcccattggatcttaacctcgaccttggaaggaggtgccattttccacatggacagaggaggctgaggggtggagtagctttcccagtgtcaccttgctggtgagaggctgaatcaggattggagcttcctagaatgtggagcagcttgtaccaaagcccttctagggctaggtgtcttgggaaagatggagatctcacctgacccctgatccttagagatcttcgaattatcttccagaaaaactaagagcctgacgcaggcctttctaattccccactcagggtgggatgtggtacctggaccagcaaggctaaggagaagaataagcactcacgaatgcttgctctctgggcgatatatactcactatctctatccccaacttcccaaaatattaccagaaaggggtcctgatccagaacctcaagagagtgttcttggatctcacgcaagaaagaatttggggtgagttcataaagtgaaagcaagtttattagagaagtaatgacggaaaagaatggctactccacaggctaagcagcaacatgggctgctcagtcgcgtatacttgtggttatttcttgagtctgtgctaaaggggtggattattcatgagttttcctggaaaggggcgaggacttcccagaactgagggttccttccccttttagaccatatagggtaacttggaaattgccatggcatttgtaaactgtcttggcactggtggtcatgtcttttagcatgccaatgtattataattaacatataatgagcagtgaggatgaccagagggcactctcatcgccatcttggttttgattggtttggccagcttctttaccgcatcctgttttatcagcagggtctttatgacctgtatcttgtgataccagtcctgctgacctcctagctcatctggtgactaagaatgcctaacctcctgggaacgcagcccagcaggtctcagcctcattttgcccctgttctagatgaagtcactctagttataacaccactgacaaaaacaccctgggaagcacttggccttgccattgtatcttgtgagtgagaaccaaaaagcagagagaggttctgcaaaggtcaaacagccattggggactgggcaggatttgaatccaaatttacctggctttcctgctgcacccctaaccactaccccagtcgcatcctcaggaggccctgctgtgtgtctgcaactcaggcatcccatgcctcccctgcccagtccttcgggtccctaaagactggggcatccaggctccaggcttttgggatggtctgatgggctactgtctgaaggaaaggcaagaaaggagcggtcttcagggagatggatggagtttcttggttcccttgcaatcaaccacgaatgttcctcaccacacttgaccttgctttctggcagctcatcgctgctaaactcctctcccagaaaatggagcagctgcaaagagaggttaagatacagccctttgccctcccagcccccagcgtcacccttccatcagcaacccagcgtctgatggatggtgcctgcttacccttcagcacagaagccatctgtgacccctgcactaggccagggctctgcatgtccctctccttcactgtacatgtggattcattgcacaagaggtggtagctggctaacaaaaagagctgtttaaagtgaggactttctcatcgcacatcaacaaagaaaatattgacgtatgaacccaaatgttttaatggtggagtttcaggcagcgtctccagtgccccctcttcgagctgtgtcagtgaaggcccacagctattctttgaaaatggtctcttgattgacattgcccttggtctttcctgcataaaacattaaactgctacaaattccatcccaggtttctttaactgcaatgagaatttaaagacatttgcaaagccatcccagtgtagaatccttcttgatctttatgattttttttcctcctaagattttctgttgtctgttccaaatttaatcttgcttttagaggggtttttttgtttttcgtttttttggttttttggttttttttgcacctcacctttccagagtatttatcttaggttttcatagaaagaacccttatagctggggccgggcatggtggctcatgcctgtaatcccagcactttgggaggccgatgggggtggaccatttgaggtcagaagttctagaccagcttagccaacatggtgagaccccagtctctactaaaattacaaaaattagcagggtgtggtggcacatgcctgtaatcccagctacttaggaagctgaggtaggagagtcacttgaacctgggaggcagaagttgcagtgagctgagattgtgccattgcactctagcctagataacagagcaagactgtgtctcaaaaaacaaacaacaacaaaaaaaaaaactcttttctcaatgatattgcattagtgtacataataaataattcgagtaattacaaaagcaagtacagcaaacaggtggtaggctttcatgtggactccagtagggcccagttggacttttcaaagtctatcccaaggctgcatcataaataattcgggtgattacagtggcaagtacagccaacaagtttggaaatgcacatttccttctcttgagaagcaggccgcacaactggtggcaattgtgtgtgagtagcctacagaccccagcattcagtcttccaggagtaccagcaggaatggggaatactgatcagtccagccaatctgttcaggatgaccattaagaactatctacaggccgaatgtggtggctcacgtctgtaatcccagcactttgggaggccaaggcaggtggatcgcctgaggtcaggagttcaagaccagcctggccaacatggtgaaaccccgtctccactaaatatataacaattagctgggcgtggtggcacatgcctgtgatcccagctacttgggaggctgaggcaggagaatcgcttgaacccaggaggcagaggttcacccaggagggtgagccgagatcgcaacactgcactccagcctggccaacagggcgagactccatctcaaaaaaaaaaaaaacaaaaaaactatctacattaactgtatgtttatttgtgtttatttctagttagtgtctagttctgctattaaactctaaattctgagaggccaggacctcccaaaggaaaactttgtaatggtggagtttcaggcactgtctccagccagtgccccctcctcaggctatgtcagtgactccctagctcaggtgtccagccctgggacagactgaaaagtccaactggaccctagtggagtccacatgggggcccacatagttttattgtttgtatttccttggtacctggctcatgacaagcacttataaatatttgtaaatcagtgatcactgagcacatgtgtggaataatgtgactgcagtgatcagcacggggccagaccagagctggggaactcactcagtcattctcttcccatgtttttcagatttgcgaaatgatccagaaatcagtgtcctccgatctacagccttatctccaaactctgccaggtaggacaccccatccatcccgggacacttttatttctgttaatttctataagagcatatatatatcttataaaatagtaaatggggcaaaaatatagaaagtaaaaattaagggccaggcgcagcggctcacacctgtaatctcagcagtctgggaggccgaggcgggtggatcacctgaggtcaggagttcgagaccagcctggccaacatggtgaaaccctgtctctactaaaaatacagaattagccgggcgtggtggcgcatgcctgtaatcccagctactcgggaggctgaggcaggagaattgattgaacccagaaggtggaggttgcagtgagccaagatcacgccattgcaccctaccctgggcaacaaagaccgaaactctgtctcaacagaaaaaaaaaaaaaaagaaagtaaaaattaaaagttcatttttctcccccacttttcttccaagaagtaacttctgttttgggtgtatcttttcagatattttctttgtatgtacaaatataaatacatgtaagcatataaatagacattcatgtatgtattattttgttcatgaatctatgtgtatatgtattattttaaatatatatgttcatatacatatagtataggcattgttccagatttcttttttttgagatggggtctcactctgtgtcccaggctggagtgcagtggtgtgatctcggctcactgcagcctcaaactcttgagctcaagtgatcctcctgcctcagccacctgagtagctgggactacaggtgcatgccaccacacccggctactttttgtattttttgtagagacagggtttctttatgttgcccaggctggtctcgaactcctgggctcaagtgatctgcccacctcagcctcccaaagtactgggatgacaggcacgagccactgtgccagcttgatttcatttttaaaaactttttattgaagtatatttataaagaaaagtgctcaaatcataagtgtgctgttaaagagtttttacatgcatgtaaccagctcccaaccgagaaacagaacacggctggtttttcagagcccctggtgtccccctcggtcactgcccagccctccagggtcaccaccatcccaacttctaccagcaaagattagttttgcactttgcacatgaatggaatcagacaatattttgagtctcttttcaaaagccagaaggctttctttgttcaactttaaaatatgaggtcagggctgggcgcggtggctcacgcctttattttttgttttctttttttttttttttttttttgtgagacggagtctcgctctgttgcccaggctggagtgcagtggcgcaatctcggctcactgcaagcttcgcctcgcgatttcacgccattctcctgtctcagcctcgcgagtagctgggactacaggcgcccgccaccacgtctggctaattttttttgtatttttagtagagacggggtttcaccatgttagccaggatggtcttgatctcctgacctcgtgatccgcccgctcggcctcccaaagtgctgggattgcaggcgtgagagctcacgcctgtaatcccagcattttgggaggccgaggcgggtggattacctgaggtcaggagttcgagaccagcccagtcaacatggtgaaaccccgtctctactaaaaatacaaaaattagccaggtgccgtggtggatgcctgtaatcccagctactcgggaggctgaggcaggagaatcacttgaacctgggaggcggagtttgcggtgagttgagattgtgctactgcactccagcctgggcaacagaacaagactctgtctcaacaaagaaaaaaaataataaataataaataaacaaaataaaatatgaggtcaggtcaggcttggtggtgcacacctataatcccagcactttgggaggccaaggagggagtatcacttcagttcaggagttcaaggccagcccgggcaacatagcgaaaccccatctctacaataaatacaaaaattagccaggcatagtggtgtgtgcctgtagtcccagctacttgggaggccaaggtgggaggatcgcttgagcccaggaggtcaaggcagcggtgggctgaaattgtgccactgcactccagcctgggccacagagtgagatcctatctcaaaaagaaatgaaataaaataaaacatgaggtccatgcatattgttgcatgcacctgtagtgtagctggtttattctccttgctgcatagtatatcaccatgtagatgtttccccatttatttgttcattctactgttgaaggccatctggggggtgttcagttttaggccattatccgtagtgctgctataaatgtcctagtacctatggtcgcatgtctttgggtatatatctgggagtgaaattgcaagctcgtcatatcatgtgatatgcccagattcagcattataagatcctgccaaacagttttccaaagtggttgtaacagaccttatttgttaacagccgtgtagtgttccatcacatggatgtgtcttcatttatttaataagtcccccactgatggacatttaggtgctttgctgtcccttgctattgccaacagggctgcaaggagccatctacaagtggagtctctggatccagggtgcacacattaagctcggagggggagaccctggcaaattatctgagatgttctctgatgccttagctcctaagcccctatgcggttatttgctgacatcacctttaccagaggtccaggtcggcaacccggtactgggacttggaacattcatccattcagggttttggaggggagtgtctgggccctctggacatgccatgcctgaccttcctggttattggctcagcattaagctccaggtgtggctggagaggtgaagcctggactcatggtgtgtgtgtatgtgtgtgtgtgtgtgtgcttgtctggaaactgcttaggccctaggctgagcatacacccccaccattgttaactcatccaagggaatccatgtagtgtctttcttgaagaagcaattctttgcctcagggccgggctagtagggggattctgaagaaagtcacagggaatgtgagtcagccagagcccttgcccctcctccagcagctgaaagtgtcatctggcccctaattctgccctgtcctcattcacagttacaacagagattgacagtttcgccgacattgattatagcttagtggaagcccctcgggcaacagcccagatgctggaggtgatgtttaaggtgagggtcctggggccgggctgcgtgggtgaggctttccctcagggtcagccattctttgggccacctgtccccccaacttcagatctgtcctcatcctcccagtggttcccgctttgtcaagggccgggtgatatggagtggtggggagtgtttccagagctaggattctcccacggctgtcttacacctctcaggtcttaacgcttccctcctccttcttcccctactttgccttgcccatcatgcagaaaaggccaatcagagcgggtcttagggagtgtagatgggcctagggcatatagaggggctggccaggacttcctgtgggttaatgtagcaaagcttctggtgagcttttcattaaaagacataacactgcctttaatggtggagtttcaggcagtgttccagccagcgtcccttcatcggactgtgtaggggaatacctagcccctgccccacgataggctttgaaaagtccaattggaccctatttccctctccagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatggtgaggatggtggcaaacaggtctctcaaatgaacacataacctaccgctccttccttctttccttttcacccctgttgacatcagtcaaatagtgagttatagctaagagaaaaatcaacaccaagaaaaatatgttagcacaatctccctttttactttggcaaccaagaaactcaaagccaaagttctttctcccatggctgggtgtggtggctcacgcctgtaatctcagcactttgggagcctgaggcgggcggatcacttgaggtcaggagcttgagaccagcctggccaacatggcaaaaacctgtctccactaaaaatacaaaaattagccaggtgtggtggtgtgcgcctgtaatcccagctacttgggaggctgaggtgggagaatcgcttgaacccaggaggtggaggttgcagtgagccaagatcatgccactgcactccagtctgagcaacagagtgagaccctgtctcaaaaaaaaaaaaaaaaaaagctcttcctcccttataacaactgtggaagactttgcagcttacttatctgtgttttgcttttctagacctgtttactagtctagacttgttagtctaattcatattttctctcatcctgatgatttctggaggtttattaaaaaatattttagtgaatgaggccgggcaaggtggctcatgcctgtaatcctcgcactttgggaagccaaggtgggcggatcacctgaggtcacgagttcaagaccagcctggtcaacatggcaaaacctcatctctactaaaaatacaaaaattagctgggcatggtggcacatgcctgtagttccagctacatgggaggctgaggcaggagaattgcttgagcccaggaggcagaggttgcagtgagctgtgatctcactacttcactgcagcctgggcaacagagtgagactgcatctcaaaaaaaaaaaaaatatatatatatatatatatatatttatatgtgaatgaggcaagataatacatgcactgataaatgcatatattttcagagaaaaggaaataaagaccaagtgaaaataaagcacaattataaagacactgagcccttaaattaatttctttaacatctcaaacctgtcggggagcttccttgtagctaaagtgaaaaagatacatgatttcatgattcatggtgaaaaggagagacagtcttcctcacacccccaaaacaactgtttccaatgtggctttgtataagggagactgaattttacagtggatctcacctttaatggttctccagtttatctaatatttctgggtttcaaaaagttgtttcttgaagcacttcataaaagttgaggcctcatgaataatgtcaggatggtgggagaaacagtgtggttcggctcagacggtccagcttaccctggtataagtcaggggccgtctggtagatcgagggtcattttgtccttctgatggcctcctacacctgcacaggccttcgcttctggcatcgtgtttggtttacccatcctactgcggcacgggcctctctttcaatgggatgataatagctacgttttatggagcactcaccatgtgctgggccttgtgctaggatgttcgtttaggcctcacagtgactcgaaggtggggactattgttatccccattttatggataaggaagttgaggttcagggagatggaagggctggcctgagatcacaaagtcaggacacaaaccgaagtctgtgtgaccgcaaacctcaccctcgcagaccctctgagtgggagccacacatcagctgccccccggggagagcgggcaggatgctgaagtcccatgtgctctccttgggtgaatgcaggacaggcatctcctccctgccagggtaacccaggctgtggagaagcgacagtcttgcacatccccctgtctccccaatcttctttagaccttcagctccagcgggagcaccctaaaacttcttcatgtctctttgctgcagataccgcctgactctaatatccgactgaccaccaagtccttccgacccttcgtcccacgggtaaggagtcccttagttccccatgagtgcagaccgagcctactagactccagaggtttctctttaaaacctctgcatctctcagcttgaccaagagtgagaaggccgggatgagactcccactgaaggctggggtgctgctcctttcaaagcctaaataacagaggccacgccccatatcttgtgggaccacagcttgtccaatcttttattggtgttatctaagaatcccaaggaatgctggcatagtccataaaatgtaccctaatgaacagcagctaacaattacagggggcttcctaggtgccaggcatgttcttggttctttaaaaaattattttttggccaggcatggtggctcatgcctgtaatcccagcattgtgggtggccaaggtgggtggattgcttgagtccaggagttcaagaccagcctgggcaacatgacgaaaccccatctctacaaaaaatacaaaaattagccaagcgtagcggcacatagctgtagtcccagccactggggaggctgaggtgggaagatcacctgaggctgcgaggttgaggctgcagtgagctgtgattgcaccactgcactccagcctgggcaacagagtgagaccctgtctcaaaaaaaattattaaaaatgttagtttttgaatgggaaataaattctcaaggttcaacattcaaaagatctagaaggttatagagtggaaagtctcacatccactcctattccctaaccacccagttcccatctcaagtttgccaatattaccagattttacatatctttctgatgatattctatgtatatacaggttcactatctcttatctgaaatgcttggaaaagcaactctgcctaccttcttagtgaagcattttaccccctcagccttccaaatgtctcccttctagaagaggatgtaggttttacatatacataaccaaaaggttcatgggagtgctgtttttccacgaatagcctcctaaaaaggaagagtcttgccccaaattaaactctgtacctatctctagtacacagaaaattaagagcacttttgaaatggtggaatctagggctggtcgtggtggctcacacctataatcctagcactctgggaggccaaagtgggggggtagcttgaggccaggagttcaagaccaacctggacaacatagcaaaaccctgtctctattttagaaagaaaagttaaaaaagaaagaaagaaagaaagaaatgttctgtggaatatcatattaaaagagtaatacgagaaaattaaatattttttttaaaaaagaaatggtgggatccagctgtgtcatatttcgaaaacactggcatctgacctcagcatgcccaattagcagaatgtgatgaggggatggagaaaccttgggagaggtagggagggagaaaaaatgggcccaacttttctggaggacaatttggcaatacctgccgaaagttttaaaagcattgctggccaggtgcggtggctcacacccgtaatcccagcactttgggaggctgaggcgggcagatcacctgaggtcaggagttcaagaccagcctggccaacatggtgaaaccccatctctactaaaaatacaaaattagccgggtgtggtggtgcacacctgtaatcccagctacttgggaggctgcagaaggagaatcgcttgaaccccagaggcagaggttgcagtgagctgagatggcaccattgcactccagcctgggtgacaagagcaaaactccatctcaaaaaacaaaacaaaaaaagaaagcattgctgtccttcaacccagcaactccacctctaggaatgttttcctgaaaagaatagccaagggtgctcacaggaggtggtcattataatggcaaaaccctggagacaacttgatgcccaatagagtttaatccatcgcaggacccatacataacgaaatacaacacagccgtgaaatagatggtgcagactctgtgtctgacatggagagatggccagttttgccactaggagaaaaaggcacagagaattttgttggaaataaaatcaatcgaaagcaacttccagctttatctgactccctcaggcctctcctggcagacttgtatattttcttctcttgatgtaatctcctaattctgctcccagttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggtaaggttcagagcctttgcaaatgctgtttccttttccccacatgcttttcccttttccccacatgcttttctccccactcaccacctgggtaattcctccaggtctcaacttaaatattacttcccgagagagggctttcttgctggcccttacccccaatctaccttacgccccttgccactttttcttgtaacaccccattatctttcttctcagcgtttactacaaagatactttgtagctgtctgcaggtgtatttgtttaatgcatgtatctctcactatgtgagtctgggctattgtggggagaaaggtatactggtgtttgtctatttgtctattttgaccttggaagactacatttcccaagcttctttgcactttgatttccacccaggtcaaccaatgggaggtactgtcaggagaatgatggcggggaggaaggatgaagccagagtactatttcctctttctttaccacggcagaggctctggctgtgactatgtctcctcatggtgacttccataattccacctccactctttgttcctctagtcctggggtggatacagcctcctgtctctggataatctctgggtggcctcaccaactctttactagcttctcaacaattccatcacttgtataaccaattccccgtattaaattccctctgcgttaaacattgagagtcagttttccttttttgatggactctgtctaatagggaagggatgttgggtcctttgggggccttgctccctggatggagaactctgctctcttgtttcttgacttttgaaatcaacaagtcaaatctctaccagggtaattcttcctagaggctatatctgcaatttaatattgttgttattgttatcaaaagtgtcattattaatatattttaaattaaaatataatttactgtctgggtgtggtggctcacatctgtaatctcagcactttgggaggtcaaggcaggagaatcacacaaggccaggagtttgagagcagcctgggcaacacagcaagactccattgctacaaaaaagaaaaaacaaatagccaggcctggtggcatgcacctgtagtcctatctactcagggggttgatgtgggaggatcgcttgagcccaggagattgaggctgcagtgagccatgattgcaccactgcactccagctgggcgacagacagagactccatctctaaaacaataataataatttattaatgttgttactagggctgaatcttgacctgagataactagaaatgatcctttttagagctttccaagggtaggtactctataccttctcttagtagtctgttcaaagtttaactgctaacataaacaacaatttcaagtaaaaatgttcaagtccaagttcaaatattgtttgagcacctacagtgagccttctgggagtctatgatctagtgggcaaatttcctgctttagctcattgagctgtttgttgagaggagacagttggtccctcgtcatcatccttcctatacatacaaccttcatcacttacacctgcttccttcttctggcatttccaggccactaatgtgtccgccaccttgaccttcaataccagcaagatcactgggttcctgaagccaggaaagtaagttggcctcctacctacatgggggtgcccagctggactccatctgtatgctgtagctgcttctctgtagctggtgggagggggggccaccatttggaaaggacacttacatttcaccccaattggcccaattcttctgccccactggtcctgcccccacaaatctcaaattgttaaagaattcactaagactgttacttcttaatgtatgaattttagaagccagctatatgaacttcctgaaatgataaagagtgagctttttgacactatctcatctgccctgtgacagtcttcccgatgtcattgtatcactgcttttagttcctcagtcatcttttccactcctgctcccgccctacctttggccctgtgccttctcaagcccatcctttctcgcttctggggacccccgcattgcttaaacttgcataaagcccacaccttttaatcttctctgattcattacagggtaaaagtggaactgaaagaatccaaagttggactattcaatgtaagttgtttttattgatgacatgattagaatgttaattaatttggggtgtttcctaagcaattgctatggcacctataataggaaatacaaaaggagaagagttgattttttgccctgcagaagtgtaaaaggtctcgaaaacacaagacatagggccaaggaacagttatatcctagtataaaacaatatataattaagtcatctactgaacagaattctcttaactgcaagagacagaaagccaattgaaatcatcttaagcaaagaggagaaatatataggattatataattgaaaagcaaaaataaacgaaaaaactaagaccagaggtttcaggcatagctggatccaggtgttctaattagtgcatcaagaatctctctccatctctctgttctgttttcatttgtgttagcttcactctcaggcaggctcttccaattggtagcaagccccagagtttcctacagtttcagttttttaaaaaatttgcacacacacacacaaaatctctgtgctagctctcattggactaatcttaggcacccagtcttaagccaagcactgtggccagaagtcagcccagcatggatctcatctacactccaggaggcaggatttgcagtcagctacatccaaagcacatggaccaagactggcaaggagggttgttccctgggggaaaatagactccgttatcaaaacaagagggattgagtgctgagcaggtaaatccaagaagtgatttccacaaggtagaaaaagtggtgaagtagacggccccaaataaaaggaggaaagagaacgtgaaaatcagtgtgggccaaagttatggagaagagctttctggaaagagggaaggaggagctgggtagactttaatgtgtagtcgttggcttctcttttaccattccatgatgctggcctccactgaccacctccacctgtgccctgcctcccagactttcccgaagcacttatgaagtggaaacaaacacagaggcggtggggagagatgcagggaccctgaagctaactcctttcagagaataaagggtggagtgaataatggtgcactcatattgtatctgtgcgtgtttactgcaaagtaaaacattcaagtgagaagtttcacaaaaatccatcctgtcgggttttcagagcatgaaatgtaaaaacaaaaactacagactcagatacatttagattcgaatcctgatgctgctgcccagtttgtagtaagtccctttcattctgtaggcctcagtttcccgatatatggaatagggacattaatatgaactttgaggggttgttgtgaagattgaatcagacatgcacgtaaagctctgagctctctgcttggcatatagtgggggttagaagttgtgtttcatgattttggtagagaagcttattttgtttttattaaattttttaaattatgtaggtagttcaggaaaaacattctcactgtaaataaaaccgatactaaagataaggctaaggacatgtcaaatgttgatgttcttcctttagaggaaagactgtcgggtgtgtaactttccaaaatttttctattcacttgcataccaaatgttcatctcaaaagagttttatcttataaaatagtagcatgatgtaatactagtttgcttttcccaagcgttttgctatgttggcacacacagaaccaccatgtggccctgtggcgatgtaaatatatctctcctgttctcttccaggcagagctgttggaagcgctcctcaactattacatccttaacaccttctaccccaagttcaatggtaagaatcactgtggatttttccaagtcaaaagtgaacactgctgtctggaggaaagagagttggacttggaaaacagggctctcctgggggctgtatgaccgtgggcaagtcacttctctctgagcttagtgacctgcctgtgacatgggatcgttgaagttggcctcatctccctccagggctctaatgagggttgggggctgggacagctctttggagcacgggaaacctccttataagcgggacagagggacacatggaagtgccccacatcctgaagaggcaggtcaaagactgaggaccaagttaatatagaaggcacaaggcagccgcctctgaactcacatctcccagtcaattgcccaactgcctagtcaaaaaagaaagcaaaaaacttaaatcctgtttccatgaagctttgcttcttttggctgcaacagagaacaggacgggcaaagggcagggagtggaacgccctgttctttatcttatcatgaatgtgtgcttcctccagacagcaccatgcctgatagcttaggctcccaagtcagcctccctgggtttaaatcccctttctgacacttcctgtgtgacctagaacaagttacttggccactctgtgcctcagtttccttatctgtaaaatggaaagaataatcacacctacctcatagtcttggaaatcactaaatgggaatatactgaatatagagtttgcagagaacattttcggtaaaaatctgtctctaattattatttattcaccaatctctttcaatgttgtgcttcaacctctagataagttggccgaaggcttcccccttcctctgctgaagcgtgttcagctctacgaccttgggctgcagatccataaggtcggtgggttcaggggggctctgaggatgtgtgagggaggaggtggtttgcatgctagctttggggccatgattcatgggtgacacccagcccagccctgcagctgggaaagtctggccaggggcaggacgggtgctcctgggccttgccatatgccacaaagccatccacatgtccttcagaagtggcacctctgctggtgcaggtggcatttgacacagccctatgccaccaccacatcccatccctaccatgaggggcctgagggaagctcaagaccagctcgttttgaaaatactgcgggccgggtgcagtggctcacgcctgtaatcccagcactttgggaggctggggcgggcagatcacgaggtcaggagtttgagaccagcctggccaacatggtgaaaccccatctctattaaaaatacaaaaattagctggacatggtggcaggtgcctgtaatcccagctactcaggaggctgaggcaggagaattgcttgaatccaggaggtgaaggttgcagtgagccgagatcacgccactgcactccagcctgggcaacagagcaacactccgtcaaaaaaaaaaaaaagaaagaaaaaaaaaagaaagaaaatactgtaagtcctagacgtagcattaggtcaggttctgaaagtcatttgtaagttttaagcttttcttctaaattttaaggttgaagagctttattataaatacctgtttggcatgcctccccatttaaacaagtactacaaccatatatacttttttttttttttttttgagacagagcctggctctgtcacccaggctggagtgcagtggtgcgatcttggcttactgcaacctctgcctcccaggttcaagagattcttgagcctgagcctctggagtggctggaactacaggctcccgccaccactcccagctaattttttttttttttttttgtatttttggtagagacaaggtttcacaatgctggccaggctggtctcaaactcctggcctcaagtgatatgctcacctcagcctcccaaagtgctgggattacaggcatgagacaccatatacagccaacactatatatgtttacaaaaattattcataaacctattgctccactacaagcacagtttgaattttggtgtacttctagtgctttttgttttaagggtttttttttttaagtttgtttgttttgcacagttgcattactagtgctcatacctgttttctttctttccctttttttttaaaacttaaaacaaatttttttttaggccaggagcggtggttcatgcctgtaaccccagcactttgggaggccaaggcgggcagatcatgaggtcaaaagtttgagaccagcctggccaacatggtgaaaccccatctctactaaaaatacaaaaattagctgggcatggtggtgcgcacctgtaatcccagctacttaggaggctgaggcaggagaatggcttgaacacgggaggcagaggttgcagtgagctgagatcatgccactgcactccagcctgggcgacagagcaagactccatctcaaaagaaaaaaaaaattaacttaaggttctttttaaagcttaacttaaaaactattttaatatcaagtgaaatagtgaaaaactattttcattattcaaactattattctgaccaagcattttgtggtctatctgtgcttccaattttcaggttatcttttgaggtgagatgaactgggttggcggactcattagcaggagggggatgctgcgctgtgcctggtacattgttaacaacagaaaataatagccattaaagggaatgaagggcaggggggatgattagggacctagaaacactggccaactgttctatctaaaaaacaaatgtcgaaagcccttttgggctctgagatactcagcacttaactgctcttgagcatttataagtagtcagacagatcgttgttcaaagcaaagattgagtgacagttcataccatcggcctcagttttctcctctgtaaaacgggacataaccgaaatgtcagtgggcttttgtgatgatttagagggcaagtatgatagcttctagctcaatgtttgacatgtggaaagtaattagatttattatatattataatattcattagaattttgaggtcaactctgcccatgtgtctaaccgtctaaaacaaaggatggatcactgtgggaaagaactgaacttggccttcggttcagaattcctgcccctctgggtgatggaaacgtaagaagagcaggagagtacaccctagcagttcacaatttttcattatttgccaaagagagaaaatttaggtgacgcaaaggacacttagaggcctgccgggcagcagcagctcggggaatgacagatcgatctctaccttggagaaggtagctgggaagagctgtgctttacggagagcttggggactgaggcacactcgcaatttatgcactgacctggattctggcagagcttgtgtttcgtgagacgtgggctccctttcaatcgcagatgcatctttttggagtagaggatgctctttaccatcctgtcctgtcctgtttttcctaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccccgactggcctgggatatctttacaagcaggcactgtatttttttattcgccatctgatccccatgcctagcagagtgctggcacttagtaggtcctcaataaatatttattaaatgatgagatgatggaatcacctggtattctagctgagcctcatcactgcctgccctcttctgacctcaggggtctttggatagtcagccacatctatggtctccaaggcccctttctcatcgccgctgctatgggagcctcaatgagagaaccagggattctgtacatcatgtagccctggatctggcgctggtgctccgtctctaaggcccttgtcctgtctcaggcaggggctcacttcgacatcgctccctccctcatttcttgcctgctacagccaagggagccaatgatctcccggagcaaaaactcagcctcccgctgcttttccctcattgaagcaggtgtaaattaggaggaaatggatctgtctaagtttttggtccaaccccaataaaaagctcatccaactgttgtttatgagccccaagcctggagggagaggccgtgatttctaattactgaacaatgagcctttgatcagactaataaagagtcatttccaagttatgtagttgggctcccagggactgggagtcagaagactcgtttgataattttttttattgtgttaatgagcagatggatggagcttcaggctagcagataattcacagggaataatcccatttaccctgtgtgtgacagagatgtgttccaagatgggacgatgtgttgtcgcccagctggtggcagggtaagctgtggcttcaagccctctctcctctccatttttgttcatttgtttgccaccatccatccctatgaccgactggcaaaggacacaggcttcatccagtactagccatgtggccttgggaaggtcactttccccctggggtcctcatctatgaaatgatgatgatgattatagtagtcaattcctgggactgctataatgactgcattgggtaatctatgtggaaggatttatttagccaaatggggattccatatttattggctgggtgtgcttactaagcacctcctatttgccaggctttggggtcctcatggggagaaatacatggagcatgggctccattcctgatcctgcttttaagagtgatacttcctctccctctccctctccctctccctctccctctccctctccctctccccacggtctccctctccctctccctctccctctccccacggtctccctctccctctcccctctttccacggtctccctctgatgccgagccgaagctggactgtactgctgccatctcggctcactgcaacctccctgcctgattctcctgcctcagcctgccgagtgcctgcaattgcaggcgcgcgccgccacgcctgcgtggttttcgtattttttttggtggagacggggtttcgctgtgttggccgggctggtctccagctcctaaccgcgagtgatccgccagcctcggcctcccgaggtgccgggattgcagacggagtctggttcactcagcgctcaatggtgcccaggctggagtgcagtggcgtgatctcggctcgctacaacctacacctcccagccgcctgccttggccccccaaagtgccgagattgcagcctctgcccggccgccaccccgtctgggaagtgaggagcgtctctgcctagccgcccatcgtctgggatgtgaggagcccctctgcctggctgcccagtctggaaaatgaggagcgtctctgcccggccaccatcccatctaggaagtgaggagcgtctctgcccggccgcccatcgtctgagatgtggggagcgcctctgccccgccgccccgtctgggatgtgaggagtgcctctacccggccgccccgtctgagaagtgaggagaccctccgcctggcaaccgccccgtctgagaagtgaggagcccctccacccggcagccaccccgtctgggaagtgaggagcgtctccgccaggcagccaccccgtccgggagggaggtggggggggtcagccccccgcccggccagccgccccgtccaggagggaggtgggggggtcagccccccgcccggccagccgccccgtccgggagggaggtgggggtcagccccctgcccggccagccgccccgtcggggaggtgaggggcgcctttgcctggccgcccctactgggaagtgaggagcccctctgcccggccagccaccccgtccgggagggaggtgggggtgtcagccccccgcccggccagccgccctgtccgggaggtgaggggcgcctctgcccggccgcccctactgggaagtgaggagcccctctgcccggccagccgccccgtccgggagggaggtgggggggtcagcccccagcccggccagtcgccccgtcggggaggtgaggggcgcctctgcccggctgcccctactgggaagtgaggagcccctctgcccagccgccaccccgtctgggaggtgtgcccagcagctcattgagaacgggccatgatgacaatggcggttttgtggaatagaaaggggggaaagttgggggaaaagattgagaggttggatggttgccgtgtctgtgtagaaagacgtagacatgggagacttctcattttgttctgtactaagaaaaattattctgccttgggatcctgttgatctgtgaccttacccccaaccctgtgctctctgaaacatgtgctgtgtccacccagggttaaatggattaagggcggtgcaagatgtgctttgttaaacagatgcttgaaggcagcatgctcgttaaaagtcatcaccactccctaatctcaagtaccccgggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaataaataaataaaaagagtgataggtgtgctgaaaagagccagtattgattccagcctacctgttttgggtccctgggcaaggtatctccaagcctcagtgtcctctcctgtcaaatgaggctgggaagagctcttggcgggattattttggaaattgatgggttcaggttaagcttccgtgggtgcccagagaataaccaggtggtggtcaatggatgacacaattagatcacctgtcatacttggtgtccccagaagcagaccctgaagaaaagaggtgagtacaagtatgacggtgttgcaaaagtaattgtggtttttgctgttactttctttttttttttttttgaggtagagtctagctctgtcgctcaggctggagtgcagtggtgcaatctcagctcactgcaagctccgcctcccgggttcacgccattctcctgactcagcctcctgagtagctgggactacaggtgcctgccaccacgcccagctaattttttgcatttttagtaaaggcagggtttcaccatgttagccaggttggtcttgatctcctgacctcatgatctgcctgcctcagcctcccaaagtgctgggattacaggcgtgagccaccgcgcctggcctgactcccagtcttttctccagttaatctttcctgggtttttgatgagattcctaggaagggggtcttaagataattgcatttcttttggaaagaagttttcttattcagagaaggaaattccagacagagtcccttctggtgcttcaggaaagaggatcagagagctaaggaggtgagggaagatcagagggagaccttgagtctgcttttttagttcagcatatcaatgtgccatatattggcgtattgttttctgagccccaacagtgttatatctcgatggggtagtacaggacaacacagctggccctagagtcccatagcaggttctgacgccctgaaatctgactgtaaacatatgagtatcctggacagctccaacctgtagagaaggactggccttgggacaggaggttctgatctcaataaccggaagaactggactgtcaaagaaccttcaagagaccacagactcattgctgtgtagatctcattctcacacaaaaccaagatgccaccttggagcgcctcctcttgactacaacctgttcctcccttctgcccttctctgatttcccctctcctctcctcaacctgatcaagacctctagcctcaccggtgtcttccaggccgctattctgatttaatttgtctccataactaagcacagttcatcatctctaacagaatcctttcatctcctgacaatcctactttccacatccccagcctggggcctaggcgtaggtaagagaattaaattactggaggaaaaggcaggcaggctatagccagttgaggtctccttccatcaccaaaaccatagttctgtctgaatggcctgagcagcagcaacagcctagaaattggaatacatgatatttctaatgaggctctcaggtaaggtctcagaacccattcagtctcaagacatgctttttgtttttgtttttgtttctttgagacaaggtctggctctatctcccaggctggagtgcagtggcacaatctcggcaaacgacaaccttcacctcccggactcaagccatcctcccacctcagcctccagcatagtgggactacaggcatgcaccaccatgcccagctatttttgtgtgtgtgggtatttgttgtagagatggggttctgccatgttgcccaggcaggccctgaacttgtgagctcaggtgatccgccggcctcagcctcccaaagtgctgagattacaggcaggagccaccatgcccagctgcatttcttctttctttttatttattttttttgagatggagtttctctcttgttgcccaagctggagtgcaatggcatgatctcggctcactgcaacctcggcctcccaggttgaagtgattctccagcctcagccgcctgagtagctggaattacaggcgcccgccaccatgcccagataatttttgtatttttagtagagacttggttttatcatgttggccaggctggtctcaaactcctgacctcaggtgatctacctgccttggtctcccaaagtgttgggattacaggtgtgagccaccatgcctagcctgcatttctttctaagagcccaagatgtagcttagaagaaaagacactagcatgccaggatagtccatattgtgctgtaagtgaaggcagcatggagaagtcttggcaatataggtaacaaggtcaggggcagccacaggtctgaataggtggaaagatgagagctgctgggtatagtatcaaagggttaggcaaacaatagaaccaataagtgtgcgtgtttggaaaggacagaagaagaaaacaaaataaacaaaaccaaaaccaagtacagcattgggccccagggattagaaagtcaagcaggagctagcacggccaatgcactttgcttctttcactggaaaagtccaaaatatattttcctattagtacacagagatcttctgcatttgatttttaaaatttaacacagctacataatattccacatttgtgtatgtacaaaacaacttcttcattcttatttaaagatgcataggatctcctggtgaaagatacaatttatttaaccagttcctacttatgggtcatcaggttgttttaaaacttttgcttttataaataatgtttcagtgaatacctgtattcatatgccaattcatacgtgtggaggtacattgtagaataaatgcccagaaatcaaatcctataactctgactctttggttaatttagcagattgtcatttgctcactttctcttctttccagactttccccttctcttgaggtggtgcctgggtatacagggatgttgaaggggtccacatggcatcatgagagtggagtgaagcaggacatagtaaagaatttaaccttgctcaaagagagacatggcttttgtccttggcccctggaaggtaatctctaagcccttggaatgcttgcctggtaagagtgcctttgtttacctgggggcattggtccataacagatagtctaacaaggggagccacggcagggcttttgttcacatcatatcagcttaatctctgaagatgctgaagactgagcccagccacatgggcagccaaccagattggcatgatcaaggccccaaaagactctggagcttttcagatgattttcaggagaaatgactgagcccaaagaacaatagcctggaaggaagttcctatgagtgctgtgggaagtggtgggaaggtgaggggcggaacttcacaatgcacaaaggttgtcttattatgcagatgaagtctccccggtaatctctgagctgcactcagaggatagatgaagaagtctgggcgtggcgattactccaagtcttttctctggttaatctttcctagctatttgatgagattcctaggaaggggaccttaaaataattgcttttattttggaaagaaggtttggctgagtgtccccagttggcaatacttcatgtgtattgtcacacatcaatgctagaaaagtgatgctgtccacgaccccagggagagagggcagctggaagctctgcgttagaactttcttggactctgccctatgttgctcttcccttggctgattttaattggtatctttttgctgtaataaaatataaccatgagtataacaactttaagtgagttctgtgaatctttctggcacattttcacacttaagggttgtctgggccactcctgaacttgcaattggtgtcagaagtaagagtggtcttgtgagcaatgctgcctctaacttcacacaaggagtcttctcctcctcagctccttcactcactggacatcctgctggccacagatgctgcctgagcatgaggccagtgacacagagacctgttccctgtggcctggtcaaggcctaaagtccctcacctcctgcccccagctgctgcatcttcagatctgctacaaaccctgtattgatcaggcttcctacctgcaaactttagcatccactctgggtagtataggcagaaaggggtttgttaaaggacattagattgttctcaaatggttgggaggagaaacagagttgaggctgagcttccaaactggtcacaggggttaatcagatgcagaccacaccaggacatataagctcactttctcattagccccactgattttttaaggtattctatcatacaccaggatcaacatatacttataaaattcctttgtctttactatttaagattgcaacacttatttagtgttcaattatctgcttgtgaaatacttcttagcccagtgcttctcaaacttcaatgtgcctatgaatcccctgagcatcttattaaaatgcagattctgatgcagcaggtctggggaggagctgagaatctaaccatcttccaggtatttccaatgctgctggtccttgagtaacaagatcaagtaaactttgtgggagtaagaaatttctcactgctatataaccccctagaacagcacctggcacatagtaggtgcacagttagacatttgtcacatgaatggatttggcccatagatccaacatggtccagcttcgccctccatccagcactgtgtgaattgttggtctacagaacgttcagtggtctggagcccaggagagaaaactggaaatttctcaaaagccaagtagtgacagaaaatgattcagtcgctgatatggtttggctgtgtacccacccaaatctcattttgaattgtagttcccataatccccaagtattgggggagagacccagtgggaagtaattgaatcatggggtggctacccccacgctgttcttgcaatagtgagtgagttctcatgagatttgatggttttttgtttgtctgtttgttttttttagatggagtcttgctttgtcacccagcctggagtccagtggcacaatcttggctcactgcaacctccgcctcccaggctcaagtgattctcctgccttggcctcccgagtagctgggattacaggcacctgccaccatgcccagctaactgtttgtatttttagtagagacagggtttcaccatgttggtcaggctggtcttgaactcctgacctcaagtgatccacccggctcagcctcccaaagtgctgggatgacaggcgtgagccactgcacccagctgagatctgatggttgtataaggggcttttccccttctgctcagcacttctccttactgctgccctgtgaaaaaggtaactttctcctcctccttctgctatgattctaagtttcctgaggtcttcccagccatgcagaactgtgagtcaattaaacctatttccattataaattacccagtcttcggtgtgtctgcatagcagtgtgaaaacagacgaatacagtcaccttgttgaggtcaagtggccaatttttgcaacattgctagatcagggtctcagtgaaaaacccccttttaggaagaaggcacaaatttcccatatagaaaaattctaagtaatgtatgtaaacactgccctgcaagaagttgggagcacagctctctgccccttaagtatgggctacacttagtaacttgcttccaaagaatagagtatggaagagtggtggggagtaaatttatcgagaaacctgacaaatactacattagccaggtgatcaaggtaaagatactcagtgataagtcatgttgatagtaggcatcttagttcaggctactctaacaaattaccatagactgagggacttaaaccacaaacctttgttctcaagttttagaggctggaagtctgggatcgggatgccagcatggccagcgagggccctccactgtgtggcaggctgctgacttcccactgtctcttcacgtggtggggagcaaagagagggaagcaagctctctcatatcttgtcttctgatggcactgtttaatccaggttagcgtaaagctgccttattttgaagttcagcctaaagattcctctgtacatcgtgaactataacctaaatggagttgtaaacagaccataccctactcttgtgccaatcaccgagttttggccaatcaaaagtggccaactgtttaaaccgttcaaataaggcaaacatagagctgtaaccaatctagctgtttctgtacctcacttccgttttctgtacctcacttccgttttctgtacatcacctaactttttctgtccataaatcttttaccaccacgtgctatgctggactttcttgagcctgctctggttcaggaagctgccaattcgtgaattgttcttgttccagtaaactcttttaaatttaatttagcttaagtttttctttaggctggatgcggtggctaacgcctgtaatcctagcactttggaaggccaaggcgggcagatcacttgaggtcaggagttggagaccagcctggccaacatggcaaatcctggtctctactaaaatacaaaagttagtcgggcgtggtggcgtgcatctgtaatcccagctactcaggaggctaaggcaggagaatcgcttgaacccaggaggcagaagttgcagtgagaatgagaagagatcgtgccattgcactccagcttgggcgacagagtgagactccatctcaaaaaaataataaattaaaaataaataaataaaataaaataaagtttttattttaacagtgctaattctattcatgagggctccattttcatgacctaattacctcccagaggccctacctccagatattatcctattgaggatttagatatcaacatatgaatttgagcaggaaacaaatattcagtccataacagtaggtgtctctgacatggtgagatgagaatggcactcaatggtcttcctccccaaaacccgtggtgaaaaacatcagacaaacccaaattcaatggcattctacagaaactgttggtcagttctcctcaaaactgtcgaggtcatcaaaaacaagggcagtgtgagaaactggcacagcccaggggagcctcaggagacttgaggactacattcagtgtggcatcctgggtgggaccctggaaaatgaaaaggacattagggaaaaaaataataaaatttggataaagttatatggttaataagaatatgtcaatcattagttataataaatgtaatattaatataagaagccaacagtagaggaactggg

SEQ ID NO: 11992 - DNA, 14915 bp, Human
  misc_feature (1)...(14915): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacagcgagactccaaacacacacacacacaaaagatatggcgcgtctcattcattcacaagttcctcttcaaaggtttggctcgttcagcgccctcgttcttcgtttcctacttccaaggccaacctgacttcctcaccctctgggcctccccgtctgagtctcagtaaacaagtttcccgccggtcctgatctgcagagatggcacctgccacccactctgcacatccccctcccgtcgccacgggctcttcccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaaggtaaccgccagcctctcctgaaacagaatgggatccaaatgggatatttgggggcggcgagtcggtcccgcaaagagaaaccagcacttagaaaatttctcagcgagaccactttacttgtacggaagggggctgcctgcgtgggatgcaatctccagagcacacgggacaaaggaagggagcttctgttcctctgtcctttccctgttggctggggttggacgcccacaatctaagctgatcccggttggctaaaacttaaaacttttttaaaatagggtaaacgcgccacctgcgaggaaagaagaagggggtaaggttgattgacaactttagacctggaagttgagtttctgaagaggaacttacttgtcccaaccaaatggtgcacaggacgtttatactaagaaattattcattttctgagatccagattcaagtgccctttaagtatttttatttgggcggaggaggtcacttcctcccacctaatttattaatacgttcatatatatatatatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggctggttggtgcctgcccaacccgtcctgctggggctggactccgcaggacctggggaaagcggcctgggcgtggaatctggagacgggtccaccctgcctgcgagtgttagggtcagagaccctcccctgagactctctggggcccccgcaagggcccgtgcggcctggagcgatcatcttggcgctcccttctggaaaaggggcttttgtcctccaagagcacatggaggctctgagtgggtcagccctccggatcgggaagggattaccgttcttcacgggatttagccctggcgtcttgcctagggcgtgcacctgcccccgggtgttctcccagactcttaagacctcgcaggctccctcgaggggccctgcgtggaagggaaggcggaatctccctctgattctgcctggattcagcacccagaatgaggtggtctctgaacgcccctcctcctttacaggcgaggaaacagccctgtgggaagtcgaggttccaaggtcacagtgagggggccctggccacccgattcagcgcaggaaatagtgagaaagtcgtttttagccgactctgacccgcattcggtttccagtgctgtcttaggagggccgtgtgttgagggtgggcaaacgtggtttggagagcgcatttgggaaatggattgaggtgtgtttttccgggagaaaagcatgacatcctttcttgcttcatagaaaatttcttcctttgttgagacccccatttggttctgggttaaagatttatagtgaggccgggcgtggtggctcacacctgtaatcccagcactttgggaggctgaggcgggtggatcacctgaggtcaggagttcaagaccagcctggccaacatggtgaaaccccatctctactaaaaatacaaaaattagctgggcgtgttggcgcacgcctgtaatcccagccactcaggaagctgaggcaagagaatcgcttgaacctgggaggtgaaggttgcagtgagctgatatcatgccactgcactccagcctgggtaacagggagactctgtctttaaaaaaaaaaaaaaaagaggtcgggcatggtggctcacgcctgtaatcccagcactttgggaggccgaggcgggcggatcacgaggtcaagagatcaagaccatcgtggctaacacggtgaaaccccgtctctactaaaaatacaaaaaattagcctggcgtggtggcgggcgcctgtagtcccagctgctagggagtctgaggcaggagaatggtgtgaaccagggaggcggagcttgcagtgagccgagatcgcgccattgcactccagcctgggcgacagagcgagaccccgtctcaaaaaaaaacaaaaaaaaaatttattgtgaccgatgtgttgggaacaaggtgcagagctggagggtctggcctcctgaagggtcaagagcaagggcttcgagcctctgtcctgggcattgagccgtagggggccttgggcagaggctggggagggggctccttcttccagaggctttgccagctaactcctgacctacgtctgagatttcgtcttcctggtaaccaaagtggccctttatcgaatgtctcctgggcaagggcctggccccagcactgcggccagctctctggggagacacagataggagcccatgggtgaggtgagcgcggaagataagccgcccccgccagccctgtggaaacccagccaggcctgactgggtttcaagcacagcacgaggttcccacattgagctaatttggacagccaagtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtggggtgagtgcccaaggttggccgtccgcgtctcctgtgggcttgtcggggaccggagggccggggtgtgctagctgggtcccgagggtggagggcttcacccccgagcctcagatgagaggagtgggagtgcctggctgcggccggtgggggtgggtgggggaggtgcccgaggctgcttcccagagctgttctcgctggctgctgtctgagcactggggtgggtggggaggagggcgggtgggggcgggcagccttatcctgcggggctgcttgtgtacaagtaccacgcggcctgcctggccctgagccctgggcaaggaggcggaggctgtttttagatgaaggtgactttacttgagaacatgggttacgtctcatgtggccagaatcgaattctaacctttctggggctgtggccgagggtcaggcgccgtccctcctcctgctgctcatgggtggaggctcctggtgcggcgggcgagatggggtggtccgtggggtgggggcgctctgcattgtccccgaggagcctctatggaggctttctcttccggacgcccccccacccccagtgacacgtcaatacacagacaccagcatcatcagcatccggagggacacagggttgttccatccaaagccttttggtccctttgggagcgatgctgcccgctgagaagctggcggacccagcgggagcaccgggaccggtgcagatggcgcctgggagcccgggactcctggaaaggtggctgggggcagctcggctgcgggccccacctggtcctcctcactttcctgtgtgccctgccctgcctggaggtggggtgaggtgagtcaggggccagccctctcctagcacccctgggtgaggaggatgtggagcccagccctgcaggtctggaggatgaggagaggggctgctgcagggcaggaaggagcttgccagctgggcagcctctggctgtgcttcctgccctgactcacctcgcccagctctgcacatagctgccagtgttgcagtctgggaaatcttaactcccaagaaatgtaggttaccaggaggagatccctttgtgaaaatggcactgccagccaggcgcggtggctcacgcctgtaatcccagcactttgggaggcccaagagggtggatcacgaggtcaggggttcaataccagcctggccaaaatggtgaaaccccgtctctactaaaaatacaaaatattagctgagtgtggtggcaggcacctgtaatcccagctacttgggaggctgaggcaggagaattgcttgaacccgggaggcagaggttgcggtgagctgagattacaccactgctgaacagagtgagactctgtctcaaaaaaaaaaaaaagaagaagaggagaaagaaaatggcgctgccaaaacttgtcaactgcgcctgcccagagctcacctgaggtgctcagacgtgaacattcctgtccccgtggccttgggggccgtgacctgtgcactgccacgcagcctcggagccgtgtgcacgcatatgcacgtgtgtatgtgttgtgtgtgtttgcagacgtgtgtccttgtgtgtgtgtgtgtgttgtagcggtgcctggggagtctgacctcagaaggtgctgtggggagggctgcaaggtcctggcgggaggaggcactccccacgcttccccttgggctgggctgttcctggcaggcgagtgctaggcacagtgtgaggttctgtgtggattctgctgtgctccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaagtcagaggacggtgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgcccacggtctttcccatgccatgctgtttccagccgggccccatcactctcccacaagctgaaaggaagtggcttctccaccagccctggctgggagtcctgtgggcgaggccttccccaggagctgccctcccaagtgccccaggcactaacaagaccccacgcgtgctctccccacagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcccagacccagccctcaggactgggtgagaggcctagactgggggtcccggacccagccctcaggactgggtgaggggcgtagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagccacacagaagagagtgggcactgacctgagccttctctgagcctgttactcctctcggcatgttttgggcctgacaaaggctgaggctttctgctgcctgccctgcagctgcctgcacccacccacctgggcgggctgcttgggcaaggttcaggggtggtcctggctgctcctggagagtgggtgtgtgaagctggtgcccagaggctgagggatgcccagcccctgcccgcccagcacacggaacagatgtggttgcagggctggagagcttgggggaccaggagcttagagcgtggaggttgcaagttgcaggaccagtaactgggtctggagggaggtttgcagcggctgtgtcagccctgcaggccgagtgtggcactgggccttctgctggtctgagcgggggtctcagggtggaggtcagcaaaagaggcttagtgggggcttagggagcctgggtgggttcccagagaagctaggaatcagatgggaagatgggaaggcagtgtgtttccgtgttgggcaaatccagcgttttcatgccacggaagccaagaaagggctcacggcctccggcctcacagggctacgcaaagggggagttgaataaacacggtgacgggccccgggcggcagctgctcccggcactgatcctgctgggccagcggtggacttgcagggcccacatccggagctgcccactggtcctcgtgctgcacagccttggaggatctgaggctggctcagggtccctggcagcaactgccctgctaggtgggggctgctgggttccacagctgggccctccctgccggctgccaccaggcggcgctgcacgcccacgctgagtggggcaggccctggagcccctctgcccgggcagcctgacggcccctcctcctcggctgagaccgcagagtcccaggcatcacccactgaaagtgtgctcagtgacctgtgaatagggatgccacgtctgcgtgcagacattgattaggcgcctgtggtatacctggagctggagggtgtgcgtggacaacaggcagaaaggtccagtgggatggaggctgccaacaggacgatggggaaggggcgcgttggggacatcgccgggcacgcggcccaggtgggcccctggctcaggtctccccccacctccctgcctgggctctgtccatctttctgccgcaccctcagccccaggtgtgggcccaccgtgcttgtggacgcctcatgctctgtaccgggtgggaggtgtgggagttacaggtcagggcagccttgggagacgggcaggtttcctggggtgcttaccggcagatggggcgcctgggtccgtgcagggtcgtccgcccgagaaagcagcccctcacccctgggcactaacttcatcttttttctttgcacacagaaacgtaaacctgattcacaaaagtataaccactcagcatgtagctttgtacacctgccctcagcatttagtgtcctcgttcatccaacaagcatctaataagcactggggtacgcagtggtgggtgtccgccccgtcactgggtgtccagcgtggggtgcggaggtggatgtccaccccgtcggtgggtgcccggcgcggaggggtgcggaggtggatgtccgccccgtcggtgggtgcccggcgcggaggggtgcggaggtggatgtccgccccgtcggtgggtgcccggcgcggaggggtgcggaggtggatgtccgccccgtcggtgggtgcccagcccgat

SEQ ID NO: 11993 - DNA, 14079 bp, Human
ctcaggaaagaagcaaggagactgccagagtattttcttgaccagatcaagctagacctacagtattttcctaaccagattaaggtgcataaacttgatgctgaagtcactagggagatgtggaaggatttttaagcaaaaagtgatatgatcagatttgcatttgggaaagatcattctcttggcagtctggtgggtgaaatggagcaactgtcttttgtcttaatcacaattccaactcaaagataaataacaaaactgggaagaatgtttgttacaaatataatacaggattgatatttttaagttattaaaattcacacagattgctaagaactagcaccaggaccagtcttgaaaacaatgggcaactggcctgaacagctcatttctagaatgtattaaatgtctaattaacacataaaaaactccagcctcgctaacatataaaggcacaataaataataatttaattaacttgacccatcccaatagtaaggatgtgaaataataacttctcagtgctagcagggattaggtgagggcacctccattgagggtgtgatggattcaacatttcaggaagggactgtagaaatatgctgatactaggtcgggcatggtggctcacacctgtaatcccagcactttgggagaccaaggcaagcagatcattgaagctcaggagttcgagaccagcctggccaacatggtgaaaccctgtctccactaaaatacaaaaattagttgggcatggtggcacgtgcctgtaatctcagctactcaggaggctgaggcaagaggaaaatcctttgaaccctggaggcggaggttgcagtgagccaagattacgccactgcactccagcctaggcgacagagtgagattccgtctcaaaaaaaaaaagaaaagaaaagaaatatgcttataccatttgatctgatgactctatttctggaaatttattaaacagtttatcaggacattatccaatttgcaaataaagacttatatataaagtgtattatttacaataggaaaaaaatcccaaatgtcccacaatcatggcaattatacaactattaacaatattttgagttacacaaaaagtctaattgattgcttttatgatatacataagcataaaataaatcttggaaggactatgccaaaatgtgaattgaggctatcattagttagtagattaagtgtgacctccattttataaaaatatttttctgtatttttaaattttttcataacaatgagaggtaggtttagtataaattaaggaattgtaggcctcatgatgagttgcttcaaaagaaataattgtcagggaggcaacttttgggccctgtaaacagaattcacagcctacccttaagactggcctttaatggagttgttccaacagacacagcacctaaggtggacggacgctccaataacgaagatggctatagacagaggctactgctaccttggcctctgggctttcatttttcaacccgcagaaataataatagaataacaatttatcctccgctgagttcctactatgtgctaagcactttacctgcttaatctcacttaatcctcccaacacctcttcaagaaaggtatgatcaatattattaccattttagagatcaaagaactgaggcttggaaagaggaaataactggctgaagccatcacatctcatttgtgtgtttccttgcctctcttctctttttctcttttctgcctttcatttggtccagctcatcaatgcatatcttgatttctgagctgaagaccacaaatccagttttccatctctctgaaaaacttttcatctcccttttttttttcctcagagtgaatataccaggccacctggaggcaggctttcctgagagcacctcccgcttccttttcctgctggcttttaacttttgccccgggggccacagccagctttctcacttggtagcagtggcctcttgtgcctttttctccaagatcacccaggtcagtatgtgtggttactctcagctccctgagggagtgagcagccagaggggcatagcatacttctctccctccagctcctttctccttggtcctaggccctctactcttcaagcccttttgcttgcttcagctcctgcttcttgctccatctcctcccatcttttctctcttctccaattcatttccttggactccatttctgcctttatacccttatctttattatcattgccaaaagcaaataccaaattcttgtatttgaaaaaagactttggccaggcacggtggctcacgcctgtaatcccagcactttgggaggccaaggcgggtggatcacgaggtcaggagttcgaggccagcctggccaacgtggtgaaactccgtctctactgaaaatacaaaaaatagcggggcatggtggtgcgcgcctgtagtcccagctactccggaggctgaggcagaacaatcgcttgaacccaggaggctgaggttgcattgagccgagatcatgccactgcactccaagctgggcaacagagcaagactgtctcaaaaataaataaataaataaataaaaaggagactttttttttagtgcagtgattccaagatttgttcatcgatatgcaaccaactaatgagtgttatgcctcacagttcccttctcctaagttttagagttagagtagtgggtgggaaggtgataaccacagtgtaaactaaaaatccatactggggatggaggctgagaggaggtttcaggggcaaatgaccagaacacttgcagctggaaagaactgtagagaggactttggaaagcggagggttgacagagccggtagttgtctcctgtccattcatctcctaggctgaagctcctgagggactcacatcagttatcttgctgctccagaagggtgggagatggcagttttcccaagctccggtctccccagatgtctgctcaccctcattctcctccagctgcccaaactggattcaggtaagtctctctctctctctgggctgcatagttgaaatatatcaataaatgtaaaataaacaatcccacttggctctccctggagacctccactggatccagacaaactcagctgtcaaaggagtaagagagcgcggggcactgcgctttggcgggaatctggtcggtgtctgtccgtagttcgcatctccacatcccgtctgatcccgctcgtttttcggcagctccctttgacgtgattggacccccggagcccatcctggccgttgtgggtgaggacgccgagctgccctgtcgcctgtccccgaacgcgagcgccgagcacttggagctacgctggttccgaaagaaggtttcgccggccgtgctggtgcatagggacgggcgcgagcaggaagccgagcagatgcccgagtaccgcgggcgggcgacgctggtccaggacggcatcgccaaggggcgcgtggccttgaggatccgtggcgtcagagtctctgacgacggggagtacacgtgctttttcagggaggatggaagctacgaagaagccctggtgcatctgaaggtggctggtgagtagacgggttttgactttctccgacgactcccctgctgtatacactttcgtatggatcagttactttggaaaccatcagattcattctcaaaatctcttttaggttgatgtcgccggggagggacgactatctgggcgggaggcgagggggggtaaaagaatttaccaagacagttgtaaagaaaggcagatttacttttaaaagtatgaaaatacttttcgaggaggcaaaaggcaggatcagcaaaagagaagctgactgccaggaaacaaaggcttgctggataatttatagaatagtttttatgctgtctgttgaagatggctttgtgcagtatctataaggcaaaggttgcagtgagctaacttgcaggtgtttggtgatagttggacacaggaaggatgactgtgagttatttgcacaggagggctgtgtactggaccatgaagaaaggcagacttgcagcttatctgccttatctctttgttttcccctgattaggactccacagctagaaggtactgaaggtcctacagtaggaaatcagtgagaaagggttttgagttgaacatggagagaacagtgcaatgtctttattgtagaactttatttcaattatctccagccctttttcaataatagggtaagcatttcttcatgaaataattaaatacatataagagttatataacattcttttatacaagtacaccataatttacttcatcgagtccctgaattgtacatttaaattgtatttctcaccattacacatcttatggctgtggtgagcataccacacactttaaggctggcttatggattagtttctaaagactgacatcctaagattagagagcatggcggtttgtcacattcctgattcatatagaaaagattctgttcttgttcccttttttgcttcaagccagaattcaaagggaaacaataaagaaaataataagctttgaggaggaaagtacgcattgaggtctgactttctcaattcctagtgaatgacatcaagcaaatctctttctgatttttactgtaaaactgaggatgtttttatctaagattatttttcaagaataaaatagtctgggaccagtggccaactcctataatctcagcgctttgggaagcagaggcaggaggatctcttgagccaagaaattcaaggttacagtaagctgatggttgccactgcactccagcctggacaatagagtgtgctgtcaaaaaaagaaaaaaaaaaagtgggatgtggtgtctcacgcctgtaatcccagcattttgggaggccaaggcgggtgactcacttttgatcaggatattcaagaccagcctggccaacatggcaaaaccccatctctactaaaaatacaaaaagaaattagctgggtcatacctgtaatcccagctactcaaggaaaatcgcttgaacctgggaggcagaggttgcagtgagctgagactgcactactgcactccagcctgggcaacagagtgagactcgtctctaacaaaaaaaaaaagaataaaataaaattagacaatatatgagaaatgacctcgccaattctaaaaacattatagacttattagatactatactgtgccttaaactgatctaaaacatataatatacaaacatattgcctttcacatatatatcatatatgtatatattatctaaatctatatgcatatattatatatatatatacatagatatatattcaagtaaatataaagtttgaaaaatacttgggtgaaatgtgggtccctgcttcacaacagggtcccccagttgcagcatcatgtataattcaaattttgacattttgtttttagggaagaagtatcttaaagcttgattataaaaacatagaaatttgatggcataaaatgtgttaccttttatgagtggcagacacccttgagaatctgctgaaagtggcagctccttccatgaaaagaatatatattcttgtatatacacacattcttggaatgtggattttaaccagtggttgtggaaatgtgtttaagagctcttttatgcagctcagtgtttttctgtaccatgtggaattacagaaaaaaataggctaaacacacaagaaaagcagctttatgtttatatataacaggccacaattatgtgagggaatatgaagttgagaccatttaagaaaatttctgaatcaacatcatagataaagaaagcttaaattgtcaactataatctcaagccaaagaatcgccaatcctctcctcaaggatattcctctgttcatccttaaatacccagtcctatttctcctcctccccaccaaagtcttctcataatgctctcagcctagaccactaacccacctctgagttattggtcttagtgttcctgctggctggacaagcacccccaagtctgcccaccaaactgctgcaaacatttcaaaggcttgatcccaacaaggcatccttctctgataaggtatatgaaattccttttattggtacttcaatttcctttaaaaaaaaaaaaaaacttttttagaaacagcatttcactctgtcacccaggctggagtgcagtggtgccatcacagctcactgcagccttgaactcctgaactcaagcaatcctccaacctcagcctcccaagtagctaggaatacaggcaagaaccaccatgcccaaagagatggggtctcattgtgttgcccaggctggtcttgatctcctggactcaagtaatcctgcctcagcctcccaaagtgctgacattacagacataaaccactgtgcctggccctcagtttccttgtatattgaaatatggagatgagttcttccccctactagtccacttgtgcctttctgtctctctctttctcaaactatgtagctctctggttataaggctcccaaaaggggtccgctaaaacattaagtctagattctctctccatagctctgggctctgaccctcacatcagtatgcaagttcaagagaatggagaaatctgtctggagtgcacctcagtgggatggtacccagagccccaggtgcagtggagaacttccaagggagagaagtttccatctacatcagagtccaggaatcctgatgaagaaggtttgttcactgtggctgcttcagtgatcatcagagacacttctacgaaaaatgtgtcctgctacatccagaatctccttcttggacaggagaagaaagtagaaatatccataccaggttagtggaaccaatgctgctggattcctatgttgacacagcttcagagccacaccacctgggacacctgcccagatgtgacctcatggcagagttgtctactttccccacctaagctcttttccagtgacttaagggaaccccaccaactttattagaagagttaagatactgaagacataaacctaccttgatctcaaataaatttcagattatttatctatttattttttgagacagtgtctcactctgttgcctagactggagtgcagcagcagaatgatctcagctcactgcaagctccgcttcccaggttcaagcgattctcctgcctcagcctccagaatagctgggacgacaagtgcacaccaccgtgcccaactaattttgtgtatttttagcgaaggcagggtttcaccatgttccccaggctggtcttgaacttctggcctcaagcaatccacctgcctcggcctcccaaagtgctgggattataggtgtgagccatcacacccagtgaaattccagattttccatttcaggagatctaagtgagatagagaagctttgtccctggaggccttcctgatccagagccttctctcctcaagtaaacaaaaagactaagttggccgggcgtggtggctcacgcctgtaatcccagcactttgtgaggccgagacaggcagatcacaaggtcaggagatcgagaccatactggccaacatggtgaaaccccgcctctactaaaaatacaaaaaaattagccaggcatggtggcgggtgcctgtagtcccagctacttgggaggctgaagcaggagaatggtgtgaacccgggaggcagagcttgcagtgagctgagattgcgccactgaactccactccagcctgggtgacagagcgagactgcatctcaaaaaaaaaaaaaaagactaagttatttttctacttttgccatttccacccatactcacttctccttcctatcccatgctagggctctgtctaggtttccagggtcctcagggaagaaaatcctctcattattccccagatactgtctctggttcaggcagaaacctttccttattctttggtcaatgagtcccattctgttacatacagaggcacacttccccttccttatttacctccttcatcctcttggctcccattctgcactgatagttaaggaagaatttccataatgacatgaattggtccattatatttattatttcacaggtcctgtcccaaaattactcgtcatttctctctttctctgctgactcctgcttgaagtcaatttttttctgaaaagtttagagtggcattggagtgactatttttttgctatatgagggatgagagtggtccaggccatcacctcttctaccctcctttggaatgtggagaaaagctggacttgctcagaatttctcaactaatgtccttcttggggattttgttttagcttcctccctcccaaggctgactccctggatagtggctgtggctgtcatcctgatggttctaggacttctcaccattgggtccatatttttcacttggagactatacaacgaaagacccagagagaggaggaatgaattcagctctaaaggtaaaccatagaatccacaagggctacgtgtcaggagtgcttcagaggcaggctggatccaagtcctttagaatgacttattttaggatgacaggaagatatttgaggctgggcatggtggctcacgcctgtaatcccagcggtttgggaagccgaggtaggtggatcatctgaggtcaggagttcgagatcagcccggccaacatggcaaaactccatctcgactaaaaatacaaaaattagccaggcttattggtgagtgcctgtaatcccagctactcgggaggctgaggcaggagaattgcttgaacccaggaggtggaggttgcagtaagccgagatcgtgccattgcactctagcctgagcgacagagtaagactccgtctcaaaaaaagtagaagatacttgattctagaattctgaaaattggaggaaatcataagggtcctgaagtcacagatgccaatatgaagaagcacagaggattggggcataggcagagtctaatcaagatatcagggctgatgtttactcactacccaccctcagaccctactcccacttttaactcaattgcccagtaccaatcttattattaaagatctgaggccgggcgcagtggctcatgcccgtagtaatcttagcactttgggaggccgagatgggtggaacacatgaggccaggagttcaagaccagactggacaacatggtgaaaccccgtctctaatgaaaatacaaaatttagccagggtcgtggcccacacctgtagtcccatctactcgggaggctgaggcgggagaatggcttgaacctgggagatggaggttacagtgagcagagattgcaccactgcactccagactgggcaacagaatgagattctataaaaaaaaaatctgatcccaagccagttccaatatgtaggaacttcctgcatctttcttcgaaaacaaagcaaaacaaaatccttgttcttgatttattggcaatgcttcaatattcaaatagtcatgaattaaacagttcctcctttgtgtgtttcccacacgagttttgtcccctcctttacgtccactatagaaagccattgaggtatttttgtttgttttccagagagactcctggaagaactcagtaagttctgtcttcttgttatttcacccacagagttttctctctcttattatataacctgtcaatgactatctttctcttttgttgcagaatggaaaaaggctaccttgcatgcaggtcagtggctctgaacttctctagggctctgaggctctatcccctaggaattcaaagtgctatgatacttggaaatgaaaacactaacactttagtgatgaggacaggaagggaaacggtgatgacagatggcctcaacagtttctgtgaggcacatagagaacccttggaagatggcacttccgacagagtcccattaggccctaggcacagttagctcttacatcaccctctggctgctggtaaggggggatcctgtggtgaatggagacccctgagcaggccaaacatccccccacctccagaagacctgtcaactcctacaacagtgttctgtttcttaggagaaggaaagacagtcctgcaacctgtaatattcactgatgtcagacctgctgtttctttctctccagttgatgtgactctggacccagacacagctcatccccacctctttctttatgaggattcaaaatctgttcgactggaagattcacgtcagaaactgcctgagaaaacagagagatttgactcctggccctgtgtgttgggccgtgagaccttcacctcaggaaggcattactgggaggtggaggtgggagacaggactgactgggcaatcggcgtgtgtagggagaatgtgatgaagaaaggatttgaccccatgactcctgagaatgggttctgggctgtagagttgtatggaaatgggtactgggccctcactcctctccggacccctctcccattggcagggcccccacgccgggttgggattttcctagactatgaatcaggagacatctccttctacaacatgaatgatggatctgatatctatactttctccaatgtcactttctctggccccctccggcccttcttttgcctatggtctagcggtaaaaagcccctgaccatctgcccaattgctgatgggcctgagagggtcacagtcattgctaatgcccaggacctttctaaggagatcccattgtcccccatgggggaggagtctgcccctagggatgcagacactctccattctaagctaatccctacccaacccagccaaggggcaccttaaggaatatctcagctcatctgttttcctttcctctaacccctctcctccatagccttctgaggcttcacctgctagctttacccagtctgtttcttcctgttgggtggcaattaattaatcctgtgaaggttacattgctgctgctagagagggtggggattgcaccttccaaatctgtttctgtaccaatatttgggggatggaggggtgactcaaactgcttctagtgttctcctaatcccttaagactagaacctataggaaactacttggagcaaactcaaaggacagattagggatcgagattgggtcaggttagcatggggttgtggttgaaatatcttggtatccaggataagggtatgtggaaaaacaggctttaggcaagtggaaaattcaaaatgtgctgtgaaaggacaatctcaggctgaaatcccataaaggaacttggagggaatattatgatggagggaagtgaggtgaatccaggcacatgatgaacacctggctcatccatagagttttcacagcctatatcgcaaattttctaagccacgtcctataggacagaggagactggccccacttctatgggtctgagctgtggaaaagggagagcagagaggaactgagatgagcagggatgaagggtcaggcagaaagcgtgatagaggagagaatttttgacaaaactcaaaagttgtttgcacagctgttctttgtaccctgttcctttctctgcgccctcctgtttctcccttgcctggaagtcattccaccctcaatttgttgatccacaagtttccagttgtcctcttctttttgttatagcatctctctatttcaaagacattcctagaagtcatccttcagtgatatcaccacttgctcagtcaccatctcaaccttatgtcacctcagccctcatctcaatgcccaaaccccttacacacaccttcagttagcttcaactgcctccgtttccacactgtgcacctttcactttccctacccagctttcctacatgctgcctctcctcagggtcccctgaatgctgcatcattgtgttcagtgcagctggactgattgcacctgtgtatttgcccctgagcactttcctttacacatgtggcttgtcttgccaatagactccaggcttacaccttccatttccatcgtattctccagtttccaggatagatgttgctcatcgtctttacctaataaataagtttgtctgattgctgaaagcaacctcttaacctttcttttttaatatcaactgaaacaaaataaaacatagggcaagaaacctgcatgggaatgcagctgtctaaagctttgccattgtatgtggtctaagacccatccctaggcctgatggcagtgggctcaccagggcaggtgcacatgggggctgatgcctcatgagggaacaactgcttaccagggtcttcaagcaggaatacagaatctcaactcaggaacaattttttattagtccatcctcatatttctgtaaagaaatacctgagactgggtaatttataaagataagaagtttaggccgggcacggtggctcatgcctgtaatcccagcactttggaaggccgaggcgggtggatcacgaggtcaggagtttgaaaccagcctgacaaacatggtgaaaccccgtctctactaaaaacacaaaaattagccgggtgtggtggcaggcacccgtaatcccagctgctcagaaggctgaggcaggagaatcacttgaacccgggaggcagaggttgcagtgagctgagatcgcgccactgcactccagcctgggtgacagagcaagactccatttaaaaaaaaaaaaaaaaaaaagataagaagtttaattggctcatagttatgtaggcatgacagcttctgctcagcttctggggaggcctcagaaaatttacaatcatggcagaaggcgaaggggaagcaggcacatcttacatggccatggcagaaggaagacagcagcagggacgggggaggagagaggggggagcgggggatgtgctacacactcttaaacaatcagatgtcataattagtcactcattcactatcacaaaaatagcattggccgggcatggtggctcacgcctgtaatcccagcactttagaaggccgaggcaggcagatcacctgaggtcaggagttcaagaccagcctaacatggtgaaaccccgtctctactaaaaataccaaaaaaattagccgggcttggtggcacatgcctgtagtcccagctacttgggaggctgaggcaggagaatcggttgaacctgggaggcagaggttgcagtgagccgagatcatgccactcacttcactccagcctaggcgacagagagagactctgtctccaaaaaaaatagcactgaggggatggtgctaaaccactcatgagaaaccgcccccatgatctaattacctcccaacaggctgcacctccaacattagggattacaattgaacatgggatttgggtggggactcagatccaaactatatcaaataatatccaaagatcacccaccccattttttttcttttaattacaaggccttaacattaaagatttcccaaatatttcctcctcttgcaaaagtactgttaaagagttggcttcacttacctataccattgaccaggttacctttacagtagtagaaatgaagttcaccacccaaacaggggcagagggtaggtagccattggcactctggccttttggatagctgaacacacggaggtttctggagggcagtgtgtgcacagagaaagcttcggagctgcatgccccttcccacacatcttgccctgtacatattttccatctgtcttttcatctgtatactttgtaatatcctttataataaatcagtaaacatgtatttgcaggataggttggataaaatcaagagtaaagtctattgaaggaaggaggaggcttagtagcatcagtccccggatttaaaagggatgtttgaacgaaactgggattccgagaagaggaaagagaagactaaaaaaaggagctaaaagaaattgctcgatctatttataatacattatgatgtattatgaaagtaaataccactctaatactttcagaatacattataatcctccctgcacttacttgcttaaatccagcatctatttctgcaatattaaaatcctccaaagcattctatttcttttaggggc

SEQ ID NO: 11994 - DNA, 35380 bp, Human
  misc_feature (1)...(35380): n = A,T,C or G
ggactgcacaaacgatgcccatgtaaaacatctgtttgtttttattatttatttatttagagacgggttctcactctgttgcccaggctggatgaaatgcagtggcctgatcttagctcactgcagcctcctcaatcaggagtcaaggatactcctgcctcagtcttcctagtatctgggtctacgggtgtgcaccatgccaggctaatttttttatttttatgtttgtagagacaggggtctcactatgttgcccaggctagtcttgaactcctggcctcaaatgatccacctgcatcagcttcccaaagtgctcagatcacagggagagccacctcgcccagccaattctgacctctttgccagtccattctggatggaagcagtccctccccttcagaatcccattgaattctccatagtaccacagtcttttggcacttacctttgcaggagtagctcttttgctcacaaatgtacttcctgtaactacattttaagctcattatttggatcatgtagcatccagaattttattctgctttgaatagctgcttccccaggtagacaggaaaccaaaattctcctacacaaattttggggctgaagttggggcgccgtggctcacgcctgtaatcccagcactgtgggaggccgaggcaggtcgatcacctgaggtcagcctggccaacatggtgaaacctgtctctactaaaatacaaaaattagccgggcgtggtggcgggcgcctgtaatcccagctactcgggaggctgagggagaatcgcttgaacccgggaggcggaggttgtagtgagctaagatcgcaccactacactccagcctgagcgacagagcaagacttcgtctcaaaaaaataaaaataaaaaaaatttgggggttgagggttggatgatactaactcatgcaaacaccaaaccctgcctttcttccccttcccggtggcaagagggcttttcagatcagtgatacattcgctgattctagtgttttccaccctagtagtcaagcctttgggtgtccaaacaaatagagaacaagagatcaggatctctaaaggtctagaaaaaccctgggccacttccattttgtgaggttctcagcatactgaaaactgaagatgtactaagagtgggttactaaaatggtggcgtatcttaaatctttccatggcaccatcctttctctcgtcctgtcatccctgtatctctctgccctgacacctaatctcacttcaggaaacataaattgaaagttcaaataacctcggattatattattctggactgtgtgttatgctgggcgacgaggctgcgcaggctcctgggccgagccatgactctgcaggaactgcggcgccggctcacacagcgcggagcagtgcacgccaatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacgggtgagggctactgggggttgggttggaacgccccgaaggcaccacagcaaccgacgcgggaacgcctgttaaaccagccccgccccgagacgcgcgcgcccggcggtctcgatccagcgtggcccgcccctcacctcccgcccaaccaacagccacttcctgcctcactcccggccaatcttcacactccacgaagaatagccgtagggggcgtatgggacggtgcgtagagcgatgcccacgccggccaaccggatgtcggggcttgcgcgggagggcgggacttggcgccggctgtggctactcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtcctcgggaggctagaggtgagaggggagacctgagcgcgtcctcgggcctgtgaggacctcggggggctgggagcgcctctgcggctgaggggtcgggcgtggccggcgactgaggggtcgggctggctcttgagggcccaggccctggccgacgcgcccgccgtgagcgaggaggcccgaatccgggcgtctttggttgggttgcgggcccaggccgcgccgccggggtcgggaggcgtggcaggtggcccgacagccttctttgacctctgggaaagctgacttattcctatggctttgcttctagggctttcttaggcctctttgccggctgcctgggcagccgcgaggtgggctggagtaactggataaaagtatagggtggaatcgggcctactaggtacccctagtagtagggaagggtggtattagaccgagagggaatgtttacaactagcgttacagtttaatatttgaaaatccaaagcggagactggaccctagttccctgaagagaaaggggaatgtaccagaaggagaacatgcagtggttgagaaacttagcagttacagcacctattctggaggcgagtaatccagttggagagggacagggcgttaaaagcaggaaagcccccgaaagctcatctaagtgcatctctttccacaccggaggcctggaggtatgaaatgactggcccaaggtcatgcgattagtgtactgatggtgctgggattatagttcagggatagaccgtgcagtggttaacgctaaggccctggctcgagtctttgattggtcattggttgctctgtgaacttcggcagttttcttaccctttgtgcccccgttcttgtcaagtaatggatataataatacccgatggatttgtgaggattaaattaagatatgtatacaataagacagggaagtccgacatttagtaactgctcgatgatcattgcggtacgttattataatctgaatgcctttggaccaatacactgccatcctagtgaactggttcagtcctgtttcgcaggacctgaggtcacagttatggtgatagaagaaaccgggcattgtgtattaccgctgggcatgacacaagtgattgctggttgagggaagttaaactgagcttaatattaaaagattgagaggacaagattaaccatagttaagtctttttacctctgatttaggaaatggaagattttgcttaattttttaataagtagatttttttaagggggaagaattttattgatctttaaaatcattctgtatctcagtcttttcccaacattgtttgagggtcatgaatagaagcaactgccatatggatcaactgttgtacatttggtataattatacttagagcagaggtaaaggactatgtgggagttctcctgtgcatcagccagggtgcacacacaagccaggtaactggatcatgagaatgctcgagtgaactgtgtgtgggggtcagtgttgcacaacagaaattttctgacttatctgcaaatggctgtcagcattccccgacaccttactatccttactccccagttcatttagcgcattatcttctcagggccacaagggataagtgttttgacagaagtcgttgctgccgttttggcaatcacactattgcatccttttagttagagttctctttgccctggaagacagcttaaggggatgaagtggcagttggtgagcatgaattgcaggctcatgaaacttgaattgtgtgcccagtgtggtaacctttttttttttttttttagacggagtctcgctctgtcactcaggctggagtgcagtggcgcgatctcggctcactgcaagctccgcctcccgggttcacgccattctcctgcctcagcctcccttgtagctgggactacaggtgcccgccaccacgcccggctaattttgtttttgtatttttagtagagacggggtttcaccgtgttagccaggatggtctcaatactccctgacctcgtgatccgcccacctcggcctcccaaaatgctgggattacaggcgtgagccactgcgcccggcccagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccttgcactccagcctgggtgacagtgtgagactccatctcaggaaaaacaaaaaaaaaagtgtaatgaactgtgcaaatagaatacgccgtttataataactcctaggaaataataaaagtacctaaacagttaaaacctatacagcttttggtaaaacttttcaggaaagtcctggttgaattctttgttactccaacagatgtacttttttttttttttttttttttttttttgagacggagtctccctctcaggctggagtacagtggtgtgatcttggctcactgcaacctccgcctcctgggttcaagcaattctcctgcctcagcctcccaagtagctgggactacaggtgcccaccaccacacccggcccggttttttgtattttagtagagacggggtttcaccgggttgtccaggctggttgcgaactcctgagctcaggcagtccgcccacctcggcctcccaaagtgctgggattacaggtgtgagccaccgcgctcagccttacttatttttttagagacagggtcttgctcttcatcaggctggagtgcagtggcgtggttattgctcactgcagtctcaaactcctgctgttattggttcaagtgatcttcctgcctcagtctcctgagtgagtagctggatccacaggcggatgacgctacactcagctaatttttttttttttcctaatttttcatagatacttcgctttgttgcccaggctggtctcgaactcctgagctcaagcgatcatcctgcttcctccaactcccagagttctgggattacacgcgcgagccacgatgccaaccaggagaccagaaattaagctcagctttctttctctcccttcttccctccctccctccctcctttccttccttccttcttttttaaaactttgtggtatctgtttgtgaattgcttattttacttaccatattgtcttcaaagttcatccatgttatagccggtgatgggatttccttcctttttgagattgaatagtattccattgtatgcctatgccacatatggtttaatcattcatccattgatggacacttgggttgcttctgactgttggctgttgtgagtagtactgctatgaacacgggtctgcaaatatctctgaaactctgccttctttttctgtttgtttgtttgtttgtttaaggcagtcttactctgttgcccaggcttgaatgcagtggtgccattacagctcactttattttttatttttttgagacagtctcactcttgttggccaggctgcagtgcagtggcgtgatttcaactcacactgcaaactccacttcccgggttcaagctattctcctgcctcagcctcctgagtaactgggattacaggcatctgccaccacacccagctaattttgtgtttttagtagagacagggtttctccgtggtggtcaggctggtcttgaactcccgaactcaggtgatccacctgcctcggcctcccaaagtgctgtgattacaggtgtgagccaccacgcccagcctgcccagctaatttttgtatttttagtagagacagggttttgccatgttggccaggctggtctcgaattcctgacctcagatgatctgcctgccttggactcccaatgtgctgggattattggcgtgagccaccgcgcctggtggagtggtggagtcttttttttttttttgaggtggagtctctgtggcccaggctggagtgcagtggcgccatctcgggtcactgcatcctccgcctcccaggttcaagcgattctcctccctcagcctcctgagtagctgcggctacaggtgtgcgccaccacactcggctaattttttgtattttagtagaaacggagtttcatcatgtttccctggctggtctcctgagctcaggcagtctaccagcctcccaacgtgctaggattacaggcgtgagccaccccaccctgcccaacgactcacttagcttcaacctgtcagactcaggcttctcctaccttagccttcttagtatctgggacaacaggtgtgtgctaccatacctggctaaatttttctttttttgattttttgtagagacaggataatttttttttttttttgtatagacagggtcaggctatgtttatgttggccaggctgggaaataaggtcttaatagaggaagttgaagattcctgggggaatagcatgtagagcagctatagagggagagggtgctgattactagctaaaagacttagaaatttttgcaaacatggactcatgatagtttttgggtgatgagtcttcttgtaggatagcttgaaagaggaggaggaaactagaggccctggtaatataaggtaacattaagtatcctgatgtcagtaatggagaagagtgaaagactatgattgattgggtgactgtgtgggcagaggatgtgaggaaaaaaggacatcttgtgtgtgtgtgcgcacacatttttagttgtgtatcttctacttgttttctcccccaccttgtacctgtactttctcaagcccaaaaatgaaaatttacctgctaccaaccacatcatcttgtgcatctgtgtagctcagtttttatttctttagatctgtggtcctccgtggaaagagagccactaccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtggtgcacacctgtcatcccacctacttgggaggctgaggtaggagaatcacttgaacccaggaggcggaggttgcagtgagccaagatagtgccaatgcatcccagcctggcgatagagcaagactcatctcaggaaaaaaaaaaaaaaggagcttgttttggccaggtgcagtggctcacgcctgtaatcccagcactttgggaggctgaggcaggtggatcacctgaggtcaggagttcgagaccagcctggccaacatggcgaaaccctgtctatactaaaagtacaaaaattagccgggcatggtggtgggtgcctgtaatcacagctactcaagaggctgaggtgggagaattacttgaacctgggaggcggcggttgcagtgagctgagatggtgccactgcactccagcctgggcgacagagggagaatccatcacaaaataaataaataaaatatataaattttaaaaagtagcttgttcttagtttaatattctttttgagttctaaaacgctaatttgaaaacatgtctattgatgatatttgagcaaccgtatccatattaagccttaatatgagaggaattatcttctgtgttaatttttttttttgagacgaactcttgctctgtcacgcaggctagagtgtagtggcgtgctcactgcaacctccacctcctgggttcaagcagttctcctgactcagcctcccaagtagctgagactacaggcgcccgctatcgctcccagctaatttttgtatttttagtagagaagagtttcgccatgttggccaggctggttgtgaactcctgacctagtgagccacctgcctcggcctcccaaagtgctgggattacaggcgtgagccacggcgcccggccatctctgttatttcattgtaatgttttaacgggtaccccctgtaaattagtgtatgaaagggcttttgtctgttgtaaagcactttacaaatgcaaaagtttgttggaaattgtatttgaatgccccacatctgtgtaaccaatcctctctatatgaggatgttgtgtatgtttcagttttattttgaaattttccagaaatggaatcttttaactgattttagggaaaccctttaatctctctaggctgcctttctttatctatgaaatgaaatagtaagttctttttagctctgcgatttaaaagctttaattttaaatgagagagtggttagtgatcttcatgaagtttgataggtggcaatacatttaactgattttgctctttatgtgtagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggtttgaaatggtctttgaatctattccttttacgtcttgagatgataaaattatgaagatacccgggtgcagggaaatgtagtctcaactactcaggaggcctaggacaggagtgtgagtccagccttggcaacacagggagatatcatctctaataaaatataaaagaaaaacatggtgaagataaatttggaacgttttcaaagggaaagcaaaattcgtgaaaatacttattgatctctctggcagcctttgtcttgctagaggccaattatatgggttgaatttgaaggccagctatgaaatttttgtgacagttgaaagcaaaccaggagaatagattctagataaaaaggcatgttgctgaaaatttaaatttttaattcatttatgtatttaacacaggttacttacaaagctccagttccaacaggggaagtatattttgctgattcttttgacagaggaactctgtcagggtaagtgttttccagagaaatatatgttagaggcagacatgtaaataagatgggatagtagattcctttttggatagcatcttttatagtgaaatgtctaactttattttattttatttatttattttttgagacagaatttcgctcttttgcctgggctggagtgcaatggcgtgataccggctcattgccacctccgtctcctgggttcaagtgattctcctgcctcagcttcccaagtagctgggattataggcatgcgccaccatgctggccaatttgtgtgtgtgtgttgttatttttttagtagagatggggttttgacatgttggccaggctggtcttgaactcctgacctcaggtggtccacttgccttagcctcccaaattgttggcattacaggcatgagccaccgcacctggcctgaaatttctagctttaatatcttcagtgttaacatccatgcaggaaaatagtcttttggaatttgtggtttttacttccacttctttccctcccccactctaccctatattttgttctttgattgaggaaaaaaattttctcttgatgttaaaacatcagtggaattatctcataggtttggtactttttcatataggtttgtgagttgaagataatgtattatcattagttgtgtgacagatttaaaggttggaagtagagtggttaaataggctaagagcagaataggtcctactttaatgagtatttacataattttccctcacaagtcaactgtcattttaagactgattttgggatttgttatttacaggtggattttatccaaagccaagaaagacgataccgatgatgaaattgccaaatatgatggtgagaatcccatttggtttagatataatagcagatagaggtttgacatgttgtctccatggcatttcctaagactagtttaaaaggacatagtaggctttaagatttttccagccaggtgcggtggctcacgcctgtaatcccagcactttcggaagccaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagcttttcctgctagtttgagatcataaataggcatgcctctttctgaagaatataataaccttttttttttttgagatggagtttcactcttgttccccaggctggagtgcaattgtgtgatcttggctcaccacaacctctgcctcttgcattcaagcgattctcctgccttggcctcccaagtagctgggattacaggcatgtgccaccacgcctggctaatttttttttttttttttttagtagagatgggttttctccatgttggtcaggctggtctcaaactcccgacgtcaggtgatctgcccgcctcagcctcccaaactgctgggttataggcgtgagccaccgcgcctggactacctttttaatttttttgaggcggagtattgctctgtcacccaggtgggcgtgcagtggcgtgatcttggcctactgtgacgtctgcctcccgggttcaagcgattctcttgccacagcctcctgagtagctgggattacaggcttgtgccaccatgcccagctaatttttcttttttttattattattattattttttttttccagctaatttttctgtttttagtagagaccgggtttcaccatgttggccaggctggtctcgaactcctgacctcaagtgatctgcccgcctcagctcctgaaagtgctgggattacaggtgtgagtcactgtacccagcctagaatataacaacctttttttcttttttttgtgacggagtcttgctttgtcatccaggctggagtgcagtggcgccatcttggctcactgcagcctccgcttcccaggttccagtgattctcccgtctcagcctccccagtagctgggattacaggcacacaccaccatgtccaactaatttttgtatttttagtagagccttgttggccaggctgatctcaaactcttggccatctgttgatccgcccacctcggcctcccaaagtgctaggattacaggcgtgagccactgagcccagcttaacctttttttgttatttccaaaagtaatacatatttaaggtatagaaattcagaagccataagtaagcaaaaagaaaacacttaaagcgagggagaggggttgaagacaagttggttaattggtacagaaataaggtagaaggaataaattctaatatttgatagtacagtagggaaattatagttagaacaatttatggtgtatttcagaagagctggaagagaattgtactgttcccaatacaaagaaaaagtaaatggagccaggtgcagtgggctcaggcctataatccctgcgcttttgggaggctgaggtgggaggatcacttgaggccaggagttctagaccagcccgggcagcatagtgagaccttgttcctacaaaaaaaataattattcaggcttggtagcatgtacctctagtcccaggtgctcgggaggctgtggtataaaaggatcccttgagtccaggattcgagattgcagtgagctatgattgggccactgcactccagcgtgggtcacagaatgagactctgtctctataaaatagaaagaaaaggtaaatgtttaaggttacagatatttcaattactgtgatttgtttgttttgttttgttttgttttgttctttttgtttttttgagatgggagtctcgctctgttgcccaggctggagtgcagtggcctgatctcagctcactgcaacttctgcctcccgggttcaagcgattctcctgcctcagcctcccgaatagttgggactataggcatgcgccaccatgcccggccaatttttttgtatgtttagtagagttggggtttcaccatgttggtcaggctggtctcgaactcccaacctcaaatgatgggcctgcctcagcctcccagagtgctgggattataggcatgagccactgggcccgtccaatgactgtgatttggtcattacacattatatacatgtatcaaaatatcacacgtaccccgaaaatatgtacaagtacgatatgtcaataaaaacatacacaaagaagtcacttaaaattatcttaaacatcagcattgtgatatatatttgtcaatatgtgtatatacacatatacaactttacatgctatatctaacttttttatttttttatttatttttatttttttttttgagacggagtctcgctctgtctcccagactggagtgcagtggtgcgatctccgctcagtgcaaactccgcctcccgggttcacgccattctcctgcctcagcctcccgagtagctgggactacaggtgcccaccaccacgctgggctaattttttgtatttttggtagagacggggtttcaccgtgttagccaggatggtctcgatctcctgacctcgtgattcgcccgtctcggcctcccaaagtgctgggattacaggcgtgagccactgcgcccggcccttttttatttgagacagaaacactgcaatctccacctcccaggttcaagcgattcttgtgccttagcctcccaagtagttgggtttacaggtgtgcaccaacatgcccacctagtttttgtatttttagtagagacagggtttcaccatgttggccaggctggtctcgaactcctggcctcaagtgatccacctgcgttagcctcccaaagtgctgggattacaggcatgagccaccacacccgtttcttaacaacaaaagagtgtgaagttcttcctcacagaaatattcattttcattatcactgacacagcagcataggattccttgtttggatgtgctgtaactcagtctcctgtgtattagatatctaggtgtggaatctgggctttaatatacatcacacttaagatgcttttatggggcccatgtggctgggcacggtggctcacacctgtagtcttaacaccttgggaggctgaggttgggcagattgcctgagctcaggagtttgagaccagcctgggcaacattgcaaaaccccatctctacttaaaatannnnnnnnnnnnnnnnnnnnttccagctactgcggaggctgaggcaggagaatcgcttgaacctgggaggcgggcgttgcagttagccgagatcacaccactgcactccagcctgggagacaaagcgagactctgttctcaaaaaaataaaataaaattttaaaaaatgcttttatggatttaaaattgttttttcattctccatgggagttaaaaagtagaaagtagaatcatgagtggacatgcgttttaataaattggaggtttgtgtaatttcagtaacgtaataataccagctctattaaaaatgaagaaatggaccttttgtactgggaagtagttgtaagtccacgtatttgtcttctcactggtgtatatgtgtaagcccaataattgtgttagtttatgtagtttcttgttttttttgttttttttttttagtgtctataagtcaagtctttggtgttaaagattttaactatcatttgctgtaattcttagaaagccgagggactaatcatttatgtttcgtgcataaggaaatgggcgttagcttccccaagaccccaggagccaggcattgttcttaccccaaagcctcaggtcagacttctgctgcttcacgttagaagtcatgatcttttgtattatggtaaagggagcttggaaaattaagtacttttaattccatttaatgtttctttcagtcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactggtgagtcttggggaactgtcttcaagtgtaagggagcatttcatatattccatgtggcttgaacaacgaaatgttggttgagtaagctctgataatttcagtaatccatgatgcagtctaatctgtagggaaaatatagagtactatagctggaaaggggccatagtgtaatcatctggattgactcaccattttacaagccacagaatgccacacttgataagagtttgtctgtggtgacactgttggtttgtggcagaatctcaggtcctttaacctggctactccagggcttctgtgaactcacatttaaagccaaagttctgaaatgctaaattttaatttgaaaaataacctttttcctatttaaacaacagtcaattctctgctgtgggttgggtggtagaatacaaagccacaaggacaccaccatctgcctacacagagcttgaagtccagttgtgaggcatgatgttggcatgtggtatcgtaagggttcatgagaaggtgccacaggagaccagagcaccaggtgtacctaaactaggcatggtttcttggagcaaggcaaatcagattgagacttggcagtgaggtgagaattaaggagttggtgaatatgggaaggggtgtttctgattgaagaatgtcgtatgcagaagtagaggagcagcaatgagcttgacatgcgagggagaaattacatggccttttatgtagggtgcacattgaagagtgaggagaaatgaagatagctggggctgtattcttgtatatggctgtctttgaacttgcaacttcacacagtgactccagaaatgtcagaaagtgaacaaagaaattcttaccctttgtaaaatatcctcctatgcttagcaattacattctagattatctttttcctccttgaaaggtaagatacatataactgaacttttgtactgcactagtataaatgccaagtttacttgtatatttggtgtatattagatttggacttagccttgttcagtattatattccttaactagctttatcacctaagaaggcccctgtacccattaagcggccactccctgtttcctcccccaactcccagcaaccactaacctgctttctgcctctctacatttgtccactttgtatatttcatataaaatggaatcatacagtatgtggctttctctgtccagtttctttcatttagcacagtgttttccaggtttatctgtgttgaagcatgtatcagtactgcattcctttttatgattgaataaattctactgttttgataatgccacattttatttatccatcctttggtggacatttaggttgtttgctcctttttgtctgtgattatgaataatgctgctatgaatgttcatgtactggtttttacataaatatgttttttcttttcttgcttttttttttttgagatggagtgtagctctgtcgcccaggctggagtgcagtggcgccatcacggctcactgcaacctctgtctcccgagttcaagtgattctcccgccctagcctcccaagtagctgggatcacaagcgcatgccaccacacccagctaatttttgtatttttagtagacacggggttttaccatgttggtcaggctgatctcgatctcctgacctcaggtgatctacccgcctcagcctcccaaagtgctgggattacaggcgtgagccaccacacctggcctcttttctttagacatgatctctgtgttgcccaggtgggagtacagtggtacggtcacggctcactgcagcttccactttctggggtcaagcgatcctctcccgccttagcttctcaagtagctgggactgcaggtatgcacgcctggctaatttttatgggttttttgtttgtttgttgagacagagtctcgttttgtcacccaggctggagtgcagtggcacgatctcgtctcattgcaacctctgcctcccgggttcaaacgattctcgtgcctcagcatcccaagtagctgggactacaagcgtgcaccactgcactcgtgcctcaccctccaagtagctgggactacaagcgcgcactactacaaaaaattcttgtatttttagtagagatgggatttcaccatgttggccaggatggtctcaaaattctgatgtcaagtgatctaccagcctcagcctcccaaagtgctgggattacaggcgtgtgccaccgtgcctggctgtgcatgttttttctttttttttgagacggagcttcgctcttgtcgcccaggctggagtgtagtggcgtgatcttggctcaccacaacctctgcctcccggtttcaagtgattctcctgcctcagcctacctgagtagctgggattacaggcatgtgccaccacgcccagctaattttgtatttttagtagagatggggtttctccatgttggtcaggctggtctcaaactcccgacctcaggtgatctgcccaccttggcctcccaaagtgctaggattacaggcatgagccactacacctggcttaatttttgtattttttggtagagacagggtgtcgtcatattggtcaggccggtcttgaactcctgtcctcaggtgatccacccgccttggcctcccaaagtgctgggattacaggtgtgagccaccgcacctggccttgtgtatttttttttttttactagagactgggtttcaccttgttgcccaggctggtgtggcctcaagtgatcctcctgccttggcctcccaaagtgctgagattacaggcatgagccactctgtctagctatagatatatattttcatttctcttgggtatatatacctaaaagtggaattgctgggtcatgtggtaactaactttttgagaaactgccaaactgttttccaaatgagcagtaccattttactttcccaccagcagtgtatgagggtttcagtttctctgcgttctttccagcatttgtttttatgagtcttttttattagagccaacttggtactaagtggtatcgttttgatttgccatttccctgatggctaatgatgttaagcatcttttcgtgtgcttattgtatgttcatattgtatatttttacattcgtatgtcttctttggagaaatgtctattaaaatcatttgcccatttttaaattgggttgtctttatattattgagttgtaaagagttattttactaggcccttagcagatatatgatttacaagtattttctaagaggaattattttaaattttgagattaaaaacaaatttttttagaatactctgttctgatccacaaagtggtactatactgtgaccagtgttgtcataactggctttttcttttgtatttaagggatgaagatgcccctgctaagattccagatgaagaggccacaaaacccgaaggctggttagatgatgagcctgagtacgtacctgatccagacgcagagaaacctgaggattggtaagaacttcagttaactttttttaattacctggtttttttgtttgtttttttttttgagatggagtctcactctgtctcccaggctggagttcagtggcgcagtttcggctcactgcaactttcacctcctgggttcaagtgattctcctccatcagccttgcgagtagctgggattacaggtgtgtgccaccacacccggcaaatttctgtattttttgtatttttagtagagacggactttcaccgtgttggccaggctggtctcaaagtcctgacctcaagtgatctgtctgccttggcctcccaaagtgctgggattacaggcgtgagccaccacacccagcataagttacctgtttttattgaagtcaatcttaatacttaaatatagccaagttccctaatttcagggtagaatttgacaattttaattatattttcttcttttttaaaaaataaatttttcctgaaaaactgttattactggaaatacaggagaagctggtctgggatactgtgaaaacatttcagcaggatcttggcagccctgggccagccagctgttcatagtcctgcatcacagaacctgtttataatttgttgtttgtacctccgtagggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccaggtttgtgcctcttgatggttgagttgctttcattaatctgtttgtattcagatagaagttttatctagagtaaggctgccaggttggtcattatattcaagctgttgaattaaaagcagaaagtagacttcctaagttgaaagagagcttaatgggttaggtattgcaaagataaacctagaaactggagtgaataactttctttaactttatttatttatttatttatttatttatttttgagatggagtttcgctcttctacccaggctggagggcagtggtgtgatgtcgcctcactgcaacctctgccttccggtttcaagcgattctcttgcctcagactcccgagtagctgggattacaggtgcctgccaccacgcctggctaatttttatatttttagcagagatggtgtttcaccatgttggccaggctggtctcgaactcctgacctcgcgatccgcccacctcaacctcctaaagtgctgggattacaggcgtgagccactgcatctggtcaactttctttttttgagactgagtctcactctagtggccaggctggagtgcaatggctcagtctcggcacactgccacctccacctcctgggttcaagcaattctcctgactcagcctcccgagtagctgggagcacaggtgtgctcacaggtgtgctcacctcacctggctgattttttgtatttttagtagagacggggcttcgccatgttggccaggctggtctcgaactcctgacctcaggtgatccacctgccttcgcctttcgaagtcctggggtttcaggcgggagccactgtgcccagccaagaataactttcatagttgctttgtaactatatttaaaaacaaaagagaaatggaaaactgttgatttgggtaccctgctcttgggtgccagggttgcttcagccataggatccacagctgagtctggacaatctgtgatgtggtgggtagaggactgtggtttgagtcagcatcttgactacatcaagtcagctcactgcttggcctcaatgcttgcaactataaaaagactgaggcccaaaagagatggtaaggatacaagtagtaaggttgtgaggctttaggcctcatgcaaaaatgtacaccctcagacctttgttccttttatctttctagccaagtaaaattatttataatctctacaaagagtggcaattaaaattatttataatcattaatttctactttatttatatacaaatactaatatatgtatatacatatacagaaacaggagaagctggtctgatactgtgaaaacatttcagcaggatcttggcatagtatatgtatatatacatatactaatatatgtttttctgtttgtaaattttttatttttttcctcatagtcgttaaagatgttatgtgaatgtatttttaattgtgtagtcaaacaataagataaaagttttactttaaaaaagttgccctttaggctgggcgtagtggctcacgcctataatcccagcacttgagaggctgaggtgggtggatcacctgaggtcagccattcgagaccagcctggccaacatagtgaaacaccatctctactaaaagcacaaaaattggcctggtatggtggcacacacctgtagtcccagctgcttaggcacgaggctgaggcacaaggatcacttgaacacaggaggcagaagttacagtgaaaaagaagttgccctttagttgttctcctgttggtggccatttaggtggattgtcacttttgctttcagagtcactgctgctgtaataatccttgtacatgtctgggtgtatgttgtgagtatttctctaggtagttatctagaagtgaattgctggttgatgatcatgtgcgttttattttaaatcaccactgaagaagtacgtactgacttatgctcccactctcattagcagttgctaagagtggaggctgttgaatgggccaggaacttgaggggttggtttggaccaaggtcatgggtgacagtagaaattggaagtagttggaatcctgcagtcttagaggcagagtgcgtaaaataatctgtagcatttgttatttattttcctgttgcttatttcaagtttcatgaagttggcatttctctccattgttcatgcaaaatttctcttacggtagattcaccataaacttttgttgatcattatctgaaatgattttctgaaacatttttttttctagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgaggttcgtgtttgctgcttgtgcatttgtgtctgttattgtaaggagctgttattttgtgaaagtctgtgttaaggttttttttcttcatttggcaatattggcataaaaagtataaccatatgcctgcaaaagacacaatattgggttttggggcatgatttcattagtctaatgtagtggctttagagtctgtttgtgttcagggttttttttttattatttgtctgggtatatatttcgaaatttgtcatttaggctatattttaatacactcttatatgttgaatctcggtttacactacatacagaattttcaaacaactggtcatgtggccgatttaagaattggagagccagggatactgagataagaaattcactggatcctgaggttaagggagccttttgcaggtgatgtagaagccagcttttgcacctatgagagtgaaatcatcttgattataaggagagcaagaggatggaggctttctctaatttcttttttacattttatgagcattttctctgaaaaagaaggtcctgcgtagtgccatgccataactgaactgcagaaaaacagcacggcctatgtttggtgtcaaaagctggaactttcaatcagccctgtcttgtttttcagccaggcgttgtggggcagatgatcgaggcagctgaagagcgcccgtggctgtgggtagtctatattctaactgtagcccttcctgtgttcctggttatcctcttctgctgttctggaaaggtaggaagtttttttttttagaatcaattttagagacatcactctagtgattattaaaaataactaagatatgttgcctgaggttttctttgtagtggctcagtaatgaccaagccatgtttggtgttgacttcagaaaccttacttactgttcctcagtggccgtttattgtgcccagatgggagcaggatttatagccccttggttgctattattatttatcctaatctgttactctccatagtgttcggcagcaactttctaaaaaaaaacaataaacttagataccaaactagccacttgggcaataatcagctttgcctgctggcatagctatttctattctttgtaattcagtctttgattcctcattatccattctgccttcaccttccccactctcaaaacagtatgttggggtaccacagccttattgttagtttttcttgtttagcctttttttttttgcatgctatcataaaaaaagaaagtcttattttggactctacttctgctaaatgaggattatgcttcatctggcattcatagcactttgtaactggatcccaagttccttttccagcctcagcctctgccactattctgtgtatcggtgcctcagtcaccttgacttttttgacctttattttcctgcctggcccttttgtttttattgttctaccttgaaacacacaagcacatgtgcatacacacacgtacatacacgctcttcagggtaggaattacatcctattcgtttctgtatatctatccctgtatacagcctggaacagaactttgcctgtaggcattcaggaattatataacataatacatgaacatgtaaacaaaattgtactttggggaacatttcagaaacagaccagtggtatggagtataagaaaactgatgcacctcaaccggatgtgaaggaagaggaagaagagaaggaagaggaaaaggacaagggagatgaggaggaggaaggagaagagaaacttggtaagaaacagagtccagaaaatctgctttaagccaagaccctacgatgttgttaaacctttacagtcaagttaaggattgtttttagccaggcgtggtggctcaagcctgtaatcctagcactttgggaggttgaagcaggaaaatcacttgagcccaggagtttaaggctgtagtcagccaggatagtgccactgcactccagctgagcaacagagtgagaccctgtctctctctctctctcttttttattttttaagacaaggtcccactctgtcactcaggttggagtacagtggcacagtcacagttcactgcagccttgaccttataggttcaagtgatcctcctacctcagcacccctccaagtagctgggaccacaggcatgcgctaccatgctcagctgtttgtttgtttgtttgtttattgatttatttatttgatatggtctggccctgttgcccaggctggagtgcagtggtgtgatctcggttcactgcagcctttgcctcccagattcaagcgattctcccacctgggcctcccaaagtgttgggattacaggcgtgcagccagacccagcgagatcctgtctcttaaaaaaaaattgttggccaggtgcggtggctcacgcctgtaattccagcactttggggggccgaagcaggcagatcacgaggtcaggaggtcgagaccatcctggctaacatggtgaaacccatctctactaaaaatacaaaaattagccgggcatggtggcaggtgcctgtagtcccagctactcaggaggctgaggcaggagaatggcgtgaacctgggaaggcagagcttacagtgagccgagattgggccactgcactccagcctgggtgacagagcaagactctgtctcaaaaaaaaaaaaaaaaaaaaaattgttggccaggcatggtggctcacgcctgtaatcccagcactttgggaggccgaggtgggtggatcacgaggtcaagagatcaagaccatcctggccaacacagtgaagccccgtctctacttaaaataaaaaagttagccaggcatggtggcgggcgcctgtagtcccacctattcgggaggctgaagcaggagaatcacttgaacccggaaggcagaggttgcagtgagccgagattgcgccactgcactccagcctggcgacagagcgagactgagtctcaaaaaaaaaaaaaaattgttggccgagcaaggtggctcacgcctataatcccagcactttgggaggccaaggtgggtggatcacctgaggtcaggagttcgagatcagcctcgccaacatggtgaaaccccgtttcactaaaaatacaaaaattagccaggcgtggtggtgggcacctgtaatcccggctactccggaggctgaggtaggagatccacttgaacctggaggcagaggttgcagtgagccgagatcatgccattgcactccaacctgggtgacaagcaaagtcgatctcaaaaaaaatagtggccgggcgcgatggctcacgcctgtaatcccagcactttgggaggccaccgaggagatcatgaggtcaggagatcgagaccatcctggctaacacggtgaaaccccgtctctactaaaaataaaaaaagttagccgggcatggtggcaggcgcctgtagtcccagctattcagaacactgaggcaggagaatggcgtgaacccgggaggcggagtttgcagtgagccgagatcgcgccactgcactccagcctgggcgacagagcaagactctgtctccaaaaaaaaaaaaaaaaattgtagatctagagatgtgttctaatgctaatatataatcaccaaaaataataaggttttgctcagttgtttaacttctgtcttagaagagaaacagaaaagtgatgctgaagaagatggtggcactgtcagtcaagaggaggaagacagaaaacctaaagcagaggtaaaggaaaggggtcacacattttgttttaccaagctgaaggtacatttatgtaaagggaatattttaatagggtagtttacagtggcttatggcagtaaaaattctgttaaagccaattttgttgaagtgggattctttgtgatacaggtcagtgttttgtttgataattttaagctacatattaatctcagaagtatctttttagctgaaaatcattttctgaaataagcagaaggttatagggggaaaataaaatgcttgctaagaaggaaacttcgggtcattaacagtctatttgcctctcctcactgtgccctgaaaagtatttcttatacaaatcactgtgttctaaactttttgtccccgttgtccatagatgggttcattcattcatttaactgacatttgttgagtgcccattttgtgccaggcattgtcagtgagtaagacagacaaagatactctgcctttagggagcttaaattctacttgggggaaacaggcaatgagcagtaaacattttaaggaagtaaacaacacagcgtattaggaagtaagaaacgatgaataattaaaacaggaaaagatactaaaagtgctagaggtaggcgggtcaccatgttaaaaccttactcgaaagatgacatcgaaccaaacacttgaaagaggtagagaacttttccatggggatgtaagtgggaagagcattccaggcacagagaacagccagtattgaggcctaaagtggttgtctacaaggccagtatggtgagtggacagagagagtggagaaaagaagggtggagaaggctccaggttagacaggctgttgtgtggacttggctttccctcctagtgaagcgggcagccatcacaggctactggacacaggtgtcacaggatgatgactgtgtctgctgtgtttcctatataccagggagaatcagggcgaccagttaggaggtccctgtaatcatctaggaaagatacggtggccccacaaagggtgacaggagaggaacagagggtatgagaactagttggagatctggatcttggttttgtggtagattggatatatagagtatgagagaaagggaacagtcactgtctgtatgtaccattgcttactaaagtcctttacccagcacctctgtgtctaaatctggtctctcccggaaagctctcctcaggttttactttcagctacaactctgccttcctattaataaagatcattgctatctgtatcttttgtatattttccatggatatgttctgtcttaactagaatgcaattcttaaaagtagagaccatgtttcccccaaactccctcacacgttaaaaagttgctggtgcatttaaaaaaagggaatattttcatagggtaatttacaatcttagcaacttgtgatagagtacagagcagcagccttggagtcagtctacttggatagccttccatcttcatgaatccttggtttcttatcctcagaatggggctagtgtgccataggccagtagattgtttgggattaagcaagattaagaaatcacagtgtctgatccttttttaagaaaatgtttatgggttagattgagaaaagtgtatgtttatagaaaacaataaagactaaactgaattagagtaggcataattccaccacctctgagacaaccattcttcttggtgcattttcttctcatcattttcctcatttttttcctcaaataagttaccctcagtctggctgatcttgaaaatatggtgaacttttattattttttaaatgtgctaattataatgaatttcttttcaatcaataggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtctgcttttgactgaatttcttcatagtaaccttcagtgtgtgtgtgtgactatgttcaattagtgggttgatcttcgtataattggccactatgtgagagttcactactaggcagaaactattatggacagtgaaataatgacttttatctcaccacgtgagtttgatgcagtcttttctgtctagcccttgcctcttcctgcccatgtgattgcggtgcagtagtttctgttgtataatagtgtggacagcagctcagaaaaggagggaatgctactgataatttgtagataatattctttaagacttaggggaaccattgaactttgaaatttttattagaaaattatttgttcagaatcagactccattattttacatatacttaaatactttaggggtatttttgaaagttagcccagttttttatgtgctattaaatttttagattacatactaaagaaaagtatgtacacagaatgtagtgctcctagttactattttttctattaagaaatagtttagttctggtgtaaaatttgtttgaatgctaaaaaaaaaaaagcaggactgcattatggcacttttgccttggtggcccactttctccatttaaaacattaggatttgtatttttctgctgcgtttgtatgaagacatatttgattgttgttttctcttgattttaaaataaaacctcatgagccctagtaaaaagctagagtaacgaatgtttgaactactgatggtgtatctcaatgtgcagcctcctgccacctcctgcttaaccttttagcaattagagtgcccatatctagagttcctgatatcctttggcatcacactatctagttttagtactaacactgtttgattgctccagtccctctactcccctttgcctattagttttaataatggggcataatttgtcttggtttggttttgttgagtaactcagttttacctaaaggactgtttttggtccggcgcggcggctcacgcctgtaatcgcggtactttggcaggccgaggtgggcggatcacctgaggtcaggagtgggagaccagcctgaccgacatggagacaccccgtctctactaaaaatacaaaattagccgcgcgtggtggcgcatgcctgtaatcccagctactggagaggctgaggcaggagaatcgcttgagcctggaaggcggtggttgtggtgaaacgtcgtcctttgcatttccagttccctctaatggagctgcactcttgcatgcttttgctcacatcttctggactttttttttaagtagtgagtaatactgcacttttgaaacttgctcgggcttttacaaataggtggaaactaccagtgattcggaatgttgcaagaggaaactaccagctcactagacgattctgaccaattatggggctggatacaaggaataaggtcaaagtaaaacggctgacattaaaatagcgtggctacttagagtttatcaaagtcgaaatttaaaaaataatttaaaaaaaaggtctctgtactgccaggcgggcgacagggactggccagctgcgccgcactcgcctgccagattccccttttctcggggtagccggaagggcctgccttcagcgggtgctgtgcaggaaaccaatagccgcctcttggacgggctcctgtcagtcacgcttagctccgcccccaggactaaggcccgcccaggggcttccctccgcccttcgcttgagaattccttttaaataccgctctggcgcccgagcgcgcctcttgcgtgctcgtccccacgccctcgggcggccggttcttccttctctgattggccagggcccctgctcatcagtcgtgatgcacaaggtctcttaccgaggccccgccttcttccgagaggcccgaaaacaattttaagatggcggccgcggcggtagcgcggaaaacaatggggccggggcggtgg

SEQ ID NO: 11995 - DNA, 60304 bp, Human
ccaaagaactacaacaccagggggatgctgaggttcagagagtgtccttgccctggtggtagggctgggacgcagcaggactggggaggcgggacccactgctgctagacactgcagcactcttagacacagctcggccacctgagcaggtgatcatttcccagttccgctctgcagaccctttttttttttcccagtagagatgaagtttcactatgttggccaggctggttttgcactcctgacctcaaatgacctggccgccttggtctcccaaagtgctgggattacaggcgtgagccacagtgcccggccccactttgcagatttaaaaacaagacatctggaagctcagagaagttaaactcaccccaggtcttacagccaaactctggcttgcctgacctgatgtcaggaggctttcttagtgcaagaaaggaagggcagggcaagccttagccgaatgtttatctctaagaggcttctgactctcctgggcgcctccggttccttctcccaggaaggcatgtggccgagctgggcttgggtgactcatggtcctagagtgatgagtgagaaacaggcactgtgagagtcatggtaggacctggccagaacttcgtcccctaagtcctggacttggtccctcctttgggattagttggggtctcacagagcctcccacatcctgggcaagttacagcacatgctacaggatctttgcagaaatgtaaacaaactctttcttcttttttttttccagccaccagtagaatttagaatttatttatttattattttatttatttatttatttatttatttgagacggagtctcactctgttgccagtctggagtgcaatggcgcaatctcggctcattgcaacctccacctccctggttcaagcgattctcctgcctcagcctcctgagtagctgggactacaggcaagcgccaccatgtccagctaatttttgcatttttagcagagacagggtttcaccatgttggccaggatggtctcgatctcttgccctcataatccgcccacctcggcctcccaaagtgctgggattacaggtgtgagccaccgtgcccggccttagaatttattatgaaattagacatgaggttccaaaaagtaactagaagattttttactttttattttttgagaaagggtctcactctgtcgcctaggctggaatgcagtggcacagtcgtagctcactgcagcttcaaactcctggactcaaatgatcctcctgccttgtcctttcaaggtgctgggattacaggcatgagccactaatcctggctaataatttttcttgacatattaaaattctgtttcttaaatagcatttcctctcattttggatgggtgcacgaaccttgggtgggatatccttgggaggtgacatcatgcacacagaaggcaggagccctaagggggttggggatggctccagaatggggtctgagaaggagatggagaagcctgttcacgcaacacttcatagtggcttgctttccgcagggtcattggcagggcggtccctaggcctggagcgctcttcccgcccatccccaggccctgctccaggtcggcctcctgggaaccatcccgtctcgccagcacaccctgtcccgaggccgcctctgacctccaggctgggcctggtccccacggcgcttagcgcaatcatgacttaaacacctattacaggacgctcagtctttagtgcttgtctccccgcggctgggctgactactcccagcacggccactgaacgcttggccgcgcgatgctccggagcgcgggtcgccattgggttgaactacagctcccagcatgctccgggccggcgacatccggagcccctggtagttgcctagcgaccgggcgtgtcccggaagacgggcccggcgtggggcgcgacttccggggcggcggttgcatcagattctaggaagtgtctgtagccgcagctgcgggtccgggattcccagccatggcagattcctccgggcagcagggtgagcggcgcggccgggccaggctgagggcggctgggggcctgactgggcgctgggtgctcggctcgaagggcagcgagtccttatgtctgaggggcccgggtgcatgggttctgaggggcagctgtgtccgtggtctgaggggcggcagtgcccgaggtctgaggggtgtcagtgcgcggggtctgagggacggcacgtccttgggtccgaggggcgggggtgctcggggtctgaggggtgtcagtgcccggggtctgagggacggcgggtcctgaggttcgaggggtggcacgtcctaggatccgaaggacaacgggtgcccggctccgagggacggccactgggacccctgggactcctgcgtgagggtctgccagacccgtggctggagcacagaccccgcggggacccgagcccgagcggggcgctgcccagaccacccagcctcagtttcctcacttggttcctgccgaggtccccttgcatcctcaccccgggaggtggccctacatcaaacagcctttccccagccggtgcctgggcgggccctcgctccctcttgccccagctggcctttagaggggagacaaaggcccaagggttgttttggttttctgcccagacctggcagcttccgggaggtgggcggagggcacctgaggttggtatttagggaaatggggcagaggacgccaggggtacgcgtacacacagtaaaagggcttggggctttacgaaggctttcatctccagttccgcaggcagtccactgcaagctgattgtcagagcattactgccccattttattgccaacccgggaggttccccagggacacagctgtgtcagctcccccagtcactcatgtcaccagcgggtagaccttgagagaccagtgggttcttctctcactgtccctccagcaagattttaggtgctggaaaggcaagagactgaatcagaaagcccagattcctaacagtctggagcagcctttccaaaggaaacattctcagtatctagtttttaattcttttggctggcaaaaattagatgcaagttcttgtaagacacctccagcccccaccctcagtttagatcgtaccaagatttccttagcatctggtggtgccctttgcccctgagggtttattgggttatagataggtagttatgacaacccgagtaatctggcggcatggggacacccagatgacagggctacactcttgtgccaagtggcaggaggtggtcaccttccaggcacgccgcctaccaccctacctgtgtgcctggattccagcaccatctccacccgtcccagagccaagcggccctcagaagtcacccagattcctgtaaaacagcatcatagttaacagccccaactctggaaccaccctggaagggccagggtcccaactctgcctcccgccccacagcaaaccatgcgtaatggctcctaccttggagcatggagtgtaaatgaattaatagatgggaaggacgtagaacagtgcctggcactcaattaagtgctgtgtctgtgctgaaagttagggcctgtttgttttcaaactaaaaatgtgtttttgttcatttgtgaacgtaaatgacgtattagtagtgttttgtatcttgtttttaaaaatagctttagaattttaggttttcagagccttgtaagaattgccttctttttggagcttgccatataggttgggattgccctctccgggctgtcagggcagcaggcagattgcccagtcctcagcctgcgcacagcatctccagccagtgttcttctgccccagggcatggcccacctgcctttactatcgcctcctcccatcacacacacactctcaaagatgagaacaggaaataaaatccaatcgtaggccaggcgcagtggctcacacctgtaatcccagcactttgggaggccgaggcaggcagatcacgaggtcaggagatcgagaccatggtgaaaccctgtctctactaaaaataaaaaaaaaattagccgggcgcggtggcgggcgcctgactactcggaggctgaggccggagaatgatgtgaacccaggaggcggagcttgcagtgagtcgagattgcgccactgcactccagcctgggcgacagagcgagactccgtctcaaaaaaaaaaaaatccaatcgtaaatgctttcagtgaccatcttcccagatttttcaaggaggccatcatttttgtaccatcttccctaagttgactcagaaggtctatttctctttcctgatttcactgggtgtacagcttttcctttgcagtcttgaaggtgcataggcttggtgcctgtccaagagcctgattatttcagaaggatgagtttcatttctgaggtttctggggtagatggagcctacctcagggcctttccgcacagacttgggataccacttggtcggctgctcatcaggtcagacttatagtttaatttttatacagtttaattcaagggtcttcataataacacagccagcattttttcagcatgagtctgtgccgggcactgctctaaatgctttgcatctgttatctcctgccacccttgggggaacccctttgaggaagatcctgccggcatcttgtacagatgagaatcctgaggttcagagaagtcaagcaatctgtccaccatcacgactagccagaggcacagccaggctcccaacctgggcagcctgactcaatagggaccttaactgctgtgctgtgctgcctttgatgattctcttcagactcacaatagctcaacccagtgagttaaggcagacgagaataaagctgatgcccttcgatgttttccccagagccacatgaaatgtttgctcctctatgaactcaggtaccatgtttccgggtatttgaagagccttaggcagtacccttggggtggagattaagccatttccagtgtgggtgctctgggtggcaatattgctgtctgatcaccccacaggctcattgtgagggatgttggatgcccctaataatgaataacctccctcccagtaaggaggaagatggagatgctgttcttgggggtgagagaggatgcctgggggccacctttgtgaacgagttgcagctggacctccggggctggtgatcaggacggggagtgggaggggaagccctcacctgtgggaggaggcgctggtctctgggagtgggtagtgttggctcctagttggtgagagcaggggtgcatgcccctctctcctccccacgattcatgtctgggggctttttccggtcccctttctgaacacttcttgggcagggagtggatcactgggaaggacccaagaggagcagctgtagagggtgggaccaggggaacatttgcagaaagggagtaacctgcagggtgagatgttgcctggacacccacaagatgaggaccctggtgggacctttgaagtagcagggtcagagggcaaagggtcagggtgagtgaggggtgcagacccccaccaaaccggggcacttattaggagctcagacctgctgtaaaggggtctgcattttagcaagctttccacccatggggaagctggtttaaacctcacttgctgggcccaccccagagattctgatttggcaggtctctggtgagcccaagaatgtgacttctctggatcccccaggttctgctgctgaaggcacaccagggccatgcctggagtggacctgggagagcctcaagggaacgcaggaagagaaacagggcagccgggagaggtttaaatgcttacaggaggccaggcatggtggctcacgtctgtaatcccagcactttgggaggccgaggtgggtggatcacctgaggtcaggagttctagaccagcctggccaatatgtagaaaccccgtctctactaaaaatacaaaaattagctgggcatggtggcgggcacctgtaatcccagctactcgggaggctgaggcaggagaatcgcttgaacccgggaggcagagtttgcagtgagccgagatcatgccactgcactccagcctgggtgacgagcgagactccgtctcaaaaaataaaataaaataaaataaaataaaaataaataaaaaataaatgctgataggaaagagccagagagagggagaggtcgcactgccacagttgtttgacgtgtcagggttgttgttcatttggtgtggctttgttttggtatctgtgctgagcaattgcttggtacttgcatgtgatttcaataaatgttctgtagagactccacctttgtagccggtgacaaccaccatccacctttgggacattcccatgtccctcaatgtgttgatgaactgaactgcaaggtcatccggtggtggacattccttctcatgggggcagagcaggagtttcggcacggagcgtgcaggctctacgatgagggccagtgtcgaggaacaggtccctgggaggttttcagtctgctcagaagtgttctcatctgatctcagcatcagactgatccacagcctggctcaaacccatgaccacttgaaagctgacctatttttatttgtttcctcgagacacacttaaatgcagctaccacgattacccaaatgactgtctgcgtccatctcatggaagcctgtcattctcctgtgcttccctgggcaccagcacctttctgctctgagaagatccttcccaagcatggacttggttcccttttgatgagccgtctagcctgctctagacggtacatttaagaattatgtgatccaagatcaaggcagatttggtaataaacttttaaaataataaaattaattaaataaaaatgggtgtgtgagccctaggaaaactccaggaaattctctgtgtgtagcatgcggctattacaataacattaataataccagagcgattatgataataatgatggcaaatggggcccctggctctgtgccaggcagcttttaaacattttacaagtgtcatttgacttaatggcctgcagctttacagggctgatgttatgagcgtgttttaccgtgaggaaatgccgccgtgtgtgtgagtgtaggtactcagccctggagggcgtcggggccgcccctcaggtctccagagagcggatacacagcggcttcagttcccagactgcttcctcagcactcaaaagccactgcagccgccgttaggacatttgatgtttttctcattttaaaaatagcagatgcttactgcagaaaatgtgagcaatgaagaaaaagagggaattaaaatcacctgtcaccccctctcatcaaccatcgtcactgtcagtgttcgggctgttgctggtggtctctccatcagaatccattctgagtgtgagaggcacgtgactgtcagctcgctgtctcagctggaagccgatgctgtgtcactgtttctcagggtgctgctgttgtctcttcttccctcttgctgtcgtggagtccaacccaggcatgagcagttgcagaagaccaaggctcagggaggggacaggggagaggaatgtggagggtcagcattggggaacagctttcgaactgtggcctgatctgtgaggggacaaggctcaccttccagctctgtccatccctctggcaagttctctaatctttagtgaacttcattttctttatcatgaaatgggacccctgctggcagctgcagagctgttggagggaaatatccagctaaactagaagtctcctggctggaagttgctctgcaaaagagtttgtaggagtctgatatttatttagagttagttttccaggacctcgctttggggtgcttggagctgcctctgtgggtctgcctccgcctccgtcctccctgatctcatctccagttgggaggagagcgcatctccatgtaagcagcctcctccttctcagagggaagccccggcagtgtcagtgctgacactgggcctgtaactgtggggatggggcaggtgagaggccctcaagagctcccggcaccccccaggcgccttcagtggggccagagtccacccctgtctttctctttccttggactgttggaagagctgaagtgaaaagtgacttgttcttgtgtctctggtatctttgggcagcagggctcctgctaagcaagcccctgggggctcaaagcagcagaggctgtggccggttcccagcactggtctttgtgcaggtgtctttctgagaagggtgcatgaggcccagtgccacaggggaacgccagcccaccactggtggcatgcactctgtggtgccattctgctgtccactcatctgtgccctaggcaactttagctgatatctggaatgtcacacgctcagttgtagatgctgaagatcgagcagtgaataaggtagatggagcggtggggcagatggtgaaggaaagaaatgcgggcacgtgttagacaggggtgctgcggagagaaagagcagccaggctcagggtctagaggcgggcgccatatggacagggagtccttgaagacctggtggggaagccggcacctagcagagctgtgaaggattaaggggcctgctggtatctggggagcatgccccctaaaaaaagagcagcaggtggaggggccatgtgactagggtattgtgagtcaggtgggggcccatggccagcatgaggacaggcttgtgctgctggcgaggtgggtgttgggggcagtaatgtgaacgtgcgcttttcagcagggccgctggaggcctgtggctgtgaggggagagccatgctggctacaggtggcggtgtctggcttgcaggaatccaggtgacaagggctggctctcaagtccaaagcttcttttgagttagaggccccggatcctcccgtgggttggctatgggtgctcctaaggataacttgtaaaggggtgtgattccagttttggctagggagtgtgcccagagctttgcttctgggtgcctgtggctgcttggagtgggtggccatcttattggggtcagatgggacagtggctccgtgcagtgggaaggaagcagggcaagttagagggacgctgcactcgtcatcccaccagcgagagtcatcccaggaagccattttaagccctgcatccatgttgagacttcaggaaggctctcccacagagtgcccacccctttactgcagagaagaggtggcttcaggacatcttctccggcagccacggaggctgggccttggggcatcacgtggctccgtaggctccctggcgggtgaagagctcggcccagtggggcattcttgctgctgcagctgtgcactccattctgactcatctttgctgacaccacagcgttccgggaagtgccagttattggcctgacacgaagggctttccccacactaagcaaagcagagaaaggcattcgtgtgcagttacccccgcaacacactctgctctctgttttcagaagctgtgtgggtttggttggggtgactctggctctgtgccaggagtaaacacggagatgggggacaaaagggaatgggagaaggcagagagggggactgtgatgtgcagggcatccacgccccatggctgtgatgtcgggcagcctgtgcccaggaagggcagctggcacagcaaggggtggccagacatgtgcattcctaccctgagtgaactctggggtgagagggtatctgtctggaaggagcaagcatcggtccttttcccacagtcctctcagcaaacacaatcactggttcaaggtttggatgcacctgtgctcatgggctcagggaccagactccctcctctggccagaagcctggcaccatctgcctggtctgcccccactttagggacgtgggctgtggacacagcacctggtccacaactcccgtgtcagaggtaattgcagggagatattccttagaatggtgagacagattttattccctaattcctgacagtaggggaaggagctgtgttccctgccagttcagcagaggtgacttttggatttaaagggagtatgattagctgggcctggtggcatgtgcctgtagtcccagctactcaggaggcttaggctggagggtcacttgagcccagcattttgaggctgtgatgagccttgattgcaccactgcactccagcctgggcagtagagtcagacgctgtctctaaaaaataaaaataaataaataaataaataaataaaaataaaaaagggagaatggaggaggagaaggagggtgagcaggggctcaaatgaaaaaagccatggagctggtcagcgtgcatgtgtcaaggcggccttgtctacagctggcagtggtgaaagttagggttctgctcctcctcccaatggtgacatgcggaacagtggctcttgggtccttgagtgacacacctgagtggtggaggtgcacgcttactgctttgaaggctctaaggagggaggctggggcctggggccaggggccaggggccaggtgaggctggctggagcagccacattttcctggcagccctgtgctttcttgggctggtcctttgagggggcccagtcctcctgaggctgtggccttgacctgcagaagccatgctagagtccagctgtctcttggtgcaggggtgtaaatggcacacattgtcaatgtggggttctcctacccctcatcccccagcacccagagggagagggtgccgctgcggcaaagaggcttgaagttggtttggtttgggggatttctgttgtgagtttttaaaaattgaggttaaattctcgtaacatacttagctgacaggagggataccatgatcatgtaggtagctttcccaaggcgaggcttatccgttatactccagatgtgctgacccctatgatttccccaaatgtcagaaactgaactgtgtaatttgtgatggtgtggaactgtgttcctgctttccctgatagaaaacataaattaaaaatgtaaaaactaagtaatttatatgacataaagtgaaaagtacacaattctgtggtatttggcgcatgatgttgtcatgcagccttcatttctgtctagttccaaagcattttcatcacccaagagggaacccatccatacctgtcaggcagtcactccctcgcccccagtcgaagcgctgcccctgtgcctttgcctgttctggatgtttggcgtccagggaagggcttgaacacctttttccttggttctgtgccatcccctagtccctgtctttctggcggcctctgggctgcccgcctgcctgcctgacaccatgtgccctctgtctttgcagctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagtgagtaacagagtgggttccctggccattagaacctctctcccaaggtcaagggctttctccatcaccctggtgcttacctggcgtctgcggataccccagagggagcctcgcccaagtgtgtctcgagcaagtggcctggatgggcagatgcagcgcttgctggatggaggttgggataaaatcacgccctatggagttggttattcaggagcagtatgttcacatcactggtgtggcaggattgcctgaggtggtggggtgcagagccgctgcggctctggggttccacgtagcatgcccaggccacgggccctagccttgtgatttttagctaaggctgtgcctggctctggttgactcagttctttctctttatttcttccataagattgtagcgtgtctatcctccagctttagaattgttgaatcctaaagtattaattggcattgaacttttttttttttttttttttgagatggagtctcgctctatcgcccaggctggagtgcagtggtgcgatctccactcactgcaagctccacctcccgggttcatgccattctcctgcctcagcctcccgagtagctgggactgtaggcgcccaccaccatgcctggctaattttttgtatttttagtagagacggggtttcaccgtgttagccaggatggtctcgatctcccgacctcgtgatccacccgcctcggcctcccaaagtgctgggattacaagtgtgaaccaccgcgcccggccggcattgaactttttaaaaatcagaaataagtcattttttctctttgagatgatgtctgtcccgtagctccagcctgttggtgctggttgtgtctgtggaacgtgcctgtggttatttgcgggagatactcctgggatgcctgcatggctttgtcactctgtggcaaatctgagggggctccatgccatcatcactgaagtatgcctttgggtggcccagctcctcctgtggctgtgggcactcctccaccttcatgtgggggcaggtttagtgctgttttctggtggtcctggctgtagctggcagccttctgggggcttctccagactccgttggggcctgggattgggaacatgcccccccgcctctgccgtgggtcaggcctctgctagatcactgttttaaccaggctggaggtggggatgtcacatctcctgtgggtcgtgttttctggataactctgcagcagacactccttccccagcgtagggcagaggccgttgctgtgcaggtcacgtccttccccatgtagccgttcctgcctgagcctccagcgcggtcacccaagtgacacctgtgctgtgaggtgccttctctccaagggctcgggtgtcaggttgttccccctgccatgtgccattccaagacacagccagaggggggcaggattagggagggtgaagcgggcctggtacgtccagctcagcagtggcctgtccaggcttccctcatagggacttgttgaaagagcggcacagacgcaagcctccatccacactgtgagaggaaggaagggttttgctcttgcaaacactttttaacctacagagaggaagcagagccacgttgctgtgtaacagaatggaccatggatagcactaatggagttgctgtgccctccccaggttccaaatcccctcatcacccaggctgcgcaagaggctgccagggtctgcttgtgccaggaatgatgggcattatgtcaggcgaccctcactcaagcttgctgtacactgagcaggggctgaagggggaggtgggagctggagtctgggactgctagagcatccagtgacctcgagtgggtccaaggcgccatggagtccagtgtagtgtcctcgcccatgtccctgggatgacagtagctgtggatctccctccatgtagctgtgacaatcagagctgcttcccccactgagtgggaacgccctctctttccatggctcatactccccaagcatgcaccttccttgctggcacagtgggccatgtgcccctcctcctgctcgcccttccacctctgttggacatcccagcagcatcagatgtgcctgtgtctggccctcagtgtgcccgcctgttaccagctcctcccatgtgccttctgtgtcctgtctccaagatcctctcagacatggaaagactctgcttggcccggcgcggtggctcactcctgtaatcccagcactttgggaggccaaggcgggcggatcacgaggtcaggagattgagaccatgctcgctaagtcggtgacaacctgtctctactaaaaatacaaaaaattagccgggcgtgatggcgggtgcctatagtcccagctactcgggaggctgaggcaggagaatggcctgaacctgggaggtggagcttgcagtgagccgagatcgtgccactgtactccagcctaggtgacagagcgagactccgtctcggggtggggggttggagataatggaaaggctctgcttaacccccaggtccctactcctgtgaagccagaccccttcctggtggatcccttccctggatcaccagcctccagcacggaggtccactggatatcaggacgttgaacttgttgagcacttctcacccgcagtggaggctcagcccttccagcccgccggcctctccctaccccccgggaaggagtgtcagctatacccttcactgaggagggtgtgggtctgtcagacgccgaggccatagtttcaggaacatgaaggtttggtgttgctctcacccctccgatggaggacccttaacttcctgatgaaggatttctctccatgaaccccttgcttgggtcctatctgcatctggtgtgttgtaggcagactgcttgccacttcctggcttccctctccatcattttatcttcagcctcccacatccctgtttcaaagccatgtctctcatgagcggttcatagttggtctgttgttggatcactcaggtcagggtgggactctggaatcaacgaatgtgtgttcattttttccaaagaaacaaaagcacaggccaggcgcggtggctcacacctgtaatcccagcactttaggaggccaaggcaggcagatcacaaggtcaggagtttgagaccagcctggccaatatggtgaaaccccatccctactaaagatacaaaaattggtggggcgtggtggcaggtgcctgtagtcctagctacttgggaggctgaggcaggataatcgcttgaactcaggaggcggaggttgcagtgagttgagattgcgccagtgcacttcagccagattttatctaaaaaaaaaaaaggggggcaagggtccttatgtgatatctctcagttcttcccttttgcaaatctgaatttgtatatctgggcctggtaacccgttttcctggggagcccatcgccagctgtgtggagatagcagccttaggggagcaggaatgctggctgtggccaggcttcttggacaagctttcagtcctgtgaaccctgggccgtttcctcatagcagggtgagtgtgatgatcccgtggcctcatggctgtgtttctgggcagcgtctccagctgtctgagatggcagcagtgtcctattgaaggagctccagggtctttgtgagggaggagagtgatgggatcctagagtggcgggttgaatgcctccaggcattgagtgagattctccttcaagggcttgtgaggcatttaaagtacactgaggccgagctgcacttggcctcaataagcacatgatgtttgattaagattggagattgcctacgctttagaatctgaccacctgtgaccactggaactcacctagagtgggggctcctgctgagcactggccctctctccgtctcctgccccatctcccacctgcccacagtacccccactgcccagacacagtgcagccgccctccttcctccccttggcctgttagtcatcagcgtctgccgtcctggctcgtgtggcctgagctagagccgggaggccaagagatggctggtgcccaggaccaacttccccgtgatcagtgtgtggcaatttgctggccatgctgccagaccctctggcacagaaaccagggacaggaggaggcaggatgcgagcaccctggtgagctgccaggcggcctgctggggtgggcacaggtcagtgctaggagtatccatctcgtaggccttcctggtgccactcagcagagacatgtgaagcccttcccagggccaggcaccagctggggtcagaggtgcccagcagagcataacgcagaacctggacctgtgggcgacgactgtggagaaaagtggggatctgctgagggggcagggcaggcaggagccggctgagggcaacgggaaagtcaccaggtaccgtcctccacacctagctttgccagattgacgtttcagagggtgaataatcaccctgtggctgcccctggccccagggacagagctctgccccttcagggatctcagatgcaggttgtgtaaggacagccttgtgccaggttggaagccaggcctggaagcagtgtgctcagagcagcccaggcggcccacaggcgagtggaggggaacaactagggaagtctggccaggaggaggtgactgcactgaggggctggctggcaggggtctctgcctggaggctgagaggagctcaggttatttatgaaggcagtatagacctatgtggagcttgaagcccagtgtctggatcagagtctgctgggctgtgggcccagagctgggagccagccactcacttctgcagtgtccgaagtgatgaggaggggctgggctggagccagtcttgcctgctggccgtggccacagggggtcctttctgctctgactcctggcttctgctgccagggcttggaggcttggaggtggcctctgtcccaacaagagtcctcaaaatcctcagtttgtccaggtgagggatcctgggtgggggaggttcccagggctgcggcagcacagaccataccttgtcagtgtcaagccctgactgacccaggagtgccaggtggtggtgtgctcactgccagaaaggggccagtatttgaagagcagtggaatgtgctgggcacgctgtgcaggcattcctcagccctcctggggctctaagggtgttattggggtatgctgccatacagaatattagaaagcaaaagaaagacgcggttgtcgggaggcagagcttgcagtgagccgagatcacaccactgcactctggcctgggcgacagagcgagactccgtctaaaaaaaaaaaaagacgcagttgtctttgacctgcgtaatgttgaccgagattcgtgtggtttcacattgtttaaatttcatggaaaactatggtcccgttgtaaaaaccaagtctccaggtgaagaggcgacttgcacttcctggtgctgcccctggaccctgatcctgctctctctgcctcccaggcaaaggccggcgtgtgcagccccagtggtcccctcctgctgggacccagccatgcagactccacctttacaacagcctcaccaggaacaaggtaaggagaacacagatgccgtggcacacgcacacaatggggaggcaggaggcaggacagcccatgtgccttgtcgcacaacagacttctctgttccttgtgttgggatctggagttccataaatccaggtttaagatccttcagtcacttccatgttatagtctctgtggcccagaggcagagctgtcctctgaaacccagacacgtgaagtatcatgcctcatgtggaagcctgcccatgacttctgggcatggatcaccctggcttgtctctcggactctgcccaaccatgagtactggaggtcatccacagccacgcctttcaggaggacgcgtggttgcagcaggtggcactgtatgagccaagcaggatggacaaaacggcaaactggctggatgttgttgggagcacagcaggttttgagaagaaggcaggattggttcctaacagaatggggtttgcatggtttgcttggctcagggcatggccagtgactccagtgatttcagaccaggctctgggcggggctgcttggatttccatcagggagcatgtttggcagacagagagtcaggtgtgagggagttcatggccttccttgggaaactggttgaggatgatgcccccagagaggtctgagggtgctgggatgttggggagtggtgccagagcagcaccacgattcaggggtcctggcctccaagccgcgctcccccaacagggactgaccctggccaagtgttgtctgcctcagtttcttcatccgtaaaaagaaaatgacataacctacgtcctagagtgtactgcatattgaatatttagctcagggcctggcacatggtaggtactcagtaaatattagctgtgttattgttaaataagcagcatttcaacaatcaataaaatcattgattccctttatcgtctccctccatagatgagtagaaccccagggaggaagaggccccacccacccagggctcagttggtgggaggtgccgtacatctcactgggctcccactgagactgtgacttttcacagtaaaacaaaatggtctctgttgaattgtttacactaaacacaaaccacactgtgatgtttgttgctgtttttggtaatcctgtgcagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtaggtccaccgcggggtgtccctgcagcttctgcagttgcacgcagaagtcagagccattgggatccacagcagcgatcttaggtccacaaagatcttagatctgctacagagacctgagatttgaggaatcgagactgaatttcttctcttatttttaagatgaaaattttaattccataagtaatctatattcactgcagaaagactacagatcaccaaaaagaaaatgtccatagccccactgctaacatgctggactcgacctgggcactttttctcacataccttaaagttttctctcatccctcaagctctcgtggggtccccagatgctgagttcccatgacactcagacctgacaggcctgacgctgggttggctgtgaccgccccccgaccactggatggtcatggctgtagctcctgacgagtagctggctgttggggtaaatgccacagagtccttttatgtgttcatgttttagttgcagtgccaaggtcatgtatagtcaacccttgaacaacctggagggtagagggtgtgaccctctgcacagttgaaaatccacacataacttttgattccccaaaaacttcaccactaaaatagcctcctgttgaccaatagcatgccagtcaatgaacacatattttgtatatacattacatactgtattcctaatgataaaggaagccagagaaaagaaaatattatgaagaaaatcataagggagaggcaatatatttactattcattaggtggaagtggatcattataaaggtcatcatccttgccatcttcacgttgagtagactgaggaggagaagggggggtcttgctgtttcagggatggcagagaaaatcatatataaatgcactcatgcagttcaaacacgtgttgttggaggttaagctatacatatcgtctggtgtggaaatgtttgttttttcattgctttaggtcctacatctcttttgatatcttgagaagagtgttgaaggattacttcaaatttgatgtcttttattgcatgaacattacggatattgatgacaaggtaaagggaatttgtaagattaaattttaaatgcaattggatggtgtaaaagaagatagaactttcgcataagtaaataatgtaggcttgagctagcttgtgttttcacctgataaacatcattttaatcccctcagtgagttaatattaccacttctgctactgatatgatcatttctatgatgttcagacacggttagaaacctgcatgttgctcaggggtcggtagccctgggtgttttgcagaaggaaggcctcccacagcacgcacttcgacatgtggcttgcaggggaagctggggcccccagggctcatttcattaagcgtcagaaagatcacgttaggccttgggcactacttggcaggtgggagatggagggtggtgtttctatttgatgatggtgtgcacgtccggggcccacagttgtctcccaccaccctcaccctcacttagagttggccaagggagagagtggcctgctgcagagggatgcatgtgggatccaagcatcactccccaatgtctgccttccctccccagatcatcaagagggcccggcagaaccacctgttcgagcagtatcgggagaagaggcctgaagcggcacagctcttggaggatgttcaggccgccctgaaggtgggcctcttgctgtctgctctagaaaccgagccctttgctttctgttctcggtcctttgtaggctactgtccctagggtagtgtcagtctcacaggctttcacaaagtgtatgttactcaagccagttccgtcaggggcgctgaagtctccataggtaaggtcccctggcctgtgacaaagtcaccagcaaagatgtactggagtggagtggagagtaggtgacattcctgccacttacaggaaaacaactgaattcatcacagtgccactaattacacttataaaaatgcttaccaatattgctgtctaattttcaatgccaaggttacaactaaatcagaaacttctgcccaagatacaaaagctatactaagctttttaatttggtaatactgtaaattttcagaatcttttgaagaaattagttctctctagtattttcattctgaataaccatcgttatatacttatttttattacaatagtaagaataggtcattttactctctactaattatccttagtaattacagtaatcattatggatatgcttatggcattttatctctggaattaaaaacaggaataaaattagagctgagcaatcttttaggtcagtgaggcctgagtaccttcctgatggatgtgtctgcagcacacctcagaacacactgggtggcctacttttcctcatccccagaacagccctagaaatactgctctcacacccaatttgcattggagaaactgaggcacagagaggttaggtgccctgtccagggtcacacgtgagagggcagaaccaggagctcctgagccgggagcttcagtctctcttagttccttactgcctggccacttgggttgcacacttctctatctctatggggccatgggaaaaaccgttctgttttctacctggaatcacctttatgaatttaggttttgctgagcagtatctaatagatttgacgtctctttatggttgcagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgaggcttcacacatctcccagacagcccgttcgggtcaaatgtcgggccgtgcatagactgatctgtgtgcacggattgattccacagattgtcttagtggaagacactctgtgtctccagtagctccactgtggcaggcggccctgttctgcggtggctgagtcagtgcccctcccctcccacacccctttgccccatttcctgggtgcagagcctgtgccactggaaggagactcgggatccacaccctcccaccacttccatcagataggcaggaggtgcacttggaacgtggggaggcagccttctgtcgaagtgttccaagattctccagcggactctccccacaccagctggagaaggaggagcagggattaacattgaattgagcattgaggcctgtgggtacctactgagcttggggccttcacgttgaccagctctcctgcccctgccaatatctccttcagacacagggcagagacctgggtgcagaggggaccctgccctcttcctcaggcctttccctgtggctggcgccctggacacagtcaggaaggccttctcctttgtgccagcgccgcctgctggtcaccctttaagaactcgatggaaaagagaagagacggctgcagctgtgtgtagaaaaagaggccccactgaggccgcagccctgccttccctcaccactgccctggccccacctcagtgatggggcagggagtctgtgtctgcccttcgccagcatgtttctttctagtttggtctcttctgtgtcctgactcagcagatcgcttcgttgcgcctgtttccaaacttcacggaaacacgccacgtgtatgtagtcgtcagtgtgctttcacccaagctgtgcttctgggacgacccacatgtggtcactgtcactgcctcagtgcctgcctgggagccgagctgtttgtctgttctcctgggacgggcagttaggtttccttcttaccaacaatgctgctgtaatttttttcccagttgttccactaatattctttttttttttttaattgtggtaaaacacacatcataagaaatttaccatcttagccatttttaaaaactttttttttgtagagacagggtctttttgtgtctggtttattttgcccagcatagtgtgcccatggttgacccatgctgtagtgcatgtcagactctgcttccttcctatggctgaatgatactctgttgtgtatagatgggccacattttgctcatcctttcacctgcccgtggacacgtgggttgtttccaccttttggagatgcaagtaatgctgctataaacctgggtgtacaaatatctgtttgggttcctgctttcacttcttttggggatatacacggaagtggaattgctgggtcatgtgatgattctatttttgatattctgcgtaaccaccgtattgtttctgcagtggctgcactattacacattcccacccatagtgcatggggttctgttttctccacatccttgccaaagcttgttattcttcatttttttcatcccagtaggtgtgaggtggtatactgtggttttggtttgcatttccttaatggctagtgatgtggagtgtcttttgctgaactgtgagttgttttgtgttgtctctaggtggacatttgcaagtttctttaggccatatacctgcaagtggaatcgctgggttgtgtaggatatatgtgagtgactgtcgggggttcccaacactgcccacacattctggggccctagaaggactcatgagactcggcatcgagttatcatcttgtctaaggtttgtagcagtgacacagcgaggagcagaagctcaggcggagtcttcaatcatccatgggcaggctgctgaagcttcctccctgcctcccatgaggggacacagcacactctcccccaccaggaaaaaaatgcagccacatgtgtgaaatgtccctccctagggaagcccatcacataggcaccctctgcctggcacgtgccgcaattcctgactccccaggaggaaagctggtgttccacctgcataagccacagtgtttgttcaacagcccactgggggctgctgccacagagctgggtttcccggcctcttagcacaggggacatttcagctcctggatgccagctaatggccagctctgtaggcaggcctttctcaggtggcagacacagaccttctaggctcacttttatcttcatagtagccatatcagaaatgtctatatggccaggcacagtggctcacacttgtaatcccagcactttgggaagccagggcaagaggatcacttgagcccaggagctccagaccagcctaggcaaaatagtgagactctatttctacaaaacttttaaaaattagccaagcatggtgatgcaagcctgtggttccagctactggggaggctgaggtgagacaatcacctgagcccaggagtttgaggctgcagtgagccatgaacacaccactgcactccagcctgggcagcagagtgagacccagactcttaaaaaaaaagaaagaaatgtctatgcaaatttcttcttcttctaccacattttgggtgtgctgtgtatttgcacatacacctgcatttgtattgttggattcttccctttcatcagtcaatgaatgtgaagtgctgattgctgtggtttgaatgtccctttttccaacctctcctgagactgagcatcttgtcaagtgcttgcttccagctgtgattctgtgcccccatctctccccctttcccatgaggttattggtccttttcttactgttttgtatcattcttatgtcttctgatactaattactatgatttgaatgtttgtcccctccaaaactcatgttgaaacttaatccctagtgtaacagtattaagaggtaaggccttttagaggtgatcgagtcatgagagctctgccctcatgaatgggttaatggattaatgggttatcacagaagtggggtagttatcatgagagtggggctgttacagaagccagtttggccctcatgagccccctggccatgtgatgctctgcgccaccttgggactctgggaaaagtccccaccagcaagaaggcccagaacagatgtggccccttgaccttgaactttccagcctacagaattgtaagaaataaattttatttaaaaattacccattcccaggcagggcatcgtggctcatgcctgtaatcccagcactttgggaggctgaggtgggcagatcacgaggtcaggagatcgagaccatcctggccaacatggtgaaaccccgtctctactaaaaataaaataaaaaaaattagctgggtgttgtggcgtgtgcctgtaatcccagctacttgggaggctgaggtgggagaatcccttgaaccagggagtcagaggttgcagtgagccgagatcgtgctgttgcactgcagcctggcgacgaagcaagactccgtctcaaaaagaaaaaaaattttacccattcccggccaggcgcagtgggtcacgcctgtaatcctagcactttgggaggctgaggcgggcggatcacctgaggtcaggggtttgagaccagcctggccaacatggcaaaaccccgttgctactaaaaatacaaaaattagccaaatgtggtggcgcgcgtctgtaatcccagctactctggaggctgaggcaggagaatagcttgaaaccaggaggcggaggttgcagtgagccgagatcacgccactgcattccagcctgggaaacagagtgagactgtctcaaaaaaaacaaaacaaaacaaaacaaaaaacagaaaacaaaaaaaagaacaaacaaaaaaacagaaaacagactaagacacgaattcatctctgttacatgttggcatgtgtttgtgtctcttaattctgttctgttggtcaaattgtccagcccagaccaggtgcagtggctcgttcctgtaatcatagcaccttgggaggccaaggcaagaggatcccttgagcccaggagtttgagatcagccgggacaacatagtgagactctatctctacaaaaagtttaagaatttaaaatttaaaaaatttataaaaattgcccagtcctgcaggagtatcatgctgtctctcacaggtatctgatgggtaagaggccccatcttggttttgtcgttaggtgtgttttgaagcctcagcttgtcaagttccatgtaagacactgttgggattttacatgttgtatctaagaaccatctcagatccagtttggctgtgttgatcctctgtagtctttttgttttatcagtttttgtccattctttattccttcttttcttctttttcctttggatttattctgtttttctttgtctcacttagcagtttagcttattttctgatttaagaatttaaggctatacattttcctctgactgtttttgctgcaaaatttgacatcatttacttgtaaacaatttctaatttccattttggattttttagcccaggaattatctagaagtaattacctaaaagttaattatctagaattacttagaagttttaaatttccaaatttaaattggatggtactttttcatattaacttattgttattcgcttataacttaattacccagtggttggagagtatggtctgtcccaatctggatctgtgaacagagacttgtgttgtggcccctgtgtgtgctggtttctgaatgttctcttgtgcttgagaagattccgtctaatcccctagtgcacagttccacatgccatccacttagctatacctgttggccgtgtggttaatattttgtgtgtctttgctaattcttcctgttggcttagcctattcatacagtttcttaaaaaaacaaaaacaagaaccaaaacaaaactccccctctgatgatgaatttgtctgtttctccttattttttcactttttagaaaaaaaaaaagttctttttttagaggagattctggttcacatcagaattgagaggctatatatatcccctacccacctcaccgtcacctcccccagcatccgcacccaccagggggtacgtttcttacagtcagcgaacctgctctgagcgtcattaccctgagtccgtggtttactttagggttcactctcaggattgttacatcctatgggtttggacaaatactatctcgtatccaccattacggtatcacacagaatagtttcactgccctgaacatcctctgtgctccagctattatcccttcctccccaccccaactcctgacagcagctagtctttctactgtctccgtagttttgcctttcccagaatgtcacatacttggaatcctacagtgttgcagccatttcagatcagaaaaaatttttaaacagaatacttcacctctgatcaccaaaatgcatagggatttcttcctcacccagcccacctctgccccgacaaccagtcagttctctagcaggcatcagctgggagtcctaaaatttaattcatttccaacacagtttgccaggaggaagcgtcagatctgacaggttgaagggctcagtcccataagactgtccccaattcagatgccagttgaaagtagtagtttgttacctatacttctgacctaccagttattggccgggcgcggtggctcacgcctgaactcccagcactttgggaggccgagatgggcagatcatgaggtcaagagattgagaccatcccggccaacatggtgaaaccccgtctctactgacaatgcaaacattagctgggcgtggcatcacgtgactgtaatcccttctactcgggaggctgaggcaggagaattgcttgaacccaggaggcggaggttgcagtgagctgagattgcactactgcactccagcctggtgacagagctagactccatcaaggaaggaaggaaggaaggaaggaaggagggagggagggagggagggagggagggaaggaaggaaggaaggaaggagaaagaaaagaacagagtgcactggtatattttggaatgcttcctttcccttcttgctattggaaacacaaggggatttttctccaatattcactgtgaggcctggtcaggttcctagaggtaaaactcacaaaagtatggggtcccctatgactgggtccctggggttttcaactgtctgacttgcctacaccaagcctgcagcaatctctgttacagtcctggttttcctcccccaacactggttcccacagaattttcagcttatgagtctctgccctggtaagttgtgattgtctgtcttctcctgttggtctctccagtttagggggcagtggtttgccctatgacctaacttctcttatggatctaagaagagttggtttttcagtttattcagctttttacctgttgttaggtagagtggcaacttccaagctcctgacttatgtgaaactggaaagcagaagtctcttatcattttgtatttatgcattttgattgttgatctgtatgcttgaccagcaacattgagtattccagccctatcatcaggcaagttttagaaacattatcttagaagtattggtgggaagcagcttttgtctatcttgaagtgtgtatatttccctgtttgttcaaggtggttgccgtcttctggcttccattgttggctgttgttgaaaacatcggctgcccttcaaattacttttctttgatcggtaaatatgtcttttctatcaggcgcattataaaagtattctctcttttcagttttctgctatttcacaaagacattgtaagagatttgtttttacttatcctattggatattttgtgtgcttcccggggctggattgttgcatgggttttgagaaattctcagatgtgtcttcaagtatcacctttactcgattccctctctcctctcctctgggttgccaattagatgtgagtctcatcatttcatctcatccttctccgtgtctcctaacctgtctttcataaaattttccttcttgtctctgtttcattttggatgacttcttcagttctgtcttcctgttcacaaattctccttcagacaggaagtgaaacagtcactcagtaggatggataagactgtttcgcctgttaatagatttcatctctgcaggttccgtttgcttctattttcagatccagctgggccgctttgctggcctgtccctgcttgctattgcctgtcatctgggagtccgtccttatgtctttaagcctgtaatatttactggattttattatgtatctgataactcctccatctgaagcgtccatctgtttgtcgtttctgctgactcccattcacagttgctcatgttcttgggtgtttggtgacctcgattaggatgtcggttcttgctgggtcgtgaccttggtgatcctgagggccaggatgcgcgtttccctgtacttggggcaggcccagtgtttgcttttcgggcagcagacttggcagcctttgctccccagagcgcacaccctgcttttggtgcttgtctgcccactggatgccctgccgcggtggggagggtgtgctcattcctgcagacgtgccttgccacttgcaggcctgcaatacatttaacacatctgtttgattcaggagctgtaggcagggattgcatcaggaacctggcccacgtgggccctgtgccccttctctgtctgtgttgtggctttgtccaccctgtgtcctcgctgtctgccaggccattttcctacactttttctctccagccttggttctttgcctccccttcccatagtaggccacagaccatctgcttggtgccacgccctgtcctgggtccacgtcagtgcattgagactctaggtccctccaagatggcggagggtagacatttctcttttctgacatgagtgcagttggggcgtgtctcatgcctagagtgtgtgtggtcaggacctggttcacataggtgccatgttttgctgggattggtggtttttactcccattccatggtgtgtcaagtggggatggcatcttcagtcaatggcgtcagggagatggggcttttgagacctctgggaccagtgccctgcctatctctcctaacctctggctgtgtccgtcatgaatcttttcctgaatgcaccaaggggttgtgctgtaggtgacacactgtgtgctcctgcccagcctctgcccataaccctgccctgcacggcccaggtaggctgcacatgctcaccaggcccacctcggccctcccacctctttttgcctctgcacccacagtccccttggctttgctcctctgagttcatgtgagacctgcccatttgtagagtcttgtatttgtccctgccgagccagttgtgtaagcatcacagtctccctaggagacggtggctcttcacaggtcaaggtcagcacctttgaattcagggcactgatgggctcacaccagctgcacgagatgttctcatgtgaagtgtgtggcccgctgctggatttttgtttctttctcttcaggtgttgctggaagaagccaaggatttgctctctgactggctggattctacacttggctgtgatgtcactgacaattccatcttctccaagctgcccaagttctgggagggggacttccacagagacatggaagctctgaatgtaagtgtcacgattgtcttgtgctggctctcttgcgctaagggccctgatttctaaattcctgttttggcaaggccagctcaattaagcggccaagtcaacattgaacttgagttgaggggcataatgggcttttcgttttatgaattgggaacgtttttatggagcgcgtggttttcagaagggaaaatcccaggacattctcatgtcttgcacaggttctccctccagatgtcttaacccgggttagtgagtatgtgccagaaattgtgaactttgtccagaagattgtggacaacggttacgggtaagcacaagggccctccctagggagggaagggctgcagaacatcgcacagggaggagctccccagctctgagcctgagtttgggaagcagaggagcaggtgttctggggctgcgtagctagaagtcccagcagacttcctcctacaactctgggcccacccaggggctgaggagcatgggtctgcactgtcctgggggccatggtgagaacctaacccagaatctgctgggaagctcggaagccaagaccatcagtcatggggccccagagctgcataatggtgagtgcgaatactgctgggccttcacagacatcagtgccattgcgtagacattttgagagtgctagtcctggtgtcatatcccgaaggaggatgcatgtcatcagcatctatcgcttggctatgattttagtgactttttgttggcaaatccatcatacacttccctggcccgtattgtctcaatctccaaagtaagcattttcagaaatggccaacaaatggaaatgcagacaggaacccggttatctgtctgtagtgtgtagggaccagccccacagggtcggtgggtttttctccccatgtgtggagatgagagattgtagaaataaagacacaagacaaagagataaaagagaagacagctgggcccgggggaccactaccaccaagacgcggagaccggtagtggccccgaatgccaggctgcactgatatttattggatacaagacaaaggggtaggttaaggagagtgagccatctccaatgataggtaaggccacgtgggtcacgtgtccactggacagggggcccttccctgcctggcagccaaggcagagagagagaggagacagagagagacagcttacgccattatttctgcatatcagagacttttagtactttcactaatttgctactgctatctagaaggtagagccaggtgtacaggatggaacatgaaggaggactaggagcgtgaccgctgaagcacagcatcacagggagacggttaggcctccggataactgcgggcgagcctgactcatgtcaggccctccacaagaggtggaggagcagagtcttctccagactcccgcggggcaagggagactccctttcctggtctgctaagtagcgggtgtttttccttgacacttacgctaccgctagaccacagtccgcttggcaacgggcatcctcccagacgctggcgttaccactagaccaaggaacccttctggtggccgtgtccgggcataacaggaggttcacactcttgtcttctggtcactcctcactatgtcccctcagctcctatctctgtatggcctggtttttcctagattatgattatagagcgaggattattataatattggaataaagagtaattgctacaaactaatgattaatgatattcatatataatcatatctaagatctatatctggtataactattcttattttatattttattatactggaacagctcgtgcccttggtctcttgcctcggcacctgggtggcttgccgcccacagtagtgctcagcactgtaccgtgcgcctgctcccagagacccactgtgtccagcctcagattgcttccctcccacaggaaccacacaggctggctgaaagagaaacaagaggttgtgacagtgccaggaacggggcagactcttaagcagtagcgctgcttctctccccacttcacacaaactactgtggggcagcataagagcctgtgccaagccgagaggcatgggcaagccgaagctcagagaggacaggtcattccagactggagtaatctagagtgcttcttggaggccaagagcctcagctaagctaatgggtagagtgtggacattcagggaaaggtgaggccacacaagaatgaggacggcagcagccctgagcaaggcagggtgggagctgcatgggtcacaggacgccaggcagagggacgagctgcccagggcaggcaggctgcctccgcagcgggatgggccctggtgtcccactcagtccaaacagctgatacggttttcagtggccaccacagagagtagataggccacagatttcgcacttttatagccctgctttattttgttactgtcatcctgctgacacactttcgggtctgttagatgcacccacccaattccttttctgttttccagctatgtctccaatgggtctgtctactttgatacagcgaagtttgcttctagcgagaagcactcctatgggaagctggtgcctgaggccgttggagatcagaaagcccttcaagaaggggaaggtgaggagggcatgcctgagagcatgtgggctctccctcctggcccagcctgggttgtgttgactttgcaggccacgggggctgcgctgagcccacccctcagactcttgggaacagtgctttttcacctgaaggaattttaggagttttctgcactcaacattgtgcagctctaagaccatgacatgtgtttttttaatggatatataataattatgcaatttatggggaacatgtgatgtcttaatacatgcacaccctgtgtgatgatcggggtagttaggatgctcgtcaccttagacatttaccttttctttgcattgggaatgttccagatcttctggctatgttgaaatatacaacaaatgttttggtaactatagtcaccctactgtgctagtgaccacaagaacctattctttctgtctgtgtgtttgtgcctagaaaccaacctctccccactcactgcccctgacctgacccttctcagcttctggtgaccactgttctatgctgcacctccttgaggtccaccgttttttagctcccacataagagagaggacatgtgatatttgtctttctctgcctggtttatttcacttaacagaacgtcttccagttccatccatgttgctgtaaaagacaagatgtcatttttttatggtgtgttattttttaagaaacaaaagacagtaaacgcagtgctgtcttgagaaacacagtggcccctggggcctggattcacagggctggtgtttgctggctgagcatgtgaggtttagggggattgtggggtgctgggatgtgtgccgagtgatgcatatttgacaacagcctgtgcgcccatctggatccaaatgcttcaaacacagatatcagactttttctagaccaggcagaattatattgggaaccctttcgttggtgttttcttcatgtttatcccttaagtgaatctggggacacatccacaagaggcaaggttggaagcctccctgcagagtggggattcccgcaatgtgccagggcacgttctgcacccccaccccgcctgtcctagtgtttctggaagacaatttggccataaaaatgttcatacttttatctaattttaggctctattctaaagaaatatcagaacctaaaataaaggtgcggtggctcacgcctataatcccagcacttttggaggccgaggtgggtggatcacctgaggttgggagttcgagaccagcctggccaacatggcgaaaccccatctctactaaaaatacacaaattagccaggtgtggtggtgcttgcctgtaatcccagctactcaggaggctgaggcatgagaatcacttgaacccaggaggcagaggttatagtgagccaagattgtgccactgcactccagcctgggtgacagaatgagactctgtctcaaaaaaatatataataaaataaaaccagacaacacagactgaagaaagatagagatagccaggttgacacataaatatcagacccatggcatttcaggctccgggtttgtgggagtagaggggcgggtttgtgatgatgaagcgcctcagctctgagaggatgcagcctgggcctctagaccagaaggcttcactaccctagaaccagagtggacatgcccacgtttcatgcacttcccaggagttgacagatcaagtaggccaagaattaatatggatatgaaaggtttgaaatacagttaacaggcttggtttgagagctgggaactttgcactcaggaattaaagaacatcctttccttccaagaacacagaaacatatgccaggccacagaaagatttccacaaatctcaaagaaccgttttcaaggaaccctcattctgtcaaggagccctcattctgtcaccatggagcgattgtattagataacaacacttggccagacatggcgacccacacctgtaatcccagcactttgggaggccgaggcaggaggatcgcttgagcccaggagttccagaccaacctgggcaacatagggagaccccctttctacaaaaaatttaaaaatgagctgggtgtggtggcacgtgcctatagtcccagctacttaagaggctgatgcaggaggatcacttcagcccaagaagtcaaggctgcagtgagccctgattgtgccattgcactccagcctgggcaacagagcaagactctgtctcaaagacattaaaaaaaattttttttttaaataaaaaagataccagcactgacaggacggacgtctaaaatgtacaaacttgtctggggggttgaaatcatgctcctggataactcctaggaaagaaaaccacagtgggaaatcaggggtgtttaagcagaacagcagcaaaggtgccacacaccaaatctggagaatgcccctaaagcaccaattagaggaaactgatgtttttaaatgtagttattaaaaaacaaagatggaaaataagtgaggtgccgggtgcagtggctcacgcctgtaatcccagcactttgggaggccaaggcaggcggatcacgaggtcaggagttcgagaccagcctggccaatgtggtgaaaccccatctctactaaaaatacaaaaattagccgggtgtggtggcgcatgcctgtagtcccagctactcgggaggctgaggcagaagaatcgcttgaaccctggaggcggaggttgcagtgagctgagatcgtgccactgcactccaacctgggtgacagagcaagagtccatctcaaacaaaaaaaaaggaaataagtgagctaagcagtcagtcaaaaagctgggaaaggaacaagaagaagtagaaagaaataggaggaaataaagtaaaatcagagattaaagaaacagaaacaattgtaaaagccaaaagctgattcttctcaaaaaataatatagaagaacccttagcaagtttgattaataaaagtagaagattgaaaaacatattagggctgaattatagctcatgcctataattcagcactttgggaggccgaggcaggaggatcgcttgaggccaggaattcaagaccatcgtgggcaatgtagtgagaccgcatctctacaaaaattttaaaaattagctgagtgtggtagcatgcacctgtagtcccagttactcagaaggctgaggtaagagggttgcttgagccagggaggtcgaggctgtagtgagctgtgattacaccgttgcactccagcctggctgacagcaagatcctgtgtgtgtgtttgaatgtatgtatgtatgtatgtatgtttgaataacaagacaaaaatggaatgtaactatggatatagtagagcatttcttaaagtccttagaggaagccgtgaacaactcgcactgcatttgacacttagatgccgggagggaactggcagcacatgggaaaggtgggagtggtaagtggagcagtgccctcaggtcacgtggtgaaggaatgttctggaggcagctagagcacactgactcaccactttatgatgaattttgctatctggccccatctagggtctttttcttaaataccatttattcttgggcccattttcttccagaatgacttcagcattggtttaagttccaggaaacaggagtagaatctaacagccaatatgcaggaccaaagagggacatggatttccacccctccacagtcagtgatcagacgtgggcacatgaccacccccgcaacctccccccaccatggggagtcataaggagtgtagccttagctctgtgcagtcatgtgctcctcgccatggggactctaatggtagaggaaaaggggaggggtgatgctggggcccaagtggtcctagatgatgacagctcctcactccgccaagtaagatgacccaccagaggcagatgggccatgcagaccactcgggaaggcacgtggcaggaaggcctagtgcagggaggaagctcccccagtgggagagaacaggaccctgttgtgctggtatgaacatgcttgtagggtcaaagctagaaacactcactctgcctctggggagagagacaggaaatgaaaccaagaaggaaaacttgaaagacattgtgttgtaaccataataggtctgttgcccaatgcacagcgagtcagtataccgggataccaggggttgccgtagaagaagcgtagtaattgtatggtggacaaatggagatgggaggaaacctcagatccgcctccctgagatttggggaggggtttttaattgctctggacaggtgatggggattgccggttgctggggaagtgaggggcgaagtcatgggacagggaggtaaaccacatttctgcgacgagtcagttccttggtgcaggtcttcagaccagttggcaacagctgtcctgctggaattcaggatccaaaaaataccttaagcagttcttggtaaaaaggtccagggttagagattctatcgctaggaacagtggtggagcaggtggtcagcgtgctatgtgactctcagttagagctgcagggaagcggatggacgtgcactgcacctggccagtgaccggcctcatcattctgcctatagcctgccttggaattctcattaaccctatgagggcagttgcagtgtgatgtttgctgaaggatagggtgtttgtggggagggtcctgtgttctctgttatcaattttttcaaagcgtatttttaaaaaatcagatataaactttcatgagtaagttcataataatgaaaagttgaaaacgtgaatgtatattttctatcaaagagcatctaaaagcgaatgtcatgggccatatcacattgtgcttttgcggaattgtcagtggcagaacagtgcggaggtagaaggaagccaggacagcggccttccgtgttggtggatagatctggattttgcttgcagaggttttttgtgtttttgtgtgtttgttttttaatctgggaatcagtataccaaaatggtaacagtagtaattcctaggttaaaagataatggcaatttttttcctagttttctttttttatctttcaaatattctacatttagtacatattttataatcatgaacttggtgtttagaaaaatatatttagcggtgcttttcctctggactctgtttctcagggcagcttaggtctgttgcctgattaggctcctgaaaagtggatttgtcacctggaaagatctcactgcagcttcttcagggtcacctgagttagaaccctagatggagtctgttcttcctccacaagggggtgacagcacctaaggcagcccttagaccagggaccaggaaaggctgcagcagccgggcaagacctggcgtgggtcctggtaaccttatgcctagagtgaagacctctgctctgcccattcatcgaacaaagggtgattctctgcgtgacctttggactggctcacaggtttctttattcacagcagctaatcttttccattggtcctgcatgtattgttgagagaaatctgcagtgatggtgcattccttttctggggactcagaccgccttgtaccctgagtgtcaggtggctgagtgtcaccgagtcaatgcatggaattcaccaaggggttatttctcatccctctggcaaggcatagacagtcttgtttttgttggccaggtgatcattggctttgtccaggaaatagaacttgtgccaagagcagtactccccttttcttatggccttcctggactattctttagtttccttcacctattttccccttataaatacacaggaacagcaaatgtccccttcaccactgcactgccaccaggttccctgcagtagtacacagcagcttagctgcatccttgtatcccccgggacccataagcagatagttgtgcgggcccttgacatattgaccccacccgcatgaaccaggcaggatccctgagccatgccccagtggctgcaccactatgtcacctcctagctttagcccagggttcttatcacttgtcctagacactggtgggctaatgctgtgagaaggcagcaggaaggtgaatgtcttacggagaccccagatgtggcctcaagtcagccaggtatataagctggtgactttggggattatgtaccgttttgtaaatctagacactgggtcaacaccagaatctggtaatacatagttaacttgaagaaatgcttgagccaagttaataaacagaagttagtcagaaggactgcccattaggcaccgtggatggccttgaagtgagacatgtgggtctgtgggtgctgctgagtgaccttgcctggcgtccctcgtgtttgcaggtgacctgagcatctctgcagaccgcctgagtgagaagcgctctcccaacgactttgccttatggaaggcctctaagcccggagaaccgtcctggccgtgcccttggggaaaggtgagcgagtggcctagaaggtgtggggcttggacaggggcactggcgccagccacactctcaggcccccagcagagggccgctctgtgtgtgaaggatgttgtcactgggccagagcctggtgctggtgcagcacaggctgcctggccccggggacctggacatcatggagactccctgagtctctggacaaatcacttccctcctgggatttctgttttctggtctgtaagtggagatgtgatcagagtagatgtccatggaggcttcttggttcttgtgttctgtgactctgagtattccaggccccagggtgtaggatgcgttctgatcttcccggtgacaggagttgttgactgcagggtaccctaggaaggggcgtgaccatctgcagctgtcaagggctcagaggtctggatgtaattcagtaacttcacctaaacctcggcccacataggaccggtttatgaacttcaccaaagaaggctatccttagtcttttttttttttttgagacagagtgtcactctgtcaccaggctggagtgcagtggcgcgatctcagctcactgcaacctctgcctcctagtcccggttcaagcaattctcctgcctcagcctcctgagtagctgggattacaggcatacgtcaccatgctcagctaatttttgtatttttttgtatttttagtagagacggggtttcaccatgttggccaggctggtcttgaactcctgacctggtgatccgtctgcctcggcatcgcaaagtgctgggattacaggtgtgagccatctcgcccagccttcccttagtcttttcatgtgcgggatttaacgcttgttccaataaagttcagaggatgtaagggccatcaacttggagtgataagtgataaaggcctggacaagcgggtaggctggtcagtcactgtgtgttcggctttctccagggtcgtccgggctggcatatcgagtgctcggccatggcaggcaccctcctaggggcttcgatggacattcacggaggtgggttcgacctccggttcccccaccatgacaatgagctggcacagtcggaggtaggtgaaaacagagtccccttgtcaggtgcaagagcacagtgttcatactgcagtggaggaaaagtcagcccaggcctcagaagggcctctctcactagaacttgacaccttcatcggggcttgtgggtggaatctgaaccctgatcatttagtgtggtttccgcattgacagcctggcctttggcaacagactagcctggatttgaaccagttgtgttacctgctggcttattaacctgggctgtccttccaagccctgcctgcaccacctggaaaacacagctcctgcctgtggacagcaccaacaaggcagcagacagtgcaggtggcaggaggcggccccagtaacacatgactgttgacatcctttgtctctttccacgcaggcctactttgaaaacgactgctgggtcaggtacttcctgcacacaggccacctgaccattgcaggctgcaaaatgtcaaagtcactaaaaaacttcatcaccattaaagatgccttgaaaaagcactcaggtatacactggcttctcccacagaccccccaaccaccttctcatacatgtgtaatggctgtagcactcgggagaataagggcgttggctgtcttgtgtccccccacagcacggcagttgcggctggccttcctcatgcactcgtggaaggacaccctggactactccagcaacaccatggagtcagcgcttcaatatgagaagttcttgaatgtgagtccccagccccttcctggaggttggtggagcagcctcccctgcacagtgggcaccttgtgcagtggtgataggtgcaccagcctcccgatgtctctaatggagaccagcacatgggtggaagcacctccatgctagtgggtataacaggctcggggccactcctgaaatggctgacggctcagcagagtggacagaggcctcgtcctcctagtcactgcagtgcacgtccttctgacttgtactttccaccaaatgagcatctgtaaacctaaagcaagaacatgtttctgtcaaagaaatatcttttcctttctttctgaccacttgtgtaattctggtctttcagatttttaccaaaaataaaatcacagcagtagaaagttgtaacagatatttcaggatggaaaagttgcctaaatgctgttaaactgatttttctaacttcaggagtttttcttaaatgtgaaagatatccttcgcgctcctgttgacatcactggtcagtttgagaagtggggagaagaagaagcagaactgaataagaagtaaggtggtgccatttctttggggtttttgagcatgcccatgttctatgcctagcctcgcatcttggccaccatgtgtcctggactgtcgaggaagggctggggacactgtcgtacgttgtgcagaattaattcaggataggcggctctgctaatgggagctgctctgggtgttgaagtgcatggagaatttcttttttgttttttctttttgagacggagtttcgcccttgttgcccaggctggagtgcagtggcgtgatctcggctcaccacaacctccacctcccgggttcgagcgattctcctgcctcagcctcccgagtagctggggttacaggcatgcgccaccatacctggctaatttctgatttttagtagaggtgggggtctctccatgtttgtcaggctggtctcgaactcccgacctcaggtgatccgcccacctcagcctcccaaagtgctgggattataggcgtgagccactgcgcctggccacatggggaatttctatggtgtgttttcaggtctgacttcacattccttcctctttgttgctcagcttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaaggtaagccaggccccaggcaggcgtatccctcagcctgtgtggacacaggagccaggccccaggactgggagaacagaggcctctggtgccccccagtgctgtgcctggtgcccagcacctctgagacgtggagatatgcttctgtcctctttggttcctggtgtgcttttcacgcgttagaaataacacccataagcggagcacagtggctcacatctataatccaacactgtgggaggccaggtgagtgtatcacctgagcccaggagttcaaaaccagcctggacaacatagtgagatcccgggtctataaaatatattaaaaattagccaggtgtggtggcacacacctgttttccagctgcttgggaggctgaggtgaggggctcgcttgagcccaggaggttgaatagtgaggtgtgattgcactactgcactccactctgggcaatagaggggagaccctgtctcaaaaccagacaaaaataagtaacatccatatagttgtccttactcagagctatttctttcctttgactccgtttccctctactcccatcttggagtttgaaaagcaaaaccacgccaggcgctgtggctcacacctgtaatcccagcactttgggaggccaaggcgggcggatcacaaggtcaggagatggagaccatcctgactaacacggtgaaaccccgtctctactaaaaaaaatacaaaaaactagccaggcatggtggcgggttcctgtagttccagctactcgggaggctgaggcaggagaatggcatgaacccaggaggcagagcttgcagtgagccaagattgcgccattgcactccagcctgggcgacagagtgagattccatctcaaaaaaaaaaaaaaaagagaagcaaaaccagggacaaggcctcctctctgaacacatcctgtgcagagcccttccccgcagtgcaccttgaaaggccagcagggcctggactcaactcccctcccctctcctcctctttccttgttgttgggctccagtggcttctggctgaaacagagctggagagggtagctgtgagtcagggccatcctggagcaatgagggcaccctcaggctcgggtttctggggctcctggagctgctgcttccatctctttcctggtcttggggcaccccctcccgtgaacgaggaacacagctcacagctgctcgccacatgccgccttcatcttgccgcagcttcaggtcccatctgtttcttttcctagatctttggggccgtagaagaggacagctccctgggattcccggtcggagggcctggaaccagcctcagtgtgagtagcatgcagggtcctgccttctgcacctgctccctccccactccctacccctctgtgtccctctgaactgcccctcctctgtctgcccacccacaccagacccttccggacagcgcctcgagctaaatggcaattctggctctgagagtgctaagtgtggtcagctgccctgccggtgtggagggtctgctttggttgtgactgttggtttggggcactttgccattgtgctgtcccatgagcttggtcttggaccccaactacataggccgctgcttatttgcattttgctgcggccacttggcatcatgaacacacatgacttcatcacatatactgacctgtattcagtaaatgcttcatcgaaaggctgcagagctcacaaacagcacagaatttacactgatggggagatacgccactgtctgcctcggtccccatggggctgggcagatgccctaacaggcccagtcctgaccctgagcccaggtcggtccacatggcctgagccaggaccccctgccccagagctgtggcccacaggtcagggggaggtcatcctgtagagccccctgtctagtgggtctgtgcggtgagaaaatccatccagaacaccctggcagtctgttgctggcttctgtttgcagttggcatgtgagcagacacacactgtcagtcctatccttctgctgtagaacccctgtcccgtctgacacacccacagtcaggcttcttaaagatggacttccacctgctcccaggtcaagaatgctctttgactattcgattagaatgcagatctaaatatttaaatagaacaactgtaattttaattaaaacaggagcttaatacaaagtcaaaatgcaaaacctttttaaaatcctgtttcctaatgacaagtggtgtgaagagcccccatgcggatggagcttacagatgctcccccaggaaccaacttgcaaagagaaaacagtccgtgttgtaagaagtcctgccagagcacctagcccatgtgcctggtgccttttgccagccttagcgctagctagcttggttgtggtagttggtgtggtatttttgagacttcctgatatgaaccttctttggtgcttttaagaaaacccacatagcttctttgttctcttgcgcaaatgatactaagatatttattttctttaaaaacaaaaaaccaaaacacacctcctgggttaaagtcagcctgcctttgaactgcagtgtttttcatcttaacggctgctgtggttgtgggggtgccttcagcgtgctgtggacacgcatccgcatcccccaggcagcctcatttggcctttgcagtcagctgattgcgaagaagcagctgcggcgaatggtgagcctgctgacaaaacgtcctgtgcccacacatcatggccatttgacgttcatggattaacttccaaatccaaatggttttaggagcaagggaggcagttcctccatcttgtaccacctcagtgtcgccacacagccacctgctagcatgctcaggtgggggttgcagccccaggcgttcttgagacacacccctgcagccattctgagagttcccctccagtgcccctagggctggaactgagcctagcagtggggtgaatgcctccctttctgtccttccccaaggcttgtctgggctggctgtgtggtgggtggagatacagatggaaaacccccaagaagtccaaagttcagatgcagaattgggtctcagggagcttggcttagacttaagggcttgctagcctgcctgacttttgcacttgctaaatttgtgtgtttctgtttttgagacagagtctcactctgtcgcccatgccagtccctgccctgtgtcgtggccgctgagctattattcagttatggatataggagtgtgagcagctctcagcgaacaaaagctcttctttccacagctggagtgcagtagcgcaatctccggtcactgcaccctctgcctcccgagttcaagtgattctcctgcctcagcctcctgagtagctgggactacaggcatgcaccaccatgcccggctaatttttttttgtattttagtagagacgggggtttcactatgttggccaggctagtcttgaactcctgacctcatgatccacccacttcgccctcccaaagtgctgggattacagttgtgagtcaccgcgcccagccagcacttgctaatgtttttattttggttactgagctgctgaatcagctaaggggcagggagcaaccttgctcaaaagcctaaaacctttcctgtcctattagaaaaagagaaatgctagcacagcatggtggctcacgcctgtaatcccagcactttgggaggctgaggtgggtgaatcacctgaggtcgggagttcgagaccagcctgaccaacatggagaaaccctgtctctactaaaaatacaaaattagctgggcgtagtggcgcatgcctgtaatcccagctacgcgggaggctgaggcaggagaatcgcttgaacctggaaggtggaggttgcggtgagccgagatcgccattgcatgccagtctgggcaatgagagcaaaactccatctcaaaaaaaaaaaggggaaatgctttgggaggccaaggcgggcagatcacaaggttaggagattgagaccatcctggccaacaaggtgaaacctcatctctactgaaaatacaaaaattagccaggcgtggtggcgcttgcctgtaatcccagctactcgggaggctgaggcaggtgaatcgcttgaacctgggaggctgaggttgcagtgagccgagatcacaccattgcactccagcctggcaacagagcaagattccgtcttaaaaaaaaaaaaaaaaaaaaaaaagggaaatatagtagaaaggtttttctatcctgtggccacctccccagtgttactgtgggtggtgaatctacgtgtagctgctaatgtgcatgtagatagtaggtgcttaatggagatcattcatcttaaacaagtgtatgtgtgaccacagatcagacgaaagcacggcccgggagccgccagcctcagcataggtaaggccccagcctggggagtgatgtccttgggctccttaggaaatagtccctcccagagctggcccctctgaaaccataaagacaagctgtttcacagcagcgtgtctgacctgaggaaagcagggcctgtcagcagctgggcagagcggcggcagacccacctgctgcagtagaaaggaagctcacttcatgctctctggcctgagagtctgtgtgactcgcacacctagcagggactgtgtgtcagggacgagagcgtccaggctctgggatgccggtcacagctgtagtgtgcacagcagcactgcccatgccagtccctgccctgtgtcgcggccactgagctattattctgttatgaatatgggagtgtgagcagctctcagtgaaccaaaactgttctttccgcagctcgaggccacagtcatgccctaccttcaggtgttatcagaattccgagaaggagtgcggaagattgcccgagagcaaaaaggtgaggaccagttgctggaaagagtgtgggagccactcccctcactgggctccccggaccgggcgtctcccccgaggcactatggcgttcaggccggatcatcctctgggaaggctgccccgtgcaccacagggtgttgaacggcatcccgggcctggacccaccaggtgcattagtaccacacgctccagtcaccacagccccacatgtccctgcagggcagaatcctcgagtgagtgcagctgagtgggcagtggggaccgaggatgtgatatgatgggccagggttgatttgcctctccttctctgagccgaggcagaatggtgggtcctctgaccagcccagtcaccacctgccatttggctcacactggggcttatttttgttcctggtgacctggtaggctgggtgcgctgaggtgtggctcgttcctgctgccgagtggagccgagctgcagcttccagggttcccttttctgctcaggcatgccagatgaatgcttgaacttggggttcacacagtggcccctcactgtccataagcagccattccttcatctttttgtttgtttgtttgtttgagatggagtctcactctgtctcccaggctggagtgcagtggcgcgatctcggctcactgcaagctccgcctcccgggttcacgccattcttctgcctcagcctcctgagtagctgggactacaggcgcccgccaccgcgcccggctaattttttgtatttttttttttttagcagagatggggtttcaccgtgttggccaggatggtctcgatctcctgacctcgtgatccacccgcctcggcctcccaaagtgctgggagtacaggcgtgagccaccgcgcctggccattccttcatcttttgaaatttctgagatgtgtgtggtttaagacttagaaagtgctgaatctgagcattcgttttgactgccagttttaagaaagtgttaaacacagcaaaaagcagcatcaggcaggcctttgcttcttcctgtgagtggttctgaattggtgagtaacagcacagctgggaacacacactgaggacttaggatgtgctgggccctgcccactgctttctgcacattgcctcatttaccaccatgatcctccaaaagaggaaaggagagccctggccgggtcacactgacctcgagtgctactccatcacctgctgtgctaattctccctccccagggggcctctgtgtggtgggaagtctgacctaggatccacctggtccccatctgtgcagagcccattatggagggtcacagtggggcagcatccaggcagggcatgctgaagacagagcagacagagacccagcaagcctctaggagaagctgcaccttgaggaaggatcaggaagcctgggtgggtggaggggccgagaggcggaggagccgaatctgggcctgtttcgggcaggggacagtggagcaggaggcaggagggcaggaaagagtttcgggagctcggggctccacaggctgcaggagagtgcaggacactgggtgagaggagaggctggccgggctgctgggctgctgggctgccacaagtgctctggagaggggcctgggcctgactgagcccctaacaggcagcggtgggcgcacttgccctgaccacataagcaccatcgcccctttccaacacctgatgccctcagcatttcaaagcactggaatcaaactgaaccaagcctggaccagcctattcaggaccagcgcagggctctccagcaatcttggcagcactaacttagcggcatcgctggggtcgtgggcttgggaagaccattcctggaggtcgcctgggcatttccacctgccttctgggggacatcgaaggccgagcccgggccccagctccctggggtcatacaagactgtgcacgtggccttggcttccctggcatgccacagccccgggagggcgctaaagggggactggccaggcacaagctcccgctcggtggcactgaccaggacaggacttgctcaggcctggagagtggcaccagccagccagcattggaagtagttcggttttgctttctgtttgcttttcacttttgttttgtggcttggagcaggtagatgggtgatgtggccccaggttaagatggtggtgatccctaccctgtacatcatcccatatgtgccttgtgagccagagaccctggggatccaggggcctcagaccttccgacggggcagcgtgttagaggtggctctggtgcaatcaccctgtctccccagcagcagcaaatagtgactgttttgttattcactgttaacatctcatggctggccaaagagaaagtgagtgtataacaagctcaggggtggccctcagatcagctgggatctgcttggcccaggccagatgctccacagacagacgaaaaagaaactgtttcccctggaaatacccccatggtccagtcagctagagagcacaggcctggcaaggagggcaatgggttcagggtttgaccaggagagaggcactgaagtgagaaagccaggggctgggccagggccctctgcactggggagatgatgccatttccccatcgccacggttttgttttcattatgttaaaatacacagctcagtgccattagggacatttacagtgttgtgcagccgccaccgtccatctccagaactcttcccttttcccaaactggaactctgtccccatggaacagcaactccacatcccctccctcagcccctggtgctcaccctctacttctgtctctttggattttactactccagggaccctacatgagtggagtcacacagtgtttgtcctgtgtctggcttatttcgctgatcacggtgtcctcaggtctatccacgttgcagcctgtgtcaggacctcctgcctttttaatggccaaatcatattccatggatggatgggccctgatctgtctattcttccatggaagaattctcatcacctttgcgttatctttgtagcccacatttctcttcagtaaatccctgatgatgatgtcattgtctgctcctctgccccagctctgctaacagaagccacagaggcttcttcctcagctcctcagaatccagacccagaggtcggtgtgggcctgaggggtacggcgtgtgtccctttcccccagggagtgtggcccgggaggctttcttggtgcctgctctgatgatcacccatggcgggtgggctggggtgctggccttgtggcctcccatgacacccgtgacagtgaccacaggtgctggcttgccttccttctaatgagggtgctatccaggggtggctttcaaagagtgaagggcaggcacctacctcagctcatgccccagtcagctgctcctcaggtggctgaggagggcctgttcccaggaatgatactgcagacaaatataaaggccattgttcccctaggtctctgcctggggaggttgaaactccggaagctgcccaaagtggctgtgcttatgagcgcggccttgaagcccaaggatatgcaattttttttttttttttttgagatggagtcttgccctgtcgctaggctggagtgcagtggtgtcatcttggcccactgcaacctccgactccctggttcaagcgattcttctgcctcagcgtcccaagtagctgggattacaggcacatgccaccacacccagatagtttttgtatttttagtagagatggggtttcaccatgttggccaggatggtctcgatctcctgaccttgtgatccacccgcctcagcctccaaaagtgctgggattacagtcatgagccaccgtgcctgcccggatatgtgaatattttatctagcagtgaatgaaggtgtggggtgcccagcaaggagctctaggggtctcagttatgaggacacagcaggaaaaggacagacgagaatggcagcatgtgcatggtcagtgctgcccaaaggcagggcaggcaggaggatggggtgggatggtgggggtcccagcaggctggggggcagggcacctgcccgcctagcacagttgggcgcagcaagctgaggggccagaagaaaactaaagggtgtggtgattccagcaaacccaaggtcagatttcagagcagaaagttgtcacttggagagcagcaagcatctgtcctgttgatgtagtctaggagatgctgtcacatcacctgatactctggagtctttctgagataggttggcatcccatttaccctgtaacacccaaaacttcttatgtcctgttctctacctgggcgttgtgcgtgggctgggaatgggaaaactcgggcagagcagagacacagagggggcgcctgctagagactgcgtgaggagcccactaggagaaccgtgggatgccgggcaagtctgcactgctgcgctctgaagtcagccacagacacatgggtttccaagcgaagctccctccccatgtgatggaggtcacagtcgccctccctgtcatgcctcctttcaccctcccagctgggtcaggtccccagtcagaggcagaggtgagcacagtcttgggaagcaacctgcggtccacccccaccgctcagccccgcctttacagctgcgtgcgcttcagccctgggagggctgattctcacagagctcgagctccttggtggtcctgggactcagctctcctgggtgccggtcaggacccccatcgcagtcccgtgtgcatttgggaaccaagtccttggggcttgagtgtaaatggtccttctgtaagaaagctgattctggcaccaacagagaggctgcctcagatgaagagtgttagcacccgaagggacccccaggcctgtcctgaccctcccacccctgctgtcggcccaacttgtgtccctttcctggaagaactgcttccggcggccagtgtgctatgcttcctcctggctctgccctgcacccccagaacagcccctgggcttacgggagacactagtctctgggcttctgcagccaatcaagctgctgggccctccctcccaagcactggaggaggtactcgttctgtgggccggggcccctccctcctgagcactggaggaggcacttgttctgtgggccacggcccctccctccccagcactggaggaggcactggttgtgtgggccctggctcctccatgtctgagggaactgctctgcttctcctacagtccctgagattctgcagctcagcgatgccctgcgggacaacatcctgcctgagcttggggtgcggtttgaagaccacgaaggtgggtgagcccttgctgtttgctacaaagttaccaggagcttggagaggtgtcacaaggagagctcccggggctgggctgaggctcatgcttcatgattgctgatgcagaatcccaaagtggcagccccatgggtcccccggcgccattcccacgctggccagcctggcaggggcaggggagcaccccgtagctccttcccactgctgcgtgtggtggcgtcacctcccctgcgcatcatctcccctaggggcctggctgcccgctgcccctgttgctaccgcctttgaagctctcagctgaggaaccagcctgtatcctgtacactgtcaacagattgcatgcttgttctcccacttcgtggaggtctttttgttccacagaaagttaatttttttgttttttattttcaatttttatttatttgtttattgagacagagtttcgctctgtcgcccaggccggagtacagtggcgcgatctcggctcattgcaacctctgcctcccgggttcaagcgattctcctgcctcagcctcccgagtagctgggattacagacgcccatcaccacgctcggctaatttttgtatctttagtagagacggggtttcactgtgttgaccaggctagtgtcgaactcctgacctcaagtaatctgcccacctcggcctcctaaagtggcatgagccacatgcccagccttagtttcagtttttatggatacataatagttgtacatatttatgggctatgtgtgatatttggatacatgcgtatgaggtactatgatcaaatctaggtaactgagatgtccatcacctcaagcatttatcatttctttgtgttacgaaccctccaattccactcttccactctgcccctggtaattttaaatctcagatgtcatgtcctattttcctactcctggctggcaagaccttcctaccttctcgttacaaaatgttctcgccaggtgtggtggctcatacctgtatcctagcactttgggaggctgaggtgggtggattacctgagctcaggagttcgagaccagcctaggcaacatggtgaaaccccgtctccactaaaatacaaaacattagctgggtgtgggctccttgggcagctgagacacgagaattgcttgaacccgataggcaaaggttgcagtgagctgagatcgtgccactgcactccagcctggatgacagagcaagactctgtctcaaaaaaaaaaaaaaaaaatcacacacacacaaaccaaaatgttctcctgtgcttcactgctgctatggaggtttttgtttgtttttctcctgtgggccctcgctctgactgggcagcaccgcatggtctgggcagggcagggcagggcagggctggccccgcagtggggacggcccacagagcccagcctcttctcacacgcagtttattttgcaggactgcccacagtggtgaaactggtagacagaaacaccttattaaaagagagagaagaaaagagacgggtgagtaaagtgaaaatgacttaagcgtgatatttgttgaaaatgtaaaaaccattgcgattattacatagtttactttttaagcattgatgtttacacttttattaaaatcccagtatttataaatgtcagaaagaaaaattaactagtatcttctaatgaaggacctcttttaaaaagattattccctcagtttaagtgaaaaccagtcacttttggcaaactgtgaagctgactttttttttttttttttttttgagacggagtctcactctgttgctcagactggagtgcagtggcacgatcttggctcactgcaacctccacttccctggttcaagggattctcctgcctcagcctcccaagtagctgggactacaggcacgcaccactgtgcccagctaatttttgtatttttttagtagagatggggtttcaccatgttggtcaggctggtctcaatctcctgacctcgtgatccacccaccttggcctcccaaagtgctgggattacaggcttgagccaccacgcctggcccgaagctgacatgttaagatcccagtcccaccgtgccctcacctgggtggcgcgtgtcactgatgcatctccacctcctattcccagcatactccccacctgcaccccacaacgcccccaggatcagggatggcccaagttcctcggtgcccaataggacagaagaacaggaacaaaaacgcaatgtcagaatctctgggcacagcgcatggggtaccctgggatgcaggcagcaggatgagaggcacctgggcccccagtgcacaccatgggaggtgggccatgggggctgttgccaccagcaggtgggtccccaagaggcttaaagcaggagaccaccgtggagggcgagtttggatgccacagctctcaggaaggaggctctgggaggaactgaggaaggagaatcgacagggtggttgattgatagatgggatgtacaaggtcagggaaggcatctatgcctagccctgcactggcccaaggcacgaggggagagctcatgccagatccaagtgtgggtggctggagtttgcagtgctttggaggaataacgaactggaactctggggaaagctctagacagtggtgagtggtctgcaggtccatcctggttggcaggttgggaagagctgggcttgccctgtgaggttggctggtgtgactgcctcatcagggcccctccccattccatcacagtcactcacctagccttgggtctcgcctgccgtgctgtgctgtgaggtggcctggtgctggctgtgcagacgccctggcttgctgcactccctggcagagtgctcagaagcaggaaacagacaagaggagcgccagggtggcccggccagagcctcacaggccttgcactctttgtgctggcctttccactggccaccttggctgtggcctgtgacttctagtagctcctgtttcccaaccaagggactcttacctcaccaagctgctgcaagaaggcatccccaggcccgaggcaccatgggggaggggtcctgcctctccctgtaccattcccaccagcacataaacacatactaacttttaaagggaaaaagcagaaatcctgagcactgtgtctctggttcctccaagctcagtgcccagctcctcccccacctcagcccctttccctcggccagccctgctctccctccatctatctcgaaagagctcgatcctgttggccccagccccatcctgagtctctgagacctttgtgccttcctggtttcttttccctagctctgtgtgtggcgcctccccaggagaccttatctggtcctgcggcttctccaccatctatcttgtacccggtggcccaaaaacagtttgcccagctgcctacctgatagctccactgggccaggaagcctctgatatctaggctgtccaaagtaaatgtgattttcaactccccaaacttgttcctccttcctgccatggagggcgtgcctacctgatagctccactgggctgggaagcatctgaaacctaggctgtccaaaggaaaggtgaaaatgtgattttcaactccccaaacttgctccttttccgtcagtggagggcatgtctgtttgtgcaatggctcaggccagaacctcaaagcaaccgagggcttccctcaccggcacccagcctgctggctccactaataagctctccctgcagcatcagactgtcctcgcccctgcccgggtgctgcctgctggttggagtgggctctggtctcctcacctagcccccaaggctgccctccgcccaccatccccatcctgccctggcgctcttgctccttcccaggtaccccaagacccactcaggataaccctcacagtgctgtcctggtcattgccttacagatcctctctccttgggccaggctcaccatgctggtccctttcttcatgttagtggtgcctggatcttttagcattggttctgtttgtctgcctgctgcatacctttgcatctagggcagggccaggcacccaggggtgccgctgaggatccccaaagggaatggaagagggtcggtgtgctgcccggcacatgggcttgtctccccacagtggggagggcctggtcagagttcagccctccatgccaggccctaggagaggggcttgtttggctagacctctcactccgagagacccagcagcctgaggcagccctgtctcatctggctctgtattgaccctccaggttgaagaggagaagaggaagaagaaagaggaggcggcccggaggaaacaggaacaagaagtaatgcattttgtttgggggtgagggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatgtaagcatgtaagcatccttctcttctattcagaacttgatcagaccacattaaagtgggaggacaggaattttcaaccttggacaagcagattttctgtctgtagaaaatttggaatcaaatctgacacccgctttaggtccagggcctcctggcccaactactgagctccttccacagcccaggcagctaggcaagcccgtgccagggccccctccactggtgtggtgagctctggtccctagccctgggagttgtggccccgggccaagatccacccaggccctcacaagctggctgaagtgccgtggcgcagataggcctcctacccccagtttcttcctttgtcatagcgattcacagccactgcctccaaacctctaggcccctccctgctggcatttggatgtgtttgctatgtacctttgggccagctgtgtcagaactcagccatgggtaggctctgaggggcacagtgcccctcaccttaggcaggaagcacccccagactctggtcgcccctctcccattcttagctgctggagccagcactgccagatgagtgtgctggctccagagcagtgtggtgactgaatgtccaagcaagaggacatggctgcatcagggagatagacactttgagacgggagggcaaagaaaggggagttggggttacccaggtgcagaggagaccaatagccgctgtgctctgggttttcagggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctctctgtcttgttctgcatgttcagcacttggcaggaggcctggtggccagccagggccgcttggtcagcaggtcacaacttaggtgcttgggtcagttgagctgcttcagctggccgaggaatttctcccccatgctgatggctatcggctaatctctggtgtgtgggcacattgggaggtatttgagtaggaaaaagacaggctcagactggcagagcctgctgagccctagacaaaggccgctcagtctgccctcgggttctgatgaataaacacactgcaggttttcctagagccgttccatactgggcagcagcacagcgagtggctcagcaggcaggcccctggcgagctgcccagaactgccgctggagacagcaagtccaggatctgcatggctaatgagtgagttgtgggggtggtctcaacacagcaggggccttcttgtccccagtgcccagtgttgtccttgccaccctgcctccacacctggttcacctggactaagaatcaccacccagacgcgaaggtgcttacccatccttggctgaggagggcgtaagcagaaaccacagcctgcttcatgcctgcggaagctggtgccaggccatatccatcgggacaaaagacagtcattggtgctgtggacatccagggggggacactccatccagtgcatgtggatggtggcagcagcctcagcatggggagtgtggcagtgttgggttgtgggtgcgccaattctttgtccttgccctctgcatgcgcatgctgtttactgcagtagtgtgtgacacagcaaaaggctggaaccagcctgtctgtgcatcagcagggtgcttggcacagcttgagagcacccacccaattatgcagggagcactaaggttataaatcaatgaggacagtctctgggtattgataggcctgactttgaaccttgtcagtattttatatataaaaaaatttaaaccagcaagaaagaaaagtcccccaaacaaagtaaaacaaacatgttccagttatctgttgccacttaacaaatcaccccaaaacttcatggctgaaaacaacaatgatcatgttaataactcatggctctggattgactgggctcagttgattggttttcagttgcaggcagatggggtcatctctaagtttgtgcctgggtcccacactagggctgcttgggcaccttttacctctgtgagacctgtgtgtgatctctccagcttggcggcttcacggtggctgatttctgttgcaacagcctatagctccaaaggtgcgagtcctgagagagagagagacaggagctatatggccttttaggatctaacctcggaggtcatgtcctgacttccactgtcctccctagcggaggccgtcacaaggcccacccacgttcatgcggagggggaggcatagacactaccctgtggtgggcattactgggttccagaagggatgggaaatactactgcagctatttcagaaagtaccatctggcacaaaaacataaatcaaattggcaacctcaagaaaagaacttcaactttctgagaattagccattttttgctacacatctttaatggggtatcttctaaggtcaaagaaagtacagaaaagtcaattcaatagttttgttgttagtaataacattggcattataattttcaaaccctgtatgccaacacaaataagatcactgacacccaggctggagtgcagggaagcaatcttagctcactgcaacctccgcctcccgggttcaagctattcttctgcctcagcctcccaagtagttgggatcacagacacgcgccaccatgcccagctaatttttgtatttttagtagagatggggtttc

SEQ ID NO: 11996 - DNA, 37116 bp, Human
cctgagtagctgagactacaggcgtgtgccaccacgcccagctaatttttgtatttttagcagaggtggggttttaccatgttggccagactggtctcgaacttctggccacaagtgatccgcctgcctcggcctcccaaggtgctgggattacaggcgtgagcccccgcacccagcctcctatgtaacattataaatttattgtcattacttgtaagcctgccctttattttaaaatacaagatatgacaagatcagaaaccagtcttgtttctccatttctttctctagaaataattctttaggaattcaaatccatagtaacaaaaacaaaggaaaaaaaaacatgcttttttttatataatgaacaaaggttaagaaatgactccaggtctcttatttattttgttgatatttgtgttggttagttaagaagatgatttgctcgattatttcaacatttatttattcaacaaactgtggactttggagatgaacagctgaagctagaatcctgactatcccttaatagctgtgtaactttgggcaagttatttaacctccctatacctctgtttcctaatctgtaaaatgaagataatattagtatctaactcatagggttgttgggagggttaactaagcaaatatacaaaaagctgagaatagtccctggtatatagtaagtgctcaataaattatggatgggaggatcctgacccacatggagtttacagtcttggcagtatggatcgggcaggtagaaaaagacaccaaattacacagccaacagcatctttataattgtttttaatataggaaaagtatagggtgctaaagatcaatttgtggctttcttttccaatgaactgctaaagttccacttttatgcccaagattcttatcatacttttgtaagatcaagaacaacatgtgaagtttccactattatatatccacccattatatgtagttgtactggaaaaaattaaaagctgataacttttaatttgaagatgatggtatatactatgtatatatattaaggtgcttaaagataaatcctagcacctgaggaggtgtagaaatcattcaaactctttgattacaatgacaaactagtcagtaacttactaaatattgtactatatattactaagtattttactcttcaacatagctttttaaagacacaaagcttttcaaaattcctgcttacctgggggtaaaatttggggaagcagatttctccagtgtttaaagaagccaatttggcagtgtaccagagttgaatacatttttcccatcacaagggaatacatttttcccatctaagttaagttgtttttctctggtaaaggaggaaatcaacacccatctgtacggagataaacgtttcagagtgtttttatattaaataattagtatactagtctagtaagtgataatccacgaataagttaagaagagctaagaaagaaaaagaaaagcatccatccatcctttggttgcaaataatacttacattagcgtatggcaaaatttaattttgtacagagtaatttaacccaggattgctgactttttaagagctgagaaagcatagctatggagcgcaaggccccacccagcagggtctaagtattccgtctgcaaaactggcaggccaccaacggccgcgtcccagggcggcctgaaggatgctgataaccgggagccccgccctgggttcggctatcccgggcaccccgggccggcggggcgaggctctccaattgctgggccagagcgggacccttcctttccgcaccctcctgggtatctccggtcttcaggcctccttcggagagccctgctccgagcccattgggcttccaatcttggcctgcctagcgccgagcagccaatcagaaggcagtcctcccgagggggcgggacgagggggtggtgctgattggctgagcctgaagtcgccacggactcggggcaacaggcagatttgcctgctgagggtggagacccacgagccgaggcctcctgcagtgttctgcacagcaaaccgcacgctatggctgacagccgggatcccgccagcgaccagatgcagcactggaaggagcagcgggccgcgcaggtacactctgtgctccccgagcgggcccgaaggtccgtttagaaagcgggggcgtcggcaagtaaaggcccggcttcccccggggcggcgcttggagggactgtaccgcggctcactgggcaggggggatccccttcggtgcagacggacttttacattcgccgaagcaggggaggggggtccgggtagtggggcgcgggactgcaggctttgttgtccgcgacaggctcgggtggttgcttcagaattttgcacttttgccaactgggacagaggtcgcagcttgaggacagattgagggctcatggggaaagaggcagagagctgcagctgcaaggaagtcagtgaggggagaagtggaaccaggctctaatggtgcccttcttgaaatactgtttacacgctttcatagttgtggggtcccagcagggcagggattgtgttttacaatcttgaggtctccagcaccagtcacagtgactggtacgtactatgcacattattaaacgactaaataaaagaacttttacattcattgtctcatttgcacttcaaaatgtcaagcctagcattttagagctggggggtgacattagggattgattaatgcgtttattctattctttgagcacctgtaggtgctaggcactgttcggggcaaggtgtacaaattccagtgcggcaagaacaacacccttgagaagctgagagtctagtctgggagacgagacacataaacagatgattacactccagcgtggtgagggctctaatagaggttatctgtagaatgtagagggagtgaccaggtgggccggacaaagcaggtgacatttgaacaggaatttttttaaatgagtaggattttaacttggtggtgggggaggcattcctggcctgtgcccacggctgcagagtctcagagggcatctatgaggaggttggattagatgagaccacatctggtctgagtctactgttggcagattggcccagggagtctaaaggtcttgccctgttccctggctgctggttaatggtagacagaggactgcagccctgttttccctattctgcctagtgctcttgctcaaaactcaggttcgtgaactggggtattaatgctaagtgctcatggattgctttaatggttccctgtttgggaaaaggctgccattctcctccaagggcctggaaaatctcccctcttggccctgttctttgttatataccattaggttggttcatgagctcttaaagtaaaccagagagaggtagagtcttagtaaaggatgtgccactacttagtggcagagacaaggttagaattcagcttcttggacccaagactctttccttacccagtgggtgcaaatcctggttcacactgaagttttcatgaatactcggtgaattgagaaaagtgtggacaaagtagtgagatttttacaaaacaaaatattttctttttctttttcttttcttttctttttttttttttgagacggagtcttgctctgttgcccaggctggagtgcagtggtatgatctccactcactgcaaactccgcctcccggattcaagcaattctcctgcctcagcctcccgagtagctgggattacaggtgtccaccaccacacccagctaatttttgtatttttagtagagatggggtttcaccatgttggccaggctggactggaactcctgacctcaggagatctgcccgccttggcctcccaaagtaccgagattacaggtgtaatattttcatttttaaaggactcccctttattctgagactagctgccttcttccttgtttgggagaatcatgaactgttgaagtccctgctgttgatttaccttacatagttgcccatgtgagaaatggctgactccaaaacacatctatagttgggaggctcttaattgaaatacagccatcccctttgtccatgacatctcagggcactgtgtacatcgtcctgattggcagtcacattgatgtcttactgttcctcagttttagctgctcttagtaaaaaccgcttacttcttttaggcacttctccctccacccagggccctccaaaaggaattatgcatatgccttatagcctatataattttcaaacactttttttaaatgaaaaatttcaaatattcagaaaagttgaaaaaattttgcagtgtatatctatatatctgccatctagattctacaaggaacattttgccctgtgtcttttattacgttactccatctgtctgtccatcctttaattcattcaagttgtttcatgtattagcagtttgttcttttcattgctgagtaagattccattatttgaatataccaccatttggatatcctgttgctggacacctgggctatttaattttttttctattgtaagtaaagctgctgtggctgggcatgaaggcttatgcctataaccctaccacttttggaggctgaggtgggaggatagtttgagctcaggagttgagaccagcctaagcaacatggtgaaaacccatctctacaacaaataaaagaagtagccagacatggtgacacatgcctgtagtcccagctactcgggaagttgagttgggaggattgcttgagcttggggtgtggaggctgcagtgagccatgattacatgactgcactctagcctgggtgacagagggagaccctgtcttaaaaattaaaaataaataaagctgctataaaaattcttacataagtctttttgtgcacaggtggttttatttctcttaggaaatacctaggagtagatttattgggtcataaggtaagtgaatgtgttatgagaaactgctgagcctttttccaaagtggttgtaccattttatacttcatcagcagtgtatgggagttccagttgctccacatcctaccaacttttggtgttgtcagtcttttacatttagttgttgggtgtgcagtggtatctcattatggttttaatttgctttgctctgatgactaatgatgcaaagcatctttttacatgcttattgaccattggtatatattcctttgaagtatatgttcaaattttctgtctttttaaaaattgaattgcttttaaattattaattcatagcccatattttaagttcaatcatgtggaatcatgtgtaggctaagtgttataataataaatctcaacatgtatcatggtataaacatattagaaatttatggccgggtgcagtgactcacacctataatccagcactttgggaggctgaggtgggcggatcacctgaggtcaggagttcaaaactagcctgaccaatatggagaaaccctgtctctactaaaaatacaaaattagctgggcgtggtggcacatgcctgtaatcccagctgcttgggaggctgaggcaggataatcacttgaaccctggaggcggaggttgcagtaagccgagatcctgccattgcactccagcctgggcaacaagagtgaaactccatctcaaaaagaaaaaaaaagaaatgtattcctttcctacatgaatggcccaaagtggtttgaggttgaaggaggtgggtgggtgctctgcttcccacagttattgagggcaccaggctgaaggaagctcccccttggtcaaacatggcttttatgggcgtcactgtccagcacagaaggctcaagagcgtggagaagggtatatgagtgtgggaaggtttagggtccagggtcactgccacttacattctgttggctagaactctgttacaggccacacctggggtagtctaccccctgtccaggaagctgactctactatattatccaaagcgtacatttcatatttggtgaaaatctgtccagccattttcttgtgatgcggcaatggacatgcaacataatttctttttaaagaatatgtcatttttactttctgacattaagatattctgttagaaaattatgacagtaacagatggtattaaaaaaaaatctccccttgcttggtaaatgcttttatctaagtgggcagctttgtgctaatatgatgtcttccacttcccaattagttgtgatgctttactgatctaggagagctttacggtttgggactactataggcgaacactctgttgcctcctctctcaagaatcagagtgtcctattttggaaacacagtcaaccatgtgaaagcaatttattgggcgtatcttctgtggtcagatttggtttgctgacaggtgaattgggagttttgtaaactttaataagtgagcattgagtcagatgtgttcatgagtatgacctcgatccacttaaaaattcttatttctttttctctcttggcaggagggaggtggttgtgcaggtattcccagccactttgaagggaacttaaatgggaactttattgctcactgcttagaatgccatgggctcttcttttgagatacttacctttaacccatttcctttttttttttttaagtgcagcttgctgccagtgctcttttcttgggggtaaatgggaaatgttaataagtagcctctgatccctttaaaatgggagaatttgaacatttcaaaccttacctttttatacagttctcttattacctgggagagaggttaagtcttagactatccatttctgtcagtgagttgcctatgcattatagcctgtgagggtctatatttttttagggtaatcctggtaataactgcattgatgttacactgctaacatttgggatggagaaggggtgactgagtgacttaacccttggtccacatgtgctttcatttctcctgaaatatacctaggtatggaatcgctaagtcattatgtgcagtgggagagactatgggagatgggacagaaatttttaaggtttcatttcttttttttagcttttgcatggtgggtaggtctatgcaaacctacccccaaagtctgaggaagctgagaggccaaagaaagaggctgacaaatcaagtttctcagaaagaaatgtttagtagggacttaggaccagaaaccatgtctgtgtcttgcgtgttggcgagacaagatggtggatcccataccattacccctcagacccagggcttaataccatagggaagggcgattcagaagggaggtatggcatgactgaagtatgataatgtcaaggttgtttgacctcagggcaggatttatagtaaataggggctctttcacaaggaataatagataaactggaaatcttaaaactggagttaatcagaagtcagcatggtggatcagtatctaagacggaattgctttagcttccacagcagtcaatatctagaccacccttattattttcccacagaccaagaaatttgaaggtcaggacagtctttggtttcctgtacgtgggtgtatacgttgtaggcacttgaatctttgttgaataaatggagaatgttaggcagttatttgctagaaaacgctaggcacattctttatcacagaatgaaaagacgtcattatgactcctctgggactgatgggcaatttgcattaaccaatcttttaattaaaagtggaagaatatgtttaggttcttgaaacttctgtgagtgaagggaactactaagtggaaagtgtaatatgttgataaaatatttcaccagatgaagccaaccttactcctcccaggaaaacttcttcatttatgtattagctctggccaaaagaagcctataaaggcagcaaagtcaaaatagaattttactttaagtccctacttctaataattgtgctagtttttagccaagctaatttctgtggcagttttcataacaagtgtgtctaaaggtgtttgatcagaatttataaattaaaatatttctctcattttttggaggggcgatgcagggagagggatagactgttgctgcttcctcctgcttgttagaaaggctcttggccatatcatattggtccgtggtttagtttatttgcatgctgaatccacacacatttgttttatgtttgttagtatattgagcagtgtattagggatcaggtatatagatgtaaaaggagtacacagtctagagaggaaaaatagtgacaggctgggcgcggtggctcacgcctataatcccagcactttgggaggccaagatgggcggatttcttgaggtcaggagtttgagatcatcagcctggccaacatgatggaaccctgtctttactaaaaatacaaaaattagctgggtgtggtggtggtcgcctgtaatcccaactacttgggaggctgagacgggagaattgcttgaacccgggaggaggtggaggttacagtgagctgagaccatgccactgcactccagcctgggcaatagagcgagactccatctcaaaaaaaaaaaaaaaaaaaaaaaaaaagaaaaacagtgacataaacaggcaattacaatattttgttatatggggcacaagaagatgcccttggccctgcttcatgagtggtgtggggcagggtagagagagcagttcaggagaggtacgtatggatgtcatgggagctagcagccaggaagatgtaaacatgttaacaaggacctctccagagagaggtcttaaaattgtccagccatagagaagcttttctctctttaaaaatattctggctctaaagttattcattgagttaaaaacaataattgcaagttggaggaaatctctttgcctgtccttacgtgttacatgtaacaagtaaacctgtgccacaacactgacatctctgcaaagttacttaagttttctgagtttgtagtatcgcccattaaatgggattaataatattgatctctggattattgacaggcttaagtgagataacttgcgtggtccattttctagccccaccctctcatttcatctagtaaatcttcattgcattaattattttcatcttaaatacaccgcatcctgctcctcaccttctaatattaatactctgtctttcagtttagatcagttcctcttatccaatgttgcgctaaacatcccctgaagttgggggatcttttcctttctagtttttgctccctggcttcccttttctgttgctgactgttgaagctttcctgccccactggctttgaaggtaaattgtatatacatgagcttgtggggaaagctgttatataaatgaggacaattgatctaactgttagagtggggaaatggaagagattctgaagcctccatttgtaacttaaaaactcaggtttcatttcttaacaggattgatgttaaggaggggattccttcattgggcaggagggaggactgccataattccagcattcccactcttaatagtcagtgtcatcaggaaagaccacctcaagctttagtactttattcatttatccaactctgcacctgctgcctttgggtgtggtatttattcttgaccatatcaccctgacccggtaaccagaagggaacatgtgatgtgctctcatctctgccttaggggcagctccctccccacgttaagaatgctggcatgtaaataacactctcatctgtttagcgttccttttactgagcttcttggtatcttttctcatacttgtaccttttatgggatgtcccccccttttttttttttgagacggagtttcgctgctgttgcccaggctggagtgcaatggcacgatctcagctcaccgcaacctccgcctgctgggttcaagcgattctcctgcctcagcctcccgagtagctgggactacagtcacccctccactgcacctggtactaattttgtatttttagtagagacagggtttctccatgttggtcaggctggtctcgaactcctgatctcaggtgatccacctgctgcagcctcccgaagtgttgggattacaggtgtgagccaccgcgcccagcctggatgtccctttattttttaaaggcttccttaaataccttgtttgtatgttgaaaagagcatttaaagagtgaacagatttggtttgctctggctctctaattattttaactttgttatcacccaatagttctaggttagtggttttcaatcctagcttgaacaggagtcatttaaaaatagcccaggcctcacccagggcacttctatcagacatctctaggggggatggcccaggcatcaggaggctttaaaaagctcctcaggtgattttagtgcattgccaaggttgaaaaccaaggctttaggtttaaactaaaggtgaaattgctctttttctggttcattttctactttagaaagtagaaattttttttctggttcattttctactttaaattaaaaataaacctacagagggtaacacgtattagcacgtcacagagggtcacacgtattagcaacatatgtatcttcaaaagagtgatgtgactgggtggtaagtgttgattggacccttaaactgtgacagtttagaaggggctttgctagatgggtttagggacagagatggtagagtgagagagtgtggatggaggagtatgcatctgtcatgattactagaaaaataaaacttcaaatgctttgctccttctgctgcgaggtcatgttctcacagccagtgaagtgacagcatatatgtgttgaatgtgtggcttgcattttacatttagctcttttaattcatgtgttaaccttaggaggtacttattattctattttgcagatgaaaatggagactcataaataagtaacttaccagcagctacatagctggtaattggtagaactggaagttggacccaggctctagtgctggcactcatagtttctccctgctgccatgttggcctcttcctacttggatgaagatataactctagtggcaagggcatttactagtgtgtgagagggtcttgtttattagttttgcaaattgcacggtctcctttattcaatatcttttttcaaacagctcacagatcttttgtggttttgtaagtgcctactccccaccgtattgccttctagagaagaggcaggaatttattttaatgtacaggacagacatgcatggggagtaaaactacagactccactctaggtgtgtggaaatactaaaaatagtgcttttctctgtgtgtgaagttggtctgttgagttttgtcatagacagcgttgagttcctctcccaggtggaggtggcgtagctttgcgtcacttacgtgtctctcctgatttccagtgacccggggaagacactgcagaggcagttgtctgtggtcaaaagtattctctgaccatggaactagatgaagctatgagcttccaggatcatgtggggctagaagaatgccgctctaaccctagaggagggacagctgagtgtcttctgatgtaactgaaattggagaatcaggtggattaaaattaattatttattacagtaaaataacctatcccatttcagagacatttgctatctttaaaacattaatactataatccaccttaccagtaacagtttacttttagtgacagtgaaagccattgactttttttttttaattgaaaagagatgttgcaaatagctggtgtacatttcttgagatgcactaaacaaggtagcgcacttgaagatcgtggcagtaataaagcgtttgtaagttctgagtaaagtattgaccagcacagcttccctggagaccgtcttctcattgctggattggacatttcactgttaagcttgtaggacgcttttgggcacctctctgactgggagctttgcagaacccagtggctttctctggagcaggtgctgagcacattttcaggctccaaaatcatctttctgctcttcagagcaagtttcttagcagattagtgttgagatttgtcaagggtttctggggcatcactaaaagtttcaggcaatggcccatcctgtcagattttagtactttggacacaggaaattaaaaaagagggcagatggtataaacattgcaaagctatgtacccgtgacagtgtaaatgaaaggtttgattgtgctaactctcctgcactttctttctgtgttcctgtagaaagctgatgtcctgaccactggagctggtaacccagtaggagacaaacttaatgttattacagtagggccccgtgggccccttcttgttcaggatgtggttttcactgatgaaatggctcattttgaccgagagagaattcctgagagagttgtgcatgctaaaggagcaggtaagtgctgtgtttatttgctgtaaaaagattgtttcacagcacctgggtcaagtgttatttcccaaaggattggaagacctttaacacaagtgtcaaatctccatttgtgggagaaaggaaaaacatccagcagtagggaaattagtaaataaatgatggttatttcctcaggttaaacattatatataaaatagtttcttttaaaaatagcagtcttccatttctcccatcattgaaggaataaaaatacaataagtcctcacttaacatcaataggttcttggaaactttgactttaaacgacatgtaatgaaaccaattttatgataggctaattgacgtaagcaagagttaagttcctatggcatatttctgattgataaaacatcatcaaacttctaaatagagactcaaaatacctcttatattaaacattgaaataaatgtgagccatacatacctttaagaaagattagtaaaataagatagttatttactagcttattccagttcaaggtggtgggaggccagagcctgtcctggcaggttggggtacaaggcaagagccagccctggacaggatgctgtccattgcagggtggactcacactgggaccattcagacatgccagttcacctaacacgcacatctttgggatgtggggggaagctggagtaccaggagaaaacctatctagacatggggagaacatgcagactccacacagatggtggcctcagctaggaatagatttttttctcatcaacgttataatgaaacaacgttgaacaaaacaatgttgtttgaggacctgctgtacagaaatacagacatagacacatgcactgcaattgcaactaagtttaaatgatgtacttactgggtaattactggaatgagctgcaaaatttggggtagttatgttagggtggtgggtttgtgatgatttttcctttccttttttccaacaatttctgtaaaactttctttatcgctgttatatcagacacaaaagatgggggtggtatttgaaagaaagtgaaaaactcagttggaaaaagagctccacagaaaggaagtttttctcttagcttgctgacttggacttccagttaggacttctgcatttcttcatctcttcttcctggataaggtttctccccatcttctccagtggtttgtgtgtatttttccatcttgacttgtttagtttattgcttgctttgtatcatcgttgctaagtgttgaaaagattctttctcttatgttttcatctcctcttctctctgttcttcactttctctcataggtcctacctgtacttcaggcccctctgagaccctgtgtccttgggccaaccttgacgacttctagcctcactcacctccttctcttggctccagctatgtggcattcgacttagcactgaatgatagaatagggctttgcatttcaccctctttattttgtgtttgggcatttccccttcctccaacatactggaagctcccagaaggctggtgctaaccatcattttctcttgtcacccaggtgcctgttgaggacctgaatgtctgagtaatggtctcatggtaaggatttctgtgtctttctcgttaggggcctttggctactttgaggtcacacatgacattaccaaatactccaaggcaaaggtatttgagcatattggaaagaagactcccatcgcagttcggttctccactgttggtaagttggtttattggcgtgattggtatggcttaactcaacttcaccttttggggatgtttataacttaaagaaaaagttattagaaaataggaagcaagcacttctccaaattatgtcaaggttttacagtagaagacatatttggagacacataggaagttacttgtatttctgtttgttgaggtcttaggaaatcacacttacacagaggctacctctgcaattctgtgacatttggaaagagctttcctaaaagtggttgcctctaacagaagaatagagtggaaatcttatttaataactatgcctacagctgacctttattgagaattaattctgtgccaactgtggttaggtgctttacagatataatctctgatttgtagatctactttgcagagtgggattctttttatttttgagaggctaagtgatgtttctcacgttacagagatagtattagatctatcatactatatttcaacatacctagtgcttcactagttccgtttctgtgtcagtctctgcattttaaaaatactgtggaatgtaaaaataaatgaaattaagaactaagaaccaatattttaactcattttcttaatgttaacctcatcattttgacaactcacttattctgtttgtcactactttaagcctcataattattttcttcccttattttaattaaaagttcaattacctgtttgaacaaagttatcttattatggtaaatgaatgacattgtcagctgttattacatgtgttctcttattgctctcaattaattattttgtttgatttgtggactgaattagctggtgggtagaaataataacccgggcacttaaatacctaatttagttcttggaagtggattagaaaggatggatccaggtgcttctttatgtctccaggcttcttggatgcaaagtgctgtggcttatgcttcctgtttccatttgaatattgtagctggagaatcgggttcagctgacacagttcgggaccctcgtgggtttgcagtgaaattttacacagaagatggtaactgggatctcgttggaaataacacccccattttcttcatcagggatcccatattggtaggtaatagagtattttgcactcaacaaatgtttgttgacttaaattgatttcaaataggttggcatttgaggagaagccgtgggaaaggcagaaagaaaagaatgcgagttgtctggactacttttttcaacacatttttctgtatttaataagataaagtaagaacagttaccattggtcttagatttgtcattttaagacagattgacttaatgggaagtgagtttagttttccttgcagagcatcgaagattagtaaaaagagggactttactttggaaacaagcagagggtgtctctacatgctctgagtcagcaggagggggtgtgtgtgcgtgcgcgcatgcgggagggtgggtatattttttccgtgaagaaatactataaatcccagcactttgggaggccaaggcaggcagatcactggagtccatgagttcgagaccagcctgggcaacatggcaaaaccatatctctgcaaaaaaatacaaaaattagccaagtgtggtggctcatgcctatagtcccagctacttgggaggctgaggtgggagatttgcttgagcccaggaggtcaaagctgcagtgagctgtgatcatgccattgcaatcagcctgggtgacagagtgagaccctgtcttaaaaaaaaaaaaaaagaaaagactatagttttgagtatatttgaaatactttagggtatcttagatgctagttgtctatgctgagtaaatttcatattatggtttggcagtttaaaattctaggattgtatttagaattataatccataaacctagtaataggcatatataatgaaagacaccataattcctgtaaacttagtttttggatttttttctctcttttttctatttagtttccatcttttatccacagccaaaagagaaatcctcagacacatctgaaggatccggacatggtctgggacttctggagcctacgtcctgagtctctgcatcaggtatgaacccttttttgccattgtattatatcacctgggatgcagtgtttaattatgcctcttcataaagtgtctctccagttttggctattttattggaatcagcttcctcagatttcttgatcgtgaagagttttgtagtaactggctttactaatcatcccccattcatcggccttaaatgatgatgatgatgatgatagatagctagcaacattgtcagttgatatttagcagtagtaaggatgaaagtctgtagtgtaaggtaaagctctgtattaaggaagtggggggaaagtagtaccaaacaaatttgctatgcaaataaattttgaataacaaattaggccagttttcaggttgttttggctttccttcatagaattttgagtcatagtattagtgatttgcatatcattttgatttaaaatttttctgtttgttattttctacaagtgaaataataatggtaacccttcccatgggaaattggctagtatgttttatgtcattaagggactttctggaaactaaggaatatcttaaaaatcaaggatgttttgatttaaatgaaaacattttaggctttatatttctgttctttaggtttctttcttgttcagtgatcgggggattccagatggacatcgccacatgaatggatatggatcacatactttcaagctggttaatgcaaatggggaggcagtttattgcaaattccattataaggtatgtgttacctttggggcagagggtacaaggctcctaccgcatacctccttatttttcctgaaggattgagcaaagattaaggcttctcccacttttccctcacctccatccccaaagttgggaagtattgatctcattgatcagtactgattttgttggctaccatctgaggaccttggagcgtatcccaatctcattatcacttccaacatccaatagtgtctttccaatatcatttcttttaactttttaagtcatccatctatttacttagcatttattgaggttttattatgaacaaggcatataagtaaaatcaattacaaatgtcagaaaacaaaattatactgtttttaaaaatttgcattcatatagccagatcaaatcagttacatctggggagggttttgagaatgttttaatcaactgaaatattataaagggccctcttttggtataagcatggcatttgttacaatgagcaatattgccagtgaaccctggcatgttagtgatattcccagagaactcccaagggctagtcagaaacaagcctgagaacctctgtttccaaatactgctgctaagataagcagaaagaagtgggctcgtgaccagtactggataatctctctcttagtgacatccaaaagccctattttcttctatcctgctttcttctttatctgaacaatttaatgtaggtatatcaaacaggaaaactatcacctctttttatattcataacttggatctataatatttgacaaggaaaaattttatgaaacagttgacccattggcttgtaattgccaaaagggtcaatgtagtattacttagaataagactaagtggttgtatctaggacagccagtctagttggtagccttggagttatgccagcctgaactcaaatttctactctcctagataattgtggccttgggcatagtattaaaagttctttgagctccagttcttttcactgtgaagttggcataatattaccagctatacaagtcctggaaagattggattgcttgtgggtcttttatcctagggccctaaggtagcctgagatctacatggattcatcagtctggattattctgacctaagattattcttttctaaacctaaaggattcagttaaaatcagaaaggtattgcagtgttattgtactacttaatatattagctctttgggcgatctgtacatggtgaccttcattgttttaatcctgaaggtggctttacttcttgttcagtagtaagagttcaaaccttttcactgatgagacagttgggatttctgtggtagaaatagaccagcgttcagagttgatttttgctaaggaaatctttctgcggcacttggcttgttgggaggtctttgagaataagatcacatggtcagtccatcaaagaacagtatgatatgataacaggagcacttatgaagtgacacagcttctctgggttttaatgtcttgcttggaaagtcagaatattaattttgcctgctcatagtcagagaactagttccaggtggctgtactgaagttcttttcaactctatgagctatgattctatgatttattaaaaaaaaaaaaaaaaggaataggacaggggtgaagggatactggccgagcacagtctcagtaattgatttgagctgtcatgaaatggaattaaaacattacttcatgataaaaggcaagtagtcctttaattttattaatcttttgcctacttttaagtatattttgatttttctgatttggaaagtaacatgagtgtaaaaattcaaataatagaatacataaagggaaagataggactgattttaaatatgaaatgtgtagatgggattcccttgacatttaaaagtattgggataatcaagtagaatttcttgttgataaattcattagtatcagatttgaacaatagaagtattgttgtaaagaaagttcattctttgggcagtgttactcataatccttcaatgaattactgatgaaattttgataactttgacaataagtttccattggagcttctttctttcattttgtagactgaccagggcatcaaaaacctttctgttgaagatgcggcgagactttcccaggaagatcctgactatggcatccgggatctttttaacgccattgccacaggaaagtacccctcctggactttttacatccaggtcatgacatttaatcaggcagaaacttttccatttaatccattcgatctcaccaaggtgagtcagtaaacaactatattgttttcttttttaagtctcttcttacctaattagaaaaaaaatctagtcaaacaattataataatggggaagtcatatacaaaatacagagggtaccacttcagagtgtcctaagctgtgaatgagtgcttaccagcatcttacttccacgttcctgtttgtcatttcattgagtatgtgtatgtggcttcatatattgttattaacagggaacagattatgaaaagctgatgtactttttcctggggaaactgtcagtatttaccacttactattgtgaaagatttaactaaggcactcatcttaaattcttatgttttattggatttaaaaattattttcattggcttgattgtatttgaaatctggtatttttgtgggtagctttgatttccttcagttgattgcctggtaattgtgaatatgacatcattttcaggtttggcctcacaaggactaccctctcatcccagttggtaaactggtcttaaaccggaatccagttaattactttgctgaggttgaacagatagccttcgacccaagcaacatgccacctggcattgaggccagtcctgacaaaatgcttcaggtgagcctggtggattgagatgttctgaggcaggtgtccatgtgagcatgcacacacaaaatatgcagcttggcatgatctttatgtgaggaattaacaagaacattacttaaactttaatctgggtgcttggttaccttgtgggattcactgaggtgaactattcttcaatgagcattccttgagtaaaccaagtataaacaaaagtccatggtaagatccctacatatgtgaagacaagaatacttactctcttaattaaaaaaaaaagacataatagaaataccttaagtattgatagagtgaagcatggtttgttctgtctgtagctgaagtatggttaattaattataataccttggtaagcctaactttattttcttgttcttttttttttttttttttttttttttgtgacagagtcttgctctgtcgcccaggctggagtgcagtggcatgatctcggctcactgcaacctccgcctcccaggttcaagcgatcctcctgcctcagcctcttgattagctacaggcgcccgccaccatgcccagctaatttttgtatttttagtagagacggggtttcaccctgttggccaggctggtctcaaactcctgacctcaagtgatctgcctgcctccgcctcccaaagtgctggattataggcgtgagccaccgtggctggcctcattttctgtttcatggtgatgcttgaatttttccatttgtaaaaagagatctagggatgatctttatgaactacatgtatgctgccagtgataaaagcagtggattaaccattcaccttgctaatgttaagccatcagtatgttttacatcactttttaatatctctttcaagagtaccaagagtgaaaaattgtactttggatcagaatcagtaagaaaataattggcttaataattactgtataaatcaatcttttgtggttttagactgtgaccttgaaacaaaggttaaagattgtaccctaaatcagaccacagcgactgaaggttacttcttatgtaagtatctgattccagttcaggtttcagtctgcatggaggacaagctaagattccgtttttaaaaaataacttttttgcttatgacattggggaacatctgaggcttttatagaaagtaagtttttcattagtttttagtccaattcaactgttacaaattgagtacctgtctgttgtgtatggtggactgtcttgggtgccataatgtaaggcagaatgccatggtgatccagaaagcaaaattttgtctgataggaggtcagccacgaagtttcatgaacgaggtagcatttgagattgttttgaagaatagataggattttgatttttagtaggtaaaatgcggcaggagaaggacatgagtataggcacaaaggtgggacatgttaggtgtgttgaaactataaacagtcactctctcctgaatgagaagaatagagtttgggtaggttcattgagtatatgtcagaggggaccttaaatgcttgagtaggagtgaaaagctttcttcagttttgagaagtgtggtctgggatatattgagtagaatcactcctcttggtgataaatagaaaaagcgacaactagggattgggaatagcaaaaggaaagtcaggcagttctcagaggaaaagcagaagtttgcattgaaaccagggagtagaggaagccaaaacaaggtaatcctgggccctaaaactccctacctggtggctgaactgtgagaggatgaggctaatgggatttgccaaggcatgaaattgtcatgggcagagcagaggctgcataaccctggttacccagggagggaacggattgaggaatacaaggttacctaaactcttttcacaagaatccaagtcaccatgggtctctggaaccacagtgggaccgtgaggcagtcagcagcactgagtcatataatttgaagaacaatgaagatttgaatggagaactaggcccccgggaaaaggactgcaaagcaaatacgtattctctacattcctaagaaagcaaatgtctaaggcagctattcaaacagtggggaagagagttctgaaaaaggatgacaagtagaaagtaatataatttctgttagtattaattttagttctggcaaatatatctattttaaattcagtgtactctttataggttgttttttttttaaatgagttttagaaactgttcgaaagagctttcataagtttgtcgagttattgtttctagcctagctttcccccatccttcttaggtcatttagctatcagttccaataccatggagcctgtgaggagccatacagttggggaaggactgttgtactcatttagccatttggtgaccattaaggaatgatttgagattttttgagtaggtgagtagggaatatgtagattgtcttgttggacaggaagtggaaagccagttaggggggctttggggttattcctgctgagagctcatgagtattgtagcctaggcagtggcggttgatatattaatgggcagtgtttacaggtgccttttaacaaggtcatgttattaagttttataactttatccaaagtggtgagccacaccatggtgaaatggacaaataatataatacaagtcatagagagactgtcctgtcccctgagtacctgaggacacaggtgcagcctttcttgctctcattctctgcattttgccaagagttggagaagttgggccggttgcttgggtgggaaaggctttcccactcacgcaggtccagcaagggagttcaggcacagggccttggggaaggcctagattcaagctggtgtcagggtatggcctcactgtgcccatttcccaacctttgttggtctccacccataggtggggtaaggttgcctgataaacacagggtgacacaaaatcagaattaggtgatagaggctacatccaggagctgcccatggcaggattgtatctcctatcctgttgatggagtcaagagcacaactttttgagccaaaggagacaaccagcttccaacctatagctgagttttggtcatggccgcatggctagtcatctaaatatgaccttaggctatttgaaatgatgataagagggagtcattcagccaaaagcaaaatattgacagaacactgggactggattaagtctgttggtatcagtgatttggaacaaagttattgcttaagttgccctattcaatttggtttttattttgcctcatagaattagggatataaaaatacttttaaggttcaaggccaatgataaattcaatggaagaaaaattgctcatagaaaaggagtatgaataatgagaatagttcaataattagatattaagattaatgcagaatttatcataaagcttttgtttgagcattaactgaaagaaatttcaagatgcttgccatctttgccttgattaacatggaacataatttaatcttagattgattacctttggcattgtagggctttcattttgaaccacagattttttgttattgttgtttatatctagaaagtctcagagctcaaagtgtttctgagataattcagaaggcagcatgggagtgggcggtactttttttttttttttttttttttttctgatcttgctttgttgcccaggctggattgcagtgacacgattgcagctcactgctgcctcaatcccctgggccaagcagtcctcccacttcagcctgttggagtagctgggactacaggcacatgccaccatgctcggctaatgttttaatttttttttttgtagagacaggtctcgctgtgttgcccaggctggtctcaaactcctgggcccaagcgatcctctcaccttggccttccagagtgctgggattataataggcatgggccactgtgcccagttggaagtgcttatttgaagaatttcccatgctgttggttttgtagaaatgtgttgctttttgtaaagagcaaatgattggttccttccctggagtgggggaatgaggaggaatagaattaattcaatatttcagttagttaacgttctagcacatttattttataatgcaatacttccttgggaataggaagtaatactgtataagacaagacactaacttgttatgcagaaggaaaaaaaaaagatattattaccaaaaacagatgtgaagatttatggttggccagagggcctgggaaattcagaactgttcagttagggagaactcgtttcataagagtagaggcttcactcttaagtagcgggaaaggcagaattttgtggtaaccatgtacagagtgctttgtacttcaaatttcagaatgaagtttacagcccattcctatgttatatgttactgcccctagtcagtgtctattgtatttattactgcagggccgcctttttgcctatcctgacactcaccgccatcgcctgggacccaattatcttcatatacctgtgaactgtccctaccgtgctcgagtggccaactaccagcgtgacggcccgatgtgcatgcaggacaatcagggtaggcctaaagacgttgggctccccctgcgtgggcagagggcacgtggagcagatgggcgggaggccaggccagtggctctcaagctggccccgcaggacctcctgcttggtaaaggtgctccccaggtgctgctaactgggcgcttttttgcccagcagtgaagatttaggctgcctgaggactctccatgctttttatctattttatatattttattgagcatttccacctcagatgttacttgtatccagtagttaaaagcagggagaaagatctttcacactggctagagtacagtaacatccagcttgggagttaggttttgaagacacttcaccaaaatggacaattccttaactcactgtgaaatcaccaagacttagacccttggaagtgcgaaagccaagagttggagtcttctgtttctctttgcagttctgctgtggccctggaggagcaggtctagctagaatttggaggggagctagaattagcagggaaggctggggagaagagagtaggggaggcagagcaagtcaaaggattcccctcccttcattttttcctaagtgaataaagttaggtgaatcaacttaccactttttgttttttggaactcatttatcaaacttaggatctttttcttttaactactttttttttggtgtcgtatacaaacagcctctggttctaattactttttctaataagtcaagcagaatgcttgattaaagttttttccttttactattccacagtttaatatagatcttagttattttcttttcccatttaggacacgtgttttagtaatatagactgcatgcattgatccctttagaaattttactgatgatttatatttatagccacagatgtctatattcaaacaaagtttatttttctatgataaaaataatacaagtgtcctaaagaaaatttggaatatataggaaaaagaagaaaaaagaaaaattcccatatagtcccaacacccaaaggtcatagctattacattttgctatatttatttatctatttatttattttttagacagagtctcactctgttgcccaggctggagtgcagtgcatgatcttggctcactgcagcctctgcctctgggttcaagagattctcatgcctcagcctcccgagtagctggaagtataggagtgtgccaccacgccagctaatttttgtatttttagtagagacagggtttcattggccaggctggtcctgaactcttgacctcaggtgacccacccactttggccccccaaagtgctgagattacaggcatgagccaccgcgcctggcttgattgtaaaagtagagcatttgggctgtgaccctgaagctcagtgaaagagcttaattgttcctgtggtcagtgctttaaagacaactaccactttgagtaaaggtcagggctcatttggaagtaggattttaaaaattaactaggcacatttcaaagagctagttcttaatgaagaaaacactgtgatggctggtttttggagcattttgcttttcatgtagatgtgactgatctgttgaatttgttgagtgaataattgggctctataatagtatggtgttcttccttcccctacacacacacttggtgtcttgatgaatgtcatacataggcacctcttgattatccactgtggataatctattacggcagtgagctggctaaaattccaaccccagattggtttgctcaaaccacttaatatgtttctgggccactcctgtttaggcagtgtgtgctcgggtaatgaaagcttctgctaatgtcagccaaagcatagttgagaaaataaatatgctaaaacgaaaaaaaagccttataatttatttcaaaagtcatagaaaatattttgattgtatttgtcactgtttcttataagtccagataagtaagtgctgatatacaattaccacattttaaaaaattctttgtttattggtctgtggagggtatgaaagtgaagctacaatggaacaaagtcatcattgtcagtaaaggagagataccctgagaatcctaaaaacactttacggaatagcaaagtagagttctgtaatggaaatactgtatatgctgggctggaggagacaaaaaacccagagttccaaccccatatctaccactggctaccgtgtgaccttgcagcagtcaggtcccatcacagagctccatgcttgtgtctgtagattcaaggagcagaaccagaactttcagatttccctcaagaattttgtgatgcagtgtttgaattgagcccaagtccaaatgacacaatttttcaagtcaattttgaaatgtgtctttgagcctcatccctatatggtggccaaatcaagcctgtataaacttctacatgtgctgtacccctcagaagacttgatagatgagaccctttgaagtgtcaaaagggactttgagattcattcataaagtgcggcagcctgtgcaagcatttagcagatggcagcgttccctaagaatcttcatactacctgtagctaaatgcgggaaattaaaaataatatgtgtgcgttgtgtttatatctgtgtatgtgtacgtgtgtatttgattaccacttgaatttatttctcatcacagtgattatttgcagacttacttgacttttcttattcctaagtgcatctgggtggttttgttttgaaggtggtgctccaaattactaccccaacagctttggtgctccggaacaacagccttctgccctggagcacagcatccaatattctggagaagtgcggagattcaacactgccaatgatgataacgttactcaggtaatgacttctctttatctgctatggaagtcacctgctaattctccttgtcaatgcctgcataatccccctccctgcaaatgccccaactgtctgatgtatcttaaattgaattcaaggaagactcatctgtaatagtaaattgggccccttactgggtggagttgaagggttatattactctggtcttttgcctcaaagcatgcagactccgtctcagtttcttcaaactttattgaagggatatggggagggggcattggggaaacagttatctcatgggaatttaagaaatgagcatgtacagcttacgtggagacaaatctaagaatctgggcaggacagtccaggttcaaggactagaactagagatccaaaatagctccaggagcctcggccacaagagtgtgggcgtttccactgcagggctcgtccttcacgtggcttattctccatctgtctgcttctgcttgccaatgctaattgattatttttaccacagcttcctgttttctcctatctgcgtcagagcttctgttttatcatggttgtggctcttccacaacaatggaaaactctcctttatggcgtctttctccattattactttttttttttggaccaccttttactccttctctcaacatgtctatctctagattctagagagatggaatcctattgacttggctaatcttttcaccccaggttgcaccattggccttggtcaggctctagttaaccgccccagggcaaatgctcatcctctttccagttgcctatggctgccctaagagctgtttcagcacatgctatgaaggaggcccttggacttggaagggctgtaggtgggcagctgcctccttaatgtgtccagtgcaacttataccacacacaataaaataataaagttaaaggtatagttgttctagagctctgtttgagcagttagtgttaaacttagtatttaaattagattagaacctatttctagtttctcagtttgtgaatgtgggttccaagtaaaaaatacttatacatgaattaattcgctgtgaggatatctttgcttgaaaagcatttacgtatatacatatatacgtatatataaaaaagaaattacattattgtgggatataaaccatttttagatgagcttaaaacatttcctgcataccttttatgtaactgcattatttttggtgatgcagatgacaccaagtatattacagtacattccctgcctctcaaagaattttgcctatgtgaggtcaatacaggtattaaaccagctcatacaacccctgcaaaaattaatgaggctattgcttacacatgaaaatttattatgtgctcattcttattgagagaatttcttatcactatataggatatagtgtggtttttaagtaatcacaatactattgttatagattcatagcataattctgtgatgatgtatcacatgggaaatacataagaaggtccagatttattctcttaaaaatgattcacttgggcttgcatctgtctatggcagactagcttgtatcttacttaccgtttcatggagaacattgaaaaggtaggtaaaatacataaagcacttgtttgaaggctttggagagctaacaaagcaacaaggatttaagggaccaagatcaaagatggaaaagaagtgcaggaaaaaaaagtgcagtgaagtaagcttgacatttggtttcctttcctcttaaggtatttgttaatttgtaagcactggtccagaagctgagtggtgtttacagcagtctcatgagtctgaagggacaaaaattggaattcaaggtctgctaagaagcagagcctctagttatactcaaggctttcagttgaaatccttaaagggccatgcctaggaataagggcaaacatgaaataaacttgctttcacaatacaggaaacataactttgcctctgctcagtctcagattggattaaggtgatctctttctacgccatctgtcagaagcaaacaaaattttctttggtggaaaatagaaactcaaatgattctagacctttttatatggaaatgttcagcattcaacaataaatgaccaggcacctaacacattaagaccttatgactgaaaatcaagagggagaaaaaaccccctacaaactgacagtagaaacaaacctaatggaggcttaaataatggaactgtcagatacaggttttaaaatgactgattaataggtttgagaaaatagatgggctgggcgcggtggctcacgcctgtaatcccagcactttgggaggctgaggtgggcggatcacgaggtcaggagatcaagaccatcctggctaacacggtgaaaccccgtctctactaaaaatacaaaaaaaaaattagccgggcgtggtggcgggcgcctgtagtcccagctactcaggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagaaaatagatgactgcttgaagaatttagtaagagaactttaagctatagaaaaagagttgaatggacataactagaaaatgtaacaactgaaattagaatttaatagatggcttttaaaggaggttaacatggctgaagagaagattagtgaattggaagatagaacaatagatgttatcaagactacttcatctgatgagtcatagtgaaaaattagaatacatacaaggaaatccaatgagaaattacacatgcaataatagatggaagaatcatagacatgataattggaaagaggctttaaaataaacatacatatttaaagagatgcaaaaaaggaatattattaagacaataggatatgaggagaaaaacaggtagatttgaaaaataaccaaataatattttctagaaacaaaaattacaatctgtgaaataaaaagtcaacagatatagtgacccagtcgatgttttcacgcaatatgtcaaatacagctgaagagagaattagtgaattggagataggtctgaggaaatccccaggatatagtactttgattagattgtgttaatcgaaaatgtctgattaactttggtatcaggtttaaactttactcaaaaatttaaaaacataattatagcctgatatttgatgacttatggaaatgatgcatctcttaatattttatgaagttgatactttggataattggatattattggacttcataaacattaatagaacagcacgtagaacagagtctcgcacattatagatactcaatatttgttgaatgagtggaatgaatgaatgaaatgtaagaataaaatcatagctacaaccttttgatttcagaatggggcagaggctgctcggattcacatatctgatactaagctcctatttttcattttaatttatggatatttattttagaggtcaacccaataatctagcaaaatatcactattaatatgtcttgcttaagaaatattggcttctgaataactacagatacacatgtataaatgaggtagttttttagatgtctatatatagatataattatctatatatcaaattatatctctagctaaattagttaattttcctccatggttctgggagaattgaacaaaggtattgtgctaagtttacattcaaaggcagcttgcacattttagacttgtcagtattaagaatgtggtgaggttttaaattgtagatctatttataagagatttatagcagttactataaaggatattattagaaagcaggtatgagctattaacaaatgaattttacttattttgcttaaaacaaaaagtgaaggacacaacccaaatttaaaatttaaaattattcttaacttctaaagttttttttatcattgatttcctaagtgttgtagtaggtgaattttgttggtgataaactggtgattcaattctctgcacttgctcttttctctgagcaggtgcgggcattctatgtgaacgtgctgaatgaggaacagaggaaacgtctgtgtgagaacattgccggccacctgaaggatgcacaaattttcatccagaagaaagcggtgagtctttgtaagctgaagggtgtcctctgctggctaaggaagacagtgcagctgtgtgggagaaccctaaaaagaaagtgccatttctgttttacttgacttaagagaacttaaaaaaaaaaaaataaactagtaatccccaaccaacttctgattattttctttccatgttttatctggtctggcatatccatcgtccttagctgtttgtccagtgtgtactaatttagttgtgttcagactgaattttgtcctattctgtttaattcagctgcagccaagttctgtgcaagatagtaaatgtgcaatatcaaaatgtgagtcctgctgcaattctacttaaactttggatgataataaatatatcagccggtgtgatggcatgcacctgtagtcctagctacttaggaggttgagatgggaggatcgcttgagcccaggaatacagggccagcctggacaacatagggagaccctgtctctaaaatcagtcaatcagtcaatcagtctgtctttcttttttgcatttttatggtttaaaacctgcctaaaggcttaatgtcataatacctcgatcctccttcagatgcagactagaaatttgcatgatttctggaataagaactgcaatgcttccaaaaggcaggctagactttcatgctaaggtgctggggtatttctgatggccgctcatcgagctgagtgaagccctctcacttctggtttcctggcctgtcccagagctaagctttttgcaaatctagaaatccccctttttccttggcccctagttgctgcttctcagttcctaggggcagctgggctagcagctgtctgggctgtgtcccagagcctgggttccagtatcagcagagagcttgacaggcgctctgtgtggtaggcagggcaggatttatctccttttactggagagaatggatacgacagcttgtaaatagcagaactgggctggaacccttggcattctcctttcacatatgctgaaactgtaaggcttttatgggttcccaatgccctgcctcctcttgctgtccactggggaattcctgcctgaagtgtgtggagttgtgctgcatgtaccagtgttcttgtatccttcacattaactttaggctgtgtctgggcccgtttctcaatgtaaatcactgtaatttgttaagcgcttactctgaggtcagctcttttcatgcagtaaatgcacctcacttctcagcatttttctcacagcatcctgtgaggtaggttgtgtgggttttttttttttaagatggagtcttgttctgtcacccaggctggactgcagtggcatgatctcggctcactgcaacctctgcctcctgggttcaagagattttcctgcctcagcctccccagtagcttggactacaggcatgccccaccatgcccgactaatttttgtgtttttagtagagatggggttttgccatgttaaccaggctggtcttgaactactgacctcaggtgatccacccatcttggcctcccaaagtgctgggatttcgggcgtgagccactgcgcctggcctaggttgtatgggtttttttccccgacaataagcaattctgtaattctttgacagtaactgtgtgtcctataactcaattcaattctaacagtagctcctggagctagagtcagaacccaaagatttaggggtcatttcccactttagataacaaatgaggtaccctggctatgcacacttctgcagattctgactgcaaatcaaaccctttcctcaggtttgataatttgctggaaagactcatagaactcaggaaaatgatttacttatgattaccaatttattataaagaatacaactcaggaatagacaaatggaagaggggcatgggggaaggcctcggagcttctgtgcctccctgagtggaccacccttctagctcctggatgtgtgcactaatccagacactccctgaccttgccagttgtgggtttttctggaggttttatgacataggcatgattgatgaaattattggctatgggtgattgaatacaatctccagcccctctcccatccctggaggtttgggggtggggctagaagttctaaccttctgatcgcgtgcttgttcttcctggtgtgagcctccatcaggaatctatgtaggcccccatgaatcatcttagtagtatataaaagacagtacattcgaagggttttagatctgtgtcaggaatgggggacaaagaccaaatagtatttttaaaattatactgattaggtgtcattttcttgcgcatttcggcagagggacataagctcagtaagttaagtgacctatccgaggttgctcagccagtatatgtcagagtgttcactggacctgcatcttaactctgaggctggcattgttaaacacctgtagtactgcctcctgctgaaacgtctttcctcccctatggaataaacactgggaaaccacagtccctggggagtgatatagtagggagttagagtaatgcttgcatttattttcctttggccttaggtcaagaacttcactgaggtccaccctgactacgggagccacatccaggctcttctggacaagtacaatgctgagaagcctaaggtaagctgggagcagcctggccatgcagaggctgtgtgtgctgggttggagtaggcatgacttagttaccacttagcattacagtctgcaggggccattacctgccactgttagatttcttaggcagctgtgcagaaattcatttgagagataaagaattcactggcaaaacacatactcttcattttagcgctgggcaatttaagacagttaaagtgaatgaattctgaattattattttcatttgcatacatattaaaactgagtaaatatcacgttgctgcccatgaggtgattaacctgctcatcttgttcttttaaaacagaatgcgattcacacctttgtgcagtccggatctcacttggcggcaagggagaaggcaaatctgtgaggccggggccctgcacctgtgcagcgaagcttagcgttcatccgtgtaacccgctcatcactggatgaagattctcctgtgctagatgtgcaaatgcaagctagtggcttcaaaatagagaatcccactttctatagcagattgtgtaacaattttaatgctatttccccaggggaaaatgaaggttaggatttaacagtcatttaaaaaaaaaatttgttttgacggatgattggattattcatttaaaatgattagaaggcaagtttctagctagaaatatgattttatttgacaaaatttgttgaaattatgtatgtttacatatcacctcatggcctattatattaaaatatggctataaatatataaaaagaaaagataaagatgatctactcagaaatttttatttttctaaggttctcataggaaaagtacatttaatacagcagtgtcatcagaagataacttgagcaccgtcatggcttaatgtttattcctgataataattgatcaaattcatttttttcactggagttacattaatgttaattcagcactgatttcacaacagatcaatttgtaattgcttacatttttacaataaataatctgtacgtaagaacagagatggtattttctttctttcgactccatatgtaactgtaaactgctaccagactcttaatttgaacatcatcattttcagatgtttacccttaaaaatggaaatgccagtatctcgaggactccatgttatttgtttaaatctatagcctttggacagccttctgagacactgataaaatagcaaatgccccaactttgaaaattacttaaatctcttgtccatttgctcacttacctgtgattgactttttaaaacaagggctcagaaccactggtcactttcctcttccttctttttaaagcccatatttgcctatcatggttgaaaatcacatggaagactttaaagatgagttctgaatactaaatgaaaatttgttttccttgaaaatctttattccgttcatattcaaaaccagtttgtgccgggtgtggtggctcatatgcctgtaaacccagcactttgggaagccaaggcaggaggatcacttgaactcaggagtttgagaccagccggggcaacatggcgaagccctgtctgtacaaaaaatacaaaaattagccgagtatggtaacgcatgcctgtagtcccagttactagggaggctgaggcgggaggatctcttgagcccaggaggttgaggctgcagtgagtcgtgattgcaccactgcactccagtctgggcaacagagtgagaccttgtctgaaaacaacaacaataacaactaaaaacaaaaaaccaaaccagtttatactttcaggagttcctgagttacgggcttcaggaaacagaccactagcagacagatacaaactcattcttggtcttttagctcaaatttctttactcctctgtcaaaccctcctgcctaattccccccgtatttgagtatgctttgagactgttatatttgtagacatagaaaatagatatatcgggctgggtgcagtggctcacgcctgtaaacccagcactttgggaggccaaggcgggtggaacacctgaggtcaggagtttgagatcagcctggccaacgtggtgaaaccccatttctactaaaaatacaaaaattagctgggtgtggtggcatgtgcgtgtaatcccagctactcgtgaggctgaggtgggagaatcgcttgaacccaggaggtggaggttgcagtgagccaagattgcgccactgcactttttattgggaaaggtgagaacttctggagatggttggtggtgatggttgcacaacagtgtgaatgtatttaatgctactgaactgtacacctaaaaatggctaaatggtaagttttgtgtatattttaccccacaaaaaaatccaatggtccattcttagtccttgtcttacatgacctctcagcggtgtttgacacagttggtcgttcacactgccttcttcattgtttatttattttagagacggcatatcattatgttgcccagggtggcctctgcctcctgagtaactgggactacaggcacacatcaccatgcccagctttcctcctcgtccctttctcctcctcctcatttttcttcctcctcctcctctctcttcttcttgtccttgccctcatcctcctcctttttttttcttccttcttccttttttcttctctctcttttttaaaataagagctttattgagatataattcacataccgtaaaaaccacccatttaaagtgtacgagtaaattttttttgtatattcacagaattgcgcaaccatcaccacaatcaattttggagcattttcatcaccccaaagggaaacctgtacctatcagcagccactctccatttctttcttaacctagtccccagccctaggccatcatgaatctaagatttgcctactctgcatgtttcatttaaatggaataatatagtatgtggtcttttgtgactggcttctttcacttagcataatattttcaagattcttacatattgtagcatctatgagtgcttcattttttta

SEQ ID NO: 11997 - DNA, 7142 bp, Human
gagtgaaactgagtaaagggtaaggaatctctgtattatttcttacaactgcatgtgactctataattagctcgacaaaaatttcagttgaaaaaaagcaagggtctttccttgattattaacttgttttaaagcaactgattggaaacctaccttgaaattgcaatgtaattgcaatctatttaaagcagtggtgttcaacagacctttctgcaaggatggaaatatcctaaatctgtactgcccaatacagtgaccactaacacatgcacatattgagcactggagatgtggctagtgcaactaaaaaactgaattacaaattttgcttaatttgaatttatgtttaaatggccacctgtgatagtggcaacctatgggacagcacagaaatgaaacttgaccttattcccaattcccttgtaagtaggaaggaggaacactcactttgaaaccatgcaattgtcccataggacagatgtttatggtctctttttttttccttttttttttttttgagagggagtcactctgttgcccaggctggagtgcagtggcatgatctcggctcactgcaacctccgcctctggggttcaagcaagcaattctctgcttcagcctcccaagtagctgggattacaggcgcctgccaccacacccagctaatttttgtattttttttttttttttttttttttagtagagatggggtttcaccatcttggccaggctggtcttgaactcctgacctcatgatccacccacctcagcctcccaaagtgctgagattacaggcgtgagccaccgcgccaggcctggtctcttttgaataaacaaattgaccctcccagtctaaaaacttgagaaatttacatttgtcttatctgagttcctttctcagggaactagccatcagtcctcccagatagcaccaaggaactgaaacttatcggatcaccacatctggaaaatcagacaccagacccctcacctgcaacaattgcctgatgcctgttgacccactcctcttcatctctccctaactcctgctattttcccacatgcagttacatttcttccctgctatatcctaattttaatcagttgagaagatggatttgagactgatctctcccccctaggctgtagcacccaaataatgccttcttccctgacaataatggggtctcagtgactggctttctgtgctgtgaaccaccagacctagaccaaactcctggcatttctctaacaatttcccaccactgaactaagttataaattctgaggatggatccctgtttcttcattttaagatggggattaaaaggtacatcctagagtgttattgtccgtgtaaaatagggctgtgaaaccccctacacctatgcacagataaactgatggccctgcaaatgcccagagaagtaaccttataaagatttagtgaatgtttcccaccattattggaaaatctggctaagtcagtagctttgttttcatatacttagggggaaaatcaacaaaaacttgatgccctgttatttccttccagtttcttctgcaactctagctccaaagactgcagttcctgcagtatttttttttttagaacaccaggaaaaaaagaaaaaaaaaccatgcaaatgtactatttcttcaaacacaactaggaatgattgaacagctgggagaatatgaagaaaacccctcagagaaccaagggcaagcagtgagttcagatctaggcacatggccactaggaatggttcttcactgccacgtgggcagccaacagccagtagctagagaccagcctcggtcttcggcctgcgggttctgcaaagtcaggctagctggctctccgcctgctccgcaccccggcgaggttccggtggggaggggtagggatggttcagccccgccccgctagggcggggcctgcgcctgcgcgctcagcggccgggcgtgtaacccacgggtgcgcgcccacgaccgccagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaagggtatggggaggggacgtggcctccccgaagaagaaccgatgcactggggctcctggcgtctgcggggtccataacgcctccctagggaggagagggaggagctaggagatgcagggagtgcagaaaccttggagaaagtgagagttttccagccaaagggaactttgtgtttccctggctgggactcttggggatctttttcaggttttctgcagtttttctgaattgagctttaaggcaactggatggattttgaactgattttaaaataaacgacaaattgcaaaaagaaaaaatggttatgccaagatccagtgtgtgcacccttcatcctccttcccccaatggtgccatcttacaaaaatactagaacatgatcaaaccaggagattgacattggcacaatactgtaaccagatacagacttactttaggcagagggcactaagtttttttttttttttttttttttttttagtatcattgtatagaattttaccccatgggtacaatgtattaactatgttctctttctctcctaaaagttgctgatcccacaccctttcatattcaagctgaagtgacgatgaaaacaaatttctttggtacccgagatgtgtgcacagaattactccctctaataaaaccccaaggtgagtctgatgggaaacagcgcaccttctctttggggcttgatttggcccctgcttgcctgggatttctcctgcaggctcctgcttcctctccatgctgcacgtgcactgacctctgtgctttttctcctgccagctgatatgtgccattttgcctcaggactttgtcctcacttctcccactcccatggccattcgtcctccctgtcgcactggtctttgcacacctggctgactctcatccttcaggtcttagctcaaacgtctcctgagagatgctctttatttgctccattcccctccgcgtgggagtccatcctgtaccctttctctgctctttcagagagatcttattcaggctggtggaggctttactaccaccagttcattaggcccttctaatacctgtcacctgtctgaaacactccttaagctcccaaccacatggttgtcttgctgcctttccatctcttcctgatgcctttccccacaatctaagatatttccagaggatccctatccttttccctaagtcgtttgggacacagaccccaccacccacccaccaggatcctgcaggtcaccatgccccacccctcataatcatttactaggtcctaggagttgtgcccactgagttcctcctgaatccgtctcattgcagctctacagcaggccctcacctgtccctctggacaattgcaaaccctcacaaggcacctctggtcttgagtcttttcctcttttcctttcccagcatcctgcgtactgtctgcatggtcatgcctctcccaaaatccttcaggaggaaagtccaagcccttagcatggttcacagagatgtccataatctgccgctgcttaactctgggcccattttaactccccttcaacgtgctgaaggtgctggacatgactatcacatgtctttggttgtaaactgctgtgatagttaccctaagtaatgggacaggagatgaacccacccattaaataacacagcaattaagcagccacttttagaaaaatttaaatgtgtggcttcgagttgggtacttgcatgtacagcttactctcagcttttatcctgtttccctgtcctgtcgtcctgttaagttgtgctacttctaaggctctggttcaccaggacctcaaagggcagctcttccaaatctcacctgactctactcagccaaaattcgaaggcaggaatgaacttcttcatgcaactaccaccacactttctatgcgtattcctcttagaactcataccagtaactgtctctcatatgaaaattttctgctccaaaatccctgcaaatttggcattcacctctctacgggattgttgcacacctttctacataatgctttgtggtgtatcttagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtgtccatttgtacagattgtttagatgctaaataagctttgtctcaagtacaatcaacctaaaaggtcaagggaagggacagtacaacttgggggtgagcaaacccagaaagtaaagaaagagccagttagtcaatattttcaatgttgtaggtcaaacaatgcattggaactccccaaatccacattatgtaacaaaagctgacagcatgtaagcctgtgagcatagctggctctggcccttcccagcctctaggaaaacaaatagtaccacaacggcaaaggcagctgacctggtctctttaaaaaagccaaagtcattggggaaaaacaaccagttgctatgtgtgaaacgtgagtgtgcacttgtgtgaaacaccgagctgatgagggacctatcagatctccataggaatgtgttatttatgtagggatgaagtgtcatgaggtgtacaacatatgccccaggtgtacaacatgtgtttcagcaaagtatacaaagactgatgaacaggtaaggcaaaaaaaaaacaacttttctgtttgttgaaagctttcaaaacctgggggttggcagtggaaacttctggctctgcccactgaattcctgacctcaggcagaatactgtatctggctttgtctctgtttcctcaactgtcaaattgggatgacagtcataggattatatgtattgagataaagtgttgagaacaaattagctgggtgtgatggtgggcgcctgtaatcccagctactcaggaggctgaggcaggagaatcgcttgaacccagggggtggaggttgcagtgagccaagattgcactactgcactccagcctgggcgacagagtgagacttcatctcaaaaaaaaaaaaaaaaatagtgttgagaacagcccctgctgtcattagttcctgtaaatgggcctgacgctgtccctgctggtaatgagaagtgtgtgtttactgtctaacacccagtaaatgcccaggccattctgtttcttccacagaatcacagtgttgtgatctctcacacttcaccagtgagaattaaggcttacagaaacaaaaagcgatcacccgtgaaaagaaggagaggccccttattttatttttatctatttattttttaattctccaaactgcttcggaagagtcccttattttatttatttatttatttatttgtttgtttgtttgtttgtttattgagacagagtctcaatcttggttcagtgcaacctctgcctcctgggttcaagtgattctcctgcctcagcctcctgagtagctgggattacaggcgcccgccaccatgcatggctaacttttgtatttttagtagagacagggtttcgccatgttggccaagctgatctcgaacttctggcctcaagtgatccacccgcctcggcctcccaaagtactgggattacagacatgagccactgcacccagcctagtcccttaggttaaaagtgaggtttactttgacaagtttcacctttcagtagggctgttcatttcttcctagtttttgtacacagacaccagaaaacaatcacgtctgcagcaaaactggtattctcaagtgctagtttagaaatttgtacctgtattgcaaagatatttttcccttaataccttaaaaataacacctaacttctttaagagatttagagaaagcattgttccaaattcaagtacctgcttacctctgagggtgaggggaggaggacatacgtggttccgtctttattgctaaggatttctttcttataccaggtgataggtacatggtgctaaaatacaattttcagaaaaaggtaaaatcatgactgtcatacagatgtaaaaataatagtcaaaaaaatgtattttactcataagggaaccagggaaatgttataactggttcaaaggaaaagctaaaaggaaaagctaacagattatatggaatcaacaaatgttgagctgaattgcaaatgacgacaaaact

SEQ ID NO: 11998 - DNA, 36302 bp, Human
  misc_feature (1)...(36302): n = A,T,C or G
gtttgcaacttgggtttttcagcgagctttttttcttcctgaaagctaatggcttccacagcaattagacattttcctcgcccgccccttccctcccctttctttacatataggagatgggatactcattcccgctgctattgataaggtcggaggcggccgggcctctccccagctttcgcccgccccagcgcccgctctccctccgccctcccttggcttccttttgatgtagtggggaacgcgtcctactaaaaaaaaaaaaaaaaaaaaaaaaaaaaaaaagtaatctgcccggtaacaatcagcgcgcagtagcaggagccccagagctattggctatgcaaatagagggaggggagacggcgccccaaactcttcctcacccttttaaagcgatatcccctcctttcccccccaccaccccttccgccccaccctcgtttaaagaggctggctccggggcctgagttaatcgcttgcacctctagtttattcgctcccctcctccgccttgcagggaacctagtgtacggctcacccagcccgcgccccaccccgccttgctggctctccgcgcccctgcccgggccccctctctcggtgagggaggcactcagtcggcctcggtgtgcccagagagctcgagccacgccatgcccgctgcacgtgccagcttggccagcacatcagggcgctggtctctccccttcctcctggagtgaaatacaccaaagggcgcggtgggggtggggggtgacgggaggaaggaggtgaagaaacgccaccagatcgtatcacctgtaaagacagccttgactcaagcatgcgttagagcacgtgtcagggccgaccgtgctggcggcgacttcaccgcagtcggctcccagggagaaagcctggcgagtgaggcgcgaaaccggaggggtcggcgaggatgcgggcgaaggaccgagcgtggaggcctcatgcctccggggaaaggaaggggtggtggtgtttgcgcagggggagcgagggggagccggacctaatccctcactcgccccctccccctcccgggccatttcctagaaagctgcatcggtgtggccacgctcagcgcagacacctcgggcggcttgtcagcagatgcaggggcgaggaagcgggtttttcctgcgtggccgctggccgcgggggaaccgctgggagccctgcccccggcctgcggcggccctagacgctgcaccgcgtcgccccacggcgcccgaagagcccccagaaacacgatggtttctgctcgaggatcacattctatccctccagagaagcaccccccttccttcctaatacccacctctccctccctcttcttcctctgcacacactctgcaggggggggcagaagggacgttgttctggtccctttaatcggggctttcgaaacagcttcgaagttatcaggaacacagacttcagggacatgacctttatctctgggtatgcgaggttgctattttctaaaatcaccccctcccttatttttcacttaagggacctatttctaaattgtctgaggtcaccccatcttcagataatctaccctacattcctggatcttaaatacaagggcaggaggattaggatccgttttgaagaagccaaagttggagggtcgtattttggcgtgctacacctacagaatgagtgaaattagagggcagaaataggagtcggtagttttttgtgggttgccctgtccggggcccctggcatgcagggctggatggagggagaggggtggggggtggcgggggaccgcgtttgaagttgggtcgggccagctgctgttctccttaataacgagaggggaaaaggagggagggagggagagattgaaaggaggaggggaggaccgggaggggaggaaaggggaggaggaaccagagcggtgagcgcggggagaggatggagagctaactgcccagccagcttgcgtcaacgcttcagagcggagaagagcgagcaggggagagcgagaccagttttaaggggaggaccggtgcgagtgaggcagccccgaggctctgctcgcccaccacccaatcatcgcctcccttctgctccaccttctctctctgccctcacctctcccccgaaaaccccctatttagccaaaggaaggaggtcaggggaacgctctcccctccccttccaaaaaacaaaaacagaaaaacctttttccaggccggggaaagcaggagggagaggggccgccgggctggccatggagctgctgtgccacgaggtggacccggtccgcagggccgtgcgggaccgcaacctgctccgagacgaccgcgtcctgcagaacctgctcaccatcgaggagcgctaccttccgcagtgctcctacttcaagtgcgtgcagaaggacatccaaccctacatgcgcagaatggtggccacctggatgctggaggtaggtcggggggtggcgctcgccaggagccaggacccctccggatgctcgggtccccggccggagccctaaacctgggagagggcaatccccgcgccggcctcccggctcctgtgcgggagtttaccgcgcgccttctggcgagacgcgtggctttatttctgttcctctccagataaactggggaggcagaggggggaggaaaatctgggagaagcgaggctgtcctgggcgggggtaggggagcatcccgcgcgcgtgttcctgcatgtggctgcctcttcttcccacccccctcgcgacctgtcttttgcgaagccgccgcggctgcttgcgctgcggccaggaagagagtcggggcctgaaatcgggaccccgagtagaaaggcaaccccccccaaaaggccagagcaaattcgtcttggcctcaggtccccgcctgtggtcgcgactccgcgctggcacttcaccggggaggtggagggaggagggagaaggagagaaacggggaattcgggagccccggaagtcccattgaagaaacgcgtgtttcaggggaacccaaaagaaccgcttcttgcccctcactccaagtctttgcccagcgagccgtgtgcccacgtatgcacagctctggacctgccgtggtttcgccatgttgctttgcaaactccctttggaaaggctgggaaacgtcgcccgcttaccctcgcaccccattatcccggccaccccacttctaatcgtgccctctcccccaccccccacctcacgaagattacttacagtttggttttccagcttcctcggtgcggagatttgggtggggtaggaagnnnnnnnnnnnnnnnnnnnnattcgttttttcttggcggacaccccgggcaaaccggagggcaccgaacggaacggggcacggaacgacggcgaacgaggaggcaaagagagcgccgcccgacccacgcccaagcgacgcaaagaaacgccgccgacccaaacccccgcaccacaacggcccccacgaccaccggaaccgcgccgcacaccccccagcccgagcagaacgcagcaaccccacccgccaaccccagcaaaccgacgccaaaagcaaaacaaagaaacgacgcccagccgccaccccggcgcagcacccccggccgcgccaccccccaccccacgccggaaggcccggagacgcaaaacgacgggaagcgcgccgcgcaccccgcggcaaagacaaacgggcagccccccccccagcctcccggcccgcacacccgggcgagacaaacaccgccccagcgggtatgcgacgaaagtattccgggtcacccctgaaggacaggtgggagccccccgtgcctctttccagggctctctgctcccgtctttcccctcgctcgtcaccgcgttccctagtttctgtccttgtgggccgcagccggacactcccgccgcggcgctcaccccttcaagtttcctcccgggatccaaagccccaggggtcggaatacagacctttctggcacccgaaacctctgtttcgggaagcctggctcttctttggggttttcacgccaaaagggcttttctaggatatttcctcgatttttaattattttttgaaaccatccccccctgctccgactccagctgccgaggctgcggcgctcttcctcctctcctccctccccctctcttccccacctctcctcacccgccccctcaaaagcggcccctgggccgcagggatccccccagacattttttccaattgtcgggaatgatagaggaggatctggggatccggatgagaccaagaagtggacccccggagcctccagaatatttttattgattttttgaaaagatgacgaaatccaaaaaagagtgagtgagttagagtgcgcgaaggagtagccaaagggagcgtcgcggagctgccgcggctgctgcgcacttctccgactccccgttttggagctgtagttcacccccttttataggatccctgggaataccaaagcactgatgggctattctgattcactccagtttcctcatctttgttctttattcttatcacgcattctggtcccctccccctcccacaaaaaaaaattaattttttttgtttcgatagattacgcttttttattctttttctcttttgctgatgctatgctctccacccccgccccccaaccctttcccactcccattataggtctgtgaggaacagaagtgcgaagaagaggtcttccctctggccatgaattacctggaccgtttcttggctggggtcccgactccgaagtcccatctgcaactcctgggtgctgtctgcatgttcctggcctccaaactcaaagagaccagcccgctgaccgcggagaagctgtgcatttacaccgacaactccatcaagcctcaggagctgctggtaatgaccggccccttcctcccttcctttctgcgattcccgctttcccctggccaacaatatgccttctatcaccactgccagagcaaattcttgggatccagaatgaccccaccaatagaatttacccacttatgggcgatagctcatttaataggaaaccactgtttattttttgtgtgttcctactatgtgcccaggctccgtgcccagcactgaggctacatctgtgaataagatcctcatggagatttgggttggtgagactcatttgcaattgtgtatgcatgtgtgtaggggacgcatggaatattttaattaacagtgataatattttaattaaattccaaatttccaaaaatagtctgagaacgtgttcacatgataggtatgtggctgtggtgtctcctaaaaacttggagttcaaaggtaatgccctctatatctacaaagtctcaagataccaacacataatagctgttcactaaatatcagttcattgacttttgagcaaagtcaaaatgtggcctttcactgaaggagtccgaggcctgggttcctacctccagtgggactgtgacctctgtacaaccccagggatcctgtcttatctctgcttttctaccagggaacctttttcccacctgatctaactccttttccctgcagcttgacatgtaagacgaccatattgcagctgtaccgcatggaatagcggctccaaggcccaccttcggtggtttgcacacccctctttgcactgttcagaaaagcaccccctccttcccgcccctccccctcctcactggtagggcccgcacaaagtccacagggctgaggctggcttcttgaactgagctctttgtgaggagccttcctttctggggctctgctgccatctagtggaagacatgcacaaggttgggggaggaattgccgagaatgtggagaggggcctgaatgacttcacctttgaaccgctgccaggttttagctgcttctggtttggtccgagaggcctagaaaggtgctttcttctgggagatctgcttcctttaataacggtgcaagaccagtggttcgtactcgcattaccctgtgaagaggaagggctggcatttcaagccatctttgaagatgatggtggtttagtagtttattggggtgctttaccccggctgtccacagaaagccaaggcagattttaaagcttatgaagaaaacattgttagaattgggaaccaatttgtttttctcatgagagagcaggaaaaatcatcttcatatggttcatttgtttcgagaggatggtgaattgagatgttcttcaggacacccaaatctttccaggactagccaagcaatatattgctacaaacaaacttggctttttcctattccctttatcccagaagttgggatttggaagagtcctattttacaaatgagaaggctgaggcctgggagggaaagggaatcacccccagccccacagctgtgggactggtgctctggttgctggtttagcaaatgaaagagattccaggttctccaggtgaatgggagagagggtgcattggcaaacaggccctgcctctcattcttctgatgacagctcagtggataggcatattttctggtagcacatacgatatttttaatgttttattttggaccgtttccctttgagcacagtttcccgtaagtatctcagtgaaagagggaaacaaggttctttttcaggtgggttgctggtgagagacccaagagacagggttgtgtggtccccacacttgcactgagggatgctgtgacactgagcaggcaccctcaccttgccccagatcacctccatctgcaaaatgaggttgctaatgaccatgtggtcctttagtcatgatgacaatggcctgtgaaacatttaggggaaagggctgagtgtcacatccccagaatttctgcctgatatgtaaaaggggagtttgagcagcagagagataaaggcactttttggcactaagtaaaagcaagctaattggttgccaaggagttgggccaaggaaccttattttgagctttatctgtgtgcatcatttttccatgaagattaaaaagactattaattcggtgatagagacatatacaataaattaccatgaaagggccacaatgaccttggccgtatctcattgtaggttcagctttctgggtgggcgggaagcagtattgcctgcaagtcagggttgggagggggtaaggggagctggagtggaaacgaagtagaagaaaatagaatcttggcaacagctacctgggctctcattattttcagtggagcctgacatttgaagcataagaagagctgtcaacaacttcaaagcttcaggggcacattgacaaatgggcccgccttacaatctagcagccacgtcctaatgagcggccttaaaactggtctggagcccaacccccagccccctacaccaggtcagcctgtggaatttagattctcctcttctcttcctgccttcccctccaggagtgggaactggtggtgctggggaagttgaagtggaacctggcagctgtcactcctcatgacttcattgagcacatcttgcgcaagctgccccagcagcgggagaagctgtctctgatccgcaagcatgctcagaccttcattgctctgtgtgccaccggtaagatgaggcttgagccggggagggagatgggggagctcttttgggagatgtccggggagaggcaaaaggccgtaggaactttcattttagttcaggagtttggaggaggggtggtcttgagtagtctaaagtctgaagtttcattcctgggttgctttttctttatctgagctttatatattcgctttctctgctaaactcataaatggtttatgaggacaggtgtggttaaggcaaaaaaaattagtgcctgttaaaatattctttatgatggctaaagtgctctttgaagattacatatactgctcactggttgtgttcaaatctttaatcttttaaggaaaaggatggcttggagataagcccaagaggaaatctcgagggggatgggggcaaatacaggttaaaggaacaacgtcaagataaatatgctgcctgccttgattagtggtaagggagaccaaagaaattcttttttttttttttttactgtagggcatttatggccttctagctgtttgcttctctagctgtttgccccactgggcgcgggagggaacctggttggctttcggtgaggctttactttctgagcgctgggttctgatgccctcagttcatgtggaggtgttttgattttggccgcagcctttaacgttgcaattccgcctaccacgtggatcccacaattgatacatcattcctactggcccatttgttttgtagtttcctaataaaccaaaggcagtggtttgctgttgtcttattaaacagccttggccagtgtctactggttttttgtttttttttttcttggtagtggccatggcagagaccctggaaccttactcatccaagggagagatgtcaggagttcatgttttgacaatcagaaaccttaggtaaaaagctgatcacttgggaagacctttcggtgtgcttcacctcaaatttgccaagagtagttaaatcgctaggtggactcacgtggtaacttttttcaggatgttgttacatgttactggtgagttctacggaacggatgattatataacgtacgatgtagtgcatatgccctgtgctcacagtcaaaaagtcaggctttgctgcatatcagtgagtgacctttaattggctgcttaacctctctgaacccgagcttcttcatctccaaaacaagcctattgatacatcatcctacagccttttcagagcagctaggaaaattaaaatcagaaagaggtgatgcacgtggacgtgctttgtaaaccgaagtgtaggttggaccttcactaattgtgaaaatgctaccatctccgattttcaccctgattttaactgttccgactaaagtggatatgatggctttccttttctggctgcccttacgtgtttctagcaggacctgtgtgttctgcacttgcaggcttgagtgtggagtcctcccggccccctgcctgttcatctagggcacaggtttccccttgctggttttctgtagtcctgttctcctggatgcaggccaggcctcatggcgtgcacatgcgccctgtgccccttggtgggagagtccgttatccttcctgcagccctgggggcggttcttaggacccctgtggacccctgctgccttttggatagtggtcactctggcttccttcccttctgctgtctggcccgggcccgagaggtcagtcctccagtgacctgtcattttgtctcccaggctcggctgtctccttcctctctcatcatgattcactgtgggggaggggtcagccagttctttctctctggcccaaggacagctgacccccgaccctaaactcccccactgcccagctgttgatagccagagctctgctcaacactgtctcttgactaacagatcttttggggtctaactgccccttcctcctctctgatctctgattggggtaggggtgctgggtggagttaccggggtgtgggcagatccccagattccgtctagacccattctcgaaaaccggggatcccatcccccacccgtggccttcttgcccagatctttgggctggctgccagctccggggccagagtagggagcctgggattcagagactgaggacagaggcccagagggatacagaggcagttataaagactgtgttttgggggccttgaactagctttggtcagggactaggaaaggacacccccaaaccacatgaaaatggtgtgctaggcactaagcctcaggcgtggacagggcagagcacaggtaggtcctcggcagtttccagggtctggaaaggaggggcctgtatcgaaagaagttgctttccctcatctgcacttgggtttgtgcaactgactgagtcacatagaatcctggctgcgtggagttttacaacagtcggcctcacagtacaaacaccgaaggccgcttttcttgaaggaaacaccttccatggagaggcgattgtgcattgtggggccagggtgtgatgaatgggcaaggacccaggactctggccagtagcgggcacagagtgactgagaggcagaggtaggagatgcagattccccaacccgagctgttgccctcacctgctcctcaaatcgcacacttccctccttttctcgcagtcctggatgttccgtcctggagctgatgaaacacctgcggccagggtctcggaggtccacagtgggtggagggtgggggtcccgagagatggccgccaaccctcaggccgtgcagctatttgatgggaaaagctggttgtgaaagagctggcagtggttctgcagtgtgtggggagcgtatttgtgtgtgaaaggggaagggagagcaggagaacatagaggggccgcgtaagtgtggcgaagtggcggtcttgctttatggggctctggattaagatggtggcaaggcggagaggagccctccttccttccctgctcagcctaaaatggcttctggaagagcaagggccgcaagctgctggtatccctctgcagcaggtcctgggcagtgcaggcatgggtgggttgggcgggggatcttcctgactacagctcctagcattcctgttcctggagtttccaaaactggggaagcagaactgagccatagcttccctggttgccgctctgctgatagaacacccaggtctgcaagcgaggaaagaaggccattggagatgacctgggttcgcactctggcactgggagattgttgagatgtgataccatgctcggtggatgattccagttagtctagcagagccaatggcattgagtttacacctggcaccgggtagggggaggtgctcaccctccctctccaggcacccacatcccctctttcttcactagaagcccaccctaagatgctgcaccttggtatttgtgccacacacggtagccacccccaggcctccccacgccaaggccagagccccattgttgactagaacccattgtgctgtcctagccccttccctggctttacctacaggtgttccctcagattccatcgccaagtgagagggagacagtggtggcccagagaagttcgatgacttggcccttgatctagagtgggagatttcgccttgatgggtgctgggaaggaagaatggaaacccgtctttccatctgcaagtctctgagctacccctgaagccgcgaggtcatgggactgagggggagtcgttagcatgccctgtggggacaagcagccaggcagtgtggtgcttgccatcgctcttccctctggctgtaagatgaatgggtagcaggctgctcatcgccctccaaccagccccctccccagctcctcccagcaggccttgcagttgcatgggcattcccttgccatggcagccctgccccacaaggacagggtatgctggtcctcttatgggggtggcagatgaggtgcgtgcccagtgacgtccctggcctgtgaacactctggttctggccctttgaacttccacctgactgcaggttggagaagagagatggggaaagcctgacctggccttccctttcttcttcagcgtcagagtgcgtatctctctccccctattggtgaacagaagcaaagccatcacccctgcaccccaagacctcggccaccatagccaaaatgatgggtgctaaatgtactgggcaggaccatgtattccgtggttttaaacttacttagctctgaactctttatttggtaaaatcctaccaagaagtgcagataccaagttgatgaaatggagcacttctcagggcccatgcccaggtgagggagcccagcgggacccccagaggctcccagggcatccttgggaggataagccttttgtgcttgctggtgccggggctgcggctgggacccaattcctttgattcctgagccagagcgccacctttggggctcttctcccacttccgacgtgaaaggctgccctgtcctcctgagtggtatatgggaggtgactttgaggagctggtcagcttccagtaagttacgaagagctctgcatccagagtctcaaagtctcatccggatcccaggcccaacactcacagtgagtgacatcagccagatcacttcatctcccaagacttcattgattcacctgtaaaaggagatgtttgaaacagatgaatttcaagctcctttttattaatacctcaccatcatcaccgccgtcataagcaagcatgcagcccacagcagagctgcccctggcgcctgtgggtccagctgggattcccctaaggtgtgtcctttgcctccaccattttgccaggagggaggcgggaatgtcgggtgttcctggttatctgggcatcgttccttggctcgggtgaactgcatctcaatgaattgtggaatgtgctgggttagagttgccaacttctctcttccattcgctgagtgttcatggggttcttttcattcccctgtggggctgcactttctcccagttctgcaaagcagcaggaggctttggggactcgatgatgtcatttctgggacacatacacaactggatagtgacagattctccaggaagcacagagccctcattcttcctggcctgcttggcctgctccctgcatctgcctgcaatccagggatgctgggcgcctttctcctcatccctccagacgctggagagcatctccagtcggaactccccaccacagtcctgcaggaagtactaggagtgagagcagaggaggggcaggttggggaggatgctggctgacattcattgcttaccttgaaccaggcactgtgcttttacaaggattattttaagtgaatcctcagaacagcactacaacgtgggtattgctgttgtcattatttgcagatcagaaaatgaagactcagagaggtcaggtaacttgctcatcttcacacacttggtaggtggtgggatggagattccacctccttctgattccagagctaatactctgaaccagtgagctgtgttctccagaggtctgctttggttggaggggagctggagccctaggccctgggacggcctctgttgcccatggcaaggcgtgtggctgctcctgctctcttcagatctccagatgcagcaacctggagaaaggccctcctgggtctggtggggactggggcaggagtggaggctgcccaagctccgtgcactccacgttccagcttggagctttttgagtctactctccaaatccttcccatctccctgaagagtcttctgagaagtgtctcaaatgctcctcttcactcaagagcctcctttctttttttttttcttttctttttcttttttttttttgagacagtcttgctctgtcacccaggctggagtgcatggcacaatctctgctcactgcaacctccaactcccgggttcaagtgattctcttgcctaagcctccagaatagctgggattacaggcgcgtgccaccatgcctggctaatttttgtatttttagtacagacagggtttcaccgtgttggccagactggtctcgaacttcggacctcaggtcatctgcccacctcggcctcccaaagtgctaggattacactgtgagccactgcgcccagccttcaagagccccctttctttgagaagtttcttcagaagttatccatatagtagtacagacctagccattatagcacaccatcctctactatctaatgcattgatgcccagccttaagaagtctgaatattgtacgttttggggggagtcctccatgctgcctggaacagggaggagcacattgtcatgagtcgatcagaatggatcgctgatcggttcattgcctctctctctgctgcaggaggaaggatctcaggaagtcaccagcatctcacctctccaggtgggcaattaacgatggcgagggcacaccctcacccctgagcgtgccttctgcaccagcatattgcttgttggcatttttgatcaagagacttaacagactgctgagaaatttgtacctggtttttatttgttaaaataatattacgtacaaattttacaaactcatctgtgtttctcccacctaacagaacagcttttattttccgtgcatccttccagttcatccataggcatatatgtatgtatttacccatggttgtaatcttcatcgtcgcatgcatgcatgcaatttggttttccgcttccttcttctgagtggatattgtgaccatttctccatcctgtcatagcgacaaagctgatggtttccaggaatggctgcattgggtaggtggagctttccacagttgagggtgggggttggctaattacagctaggaagctagtgcacagatgaaatgatgtttgatttttttgtttttctctctgttcagtatcccctaccagtagagagggggatgtccttgagagtggtcctggggcagccctggtgccacggggaagtagcgccgctctgtggagagggctgctttgtgaatttgccggctggtagacaccgtgatccattctattgtctcctcattgttcttctccttgggagtcattcccattccagatcctcaagtaagagcaaagtagacctgtaaggcacctgggaggttatcctgcttactatctttaaactcttgacctaagccatgtaggaagaaacacattttataacacaactcaggatacttgtacaagtatatcaaactgatacaaaagtttctccgaacaatatttactcttaacgacatacggtgagcctgatactttctatcctactctatttggttaaaggagaacaacaacagaaagtgctggtcacgacccacaaatgcatttcatgacccattaatgagttgcagctagaagttagaaaaacacttatctcacccaacccgttattagacaaatgggaaaccaagcccttggaaagaggaagtgacttgcccacagtcccacgtctggacctagctggagggctgatgttgcctcagtatttgactaacctggaggagaggtggggcatgctcagggatcccgaggaagatgctcgtcttctgtgtagcgggcaacagagggcagcacggccgccgtcctcgtctccagcggcgtctctcctctggctgtgggaacacactgctcctttggtgccactctgagctgctgagaggcagtcaagttcatgcacatagtgctccccaattctgtgggattggacagtgtccccaagaggactcccctgaaaatcttcttagtaaaacaaaaagggaggtagagtctccctgtgcaaccggtgcacctgttccccctatgcctgctggcttccagaagttcattcgtatgccaataataagagttggttttgctagcagtgggacagcagagatgggcatgtgtgaggtgtgcttcccggtctgaggcctatggcagagggaagggagggccggggatacttgcctgcctcttccctggcagatgctcccacccgggcctttgtgggcccagggccatgggccggctgccccgcttgtgttatgaatgtcacaggggggagctaacgaggttattgggcagagaaacactctcctgtgacccatgtggaagagacctacagcagagcaagaggcagggaggctggctttgtcacactgttcatggcgacagagaaggcgtaggaggggcgggtggacagcaggcgtgggcgcagcaccattatatacgtccctcaagaggtggagatggtgagagggcaatggagaaaaagccaaggagacaggcagatggccaggtttgctctgcgttcatgatgggaggggagggctgtgcttggctcagggatccacggtgtctaacaatgctgctaacttgatgctggggcaatgggctgaccattaaaagagctgctgtagaaagtgtgtttgtaatagagtgtgtacaggaggaaggggaaataggagaggggctggtttttgtagatttaacctgattgtttttgctgtaagttgaagggtgacccacggttccctgtatgctgtgtctcctgcccccacgtgccccttccatgtctacacacagtaagctcactagagcaatgctaaaacgagaaagagtacgctttggaagacttgctgcactccaggaccgtcactagcgtgatggctgcaactatacccaccctaatatctgtcaacacgagcaggggcaacttaaactctcaaaagtctcagggttctcacccataccattagggtgacgctcgtgtgcatcttctgtggctgatgggtaaattaaacaggacgtaatgtgtagcgtactgcatgtggtggtcattggtagctgtcagcagctgtaacaggagaagttggctgtctttatttcccctcgatggaccaagcagctgctggatcatggccacccagcccctctgaaggagtgctcggaggaacacaagggggctggtcttccaagaggagccctctagcatggcagtggacggggttcaagcccctctgatttattatcctcattctgcacttccctgtagcaagtcacatttttttctcttagcaataaaatggggccttcagtctcatgagtcataacatcgaaaccgagtcacccatctgattcggatgcaatgattaatcttcagtgcttagttagagccctatgttagggttagaatcctctgccctaatgttctgagggttcttgctgttgggccagaggttgggaactgggtggaactcagcccccactcgcccactccctgcattgctgcttctctcatttccttttttagatcaaaccttttttttttttttgggtgggggtcatattaatcctcaatgcctgtccagagactataacaagatcccatctgaattagcattatgcatagattttgcccgtttctcccatctccttgtactttccctccttctcacatctggagcccctggtctgtcctgcttgcatggcccatggggtaccttgtctgcactggtctcaggcattctctgctctgttcccaccatcacctctagaggagactatgactcgctcaccttgctccccccaccagggtcaagaatgttaactcagacatgcttaatatgactgggatctggggattggggaccttgaatcctctgtgcattcattgtgtgcgcttagataagctgtcttccttccctgcctcagtctccttcgtttaatctggaacagccatggtgatggcaaataaacacaggctccttgtgaaagaactcgagggaggacatgcctgtagggcacggggtcactcgcgccgctgacctgctgccgtcctgtttctgagtctctgcagtctcgggagctccaggatccaaattcgttctgtgccctgaccttctgcctctcattccttgcagactttaagtttgccatgtacccaccgtcgatgatcgcaactggaagtgtgggagcagccatctgtgggctccagcaggatgaggaagtgagctcgctcacttgtgatgccctgactgagctgctggctaagatcaccaacacagacgtggtaggtggccaccaccttcttggctaagtccagatgtctcttctcagctcagggaaggagacgacggatttgattatgttgtgtcagaggtatttttctggtttgtttcctaagatcgacatccaagggagtgcaaagttcagcaggtgacaccccctcttaaggttctgaaaagctgtgcacgggaaaatacggaagaaaactcagcaagcagatgaagggggtgggggtgggagggctgtttaccgatgttcctttatggcgtgggcttctcagtgggtctgaattgttgcttcattgccatatttgtacacgctgccaggctgcctctgcccggcagcgaagagctgccgtgtctgctttcacacgctgaggctgtaaggcgcacagaggagaaaggagagccaggactcagctgcagtggatggagcagacacacaagaggtgccccactgtgagaacggtgtccgtccctggcaaacctctcgacccctccccgctctctcttcccttttgttcaatgcagtaatggattacaaagtgctttcaaaagacaaagtgccatacaaactcaagaaactattattagctacggagcttccccattctgtgtgccctgtggacggcccagaggctgttaacttcctgttgccagaatttggagctcctgagaagaaaggttttgagagagaccagggtcaagtgagcctctgaattcaatcagcaggaagctgcagtcctagcccgtccgagacaggatggtgccaagaggtcagagaggccattccttcgttttccacgggcaggacagggactgaagtaaccagccaggagcggggtgggcagtggctgagctggggctagaacccccaggctccggctgccccctggaaacttcccactccacccttgttgccgctcctgggatcttttggtttgaaaaaaaaccctggggtttaaagtcaacctgagagaggggtgttggccctgagccctcatgcatcaccatggagaggctgaagaatgctgggcacttcacgatgacaccctctggatggtccggggggattcagatgccctctgcgggcttttattgagttaagggatcatgtggtttataggcctatggctgaggcctgcacgagggatacgggacaggttaaacctcagagagcccacggctgcagctcgccggcctcctcgcccgcccacctggattttccctggcatttgttcccagctcagagaaatggcgcagggagatgctgacggagcaaatccggggtcctcctctgagatagttcgtagatatggttttaaaatgcgggctccaaacatacgctttttaaacgaggactccagaacacagactgaaaacctccctccagtgcagcatgaagaatgcttttctaatcctccagaggaaaatcgtggacgggacttaacgtttatagaaatggtacgctttcctccttttctgaatgtctccaattaaggctgccttacaaataggactctcagccagtttaagacaagcccttcctcaatgcctggagacaaaaatgtcagtgacaggagttggagcggccacccccctcctcctgcccccaggcattgtaaccttttcccccgatgttgatagacctgctctgatgggctgaccaccctaccggctccagccttttcccacctccctttgtcccccgttactgatctcacatggacagtggtggaaatttccctcctgggagttgctgctacgtctcttggcttttcgagaccgcaggcaagtcagtccgtcatctcatctggggaaactgtttgcctttttctgatactacgtagccagtccatttaagtcagctggccaactctgttaaatggatatgaagtgggtacgaagctggtttaggggtgtcctcctataaatcctaactgttggtcaagttgatatctcatttctataatgggcacacgccgtgtttcctaactggggctgcctgtgtgtgcctcattcacaccggtggacctgggttgaacatgttcatatttaaaaaccaagagtgaacgcggtgaaatgtacaattcataacactttttcaaagaaaaatctgagccctcaggaagttccaggcttacctctggcaccccggaggctggttcgctctccctgaaaatgtttttagtggaaaggttcaagcagctctgggctaggctgtgtgtgtgtgtgtgtgtgtgtgtgtgtgtgtgtgtgtgtttatgcacctttccaagtgctaaatctcctcccatccatcagcctgtgttctctgaaaagctgacgctcagagggaagaaaaataaaaggactagaatttagaacacattagtgtttggagggaggtgagttgtgcttcctgagctctgtttaccatttcacgagtcaagaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacccaaaagaaggagctcatcaggcctaacgtagaatgccggcctcccagcagagaaaacttggtgatagaaactgttcttagagtagagaaacaaaatgtatgggcacgcaatggaatattattcaaccttaaaaagaaatgaaattccgatccatgttataacatgggcgaaccttgaaaatactatgttaagtgaaacgagccagacacaaaaagacaaatactatatgattccacttataccaggtacctggaatagtcaaattcgtagagacagaaagtagaatagaggttcccaggagtctggggagaggagaggatggggagttagtgtttaatgcgtacggagtttcagtttgggatgatgaaaacaattctgtagatggagagttctgatggccacacagcagtgtgaatgtacttaatgccactgtacatttaaaagtggctgaaaagggaaatttgacattatgtgtatttatgatagtaaaatgtgtgtgtgtatatatgtatatacacacacatacataaatggatatatatatatgtatgtatgtatgtctgaaacattctcgggccacgctatgaaatgcccataggttgatgttgagctcttccctggaaaagtgaaatacacaggaccacattttgccccctggccctagtgcattgacaaacgggaatcaggaagagctgacagtttcccccagagcccctgaagttatatgtcagctcctacacaccttggtggacatgatcccttcaagctggcatagctctttgcttctttgtaggttaggtcgtgggctgacagcgatcgagctgtgaaaagaggacacccctgattcttgagagatggccagactagtctctgtaggtcattggccagaagcagacttgcttgatatgaggaacgcatactgctctnnnnnnnnnnnnnnnnnnnnagctgacagtttcccccagagcccctgaagttatatgtcagctcctacacaccttgctgtttctgatttcttcaagcttgcaatgctctctgttactttgggggttaggtcgtgggttgtcggggatcgagctgtggaaagagggtccccctgattcttgtgagatggccaggcgagtctctgtggttcattggccaggagcagatagctttgatatgagggacgcatgcggctctgagaaagtcggcctttgttgctccgtctggttgccaaaataaaccagaacgcttcattccaaagagaaagctgagtgaggggcctgacagttttatagggaataaacgtctcagagagtggtatattttaaatactttttccttccaatcgtaagagttgctaaaaacagccagagaggcagtttggctgtaggggggacgtctattgggggtgtccagtgcctgggtaggtttgagaggggagggtgccactggcctgggtccccggtgaccatggccctgcttccttgggctgaatcggggtcctcttccatcccctctgcacactagtcgggctgcgtgccagcattgatctcactgcttccttgtctatagaacctcttgaataaggcccagcttttcctcagctctttatccagagcccctggcagagtcattgggagtgatgcttaagagaggaagggaagaggaaggaaggagcaaaggacaaaggcaggcagatgggtttccagtgggtttccgattcactggtctgtccatgtcctttgaaaagctgtgtcttttctttaacttcaattctgtgtcagggccttccgagccttctgagttttccccaaccttatcttagagtaggttaaatgaagtggcttcattttcatatgacacagttgcacaaattcactaactaaaaaatggaatggaggctcacaggccataaaggtgttgtgaagttattgcaagatacttaacagaagaaagactctagtcatctgttccttatatttatccttttttgtctaagtcacatcaaaactctttgtcacattctttaaaaacaaaaagcaaaaaacaaaactttagattcaggggatccatgtgcggtttgttacgtggatatatcgtgtgatgctgaggtttgggcttcagtcgaacccgtcacccagacagtgtacgcagtacccaatagggagtgtttcaactctcgtccctgtccctagacacattcttaaatattgcccagagaagattccaggatatcccttccttagggtcatcctggcattttacggtcctggttatcagtgagctattaaaaagcagggaggtggaggcgccgtggaagaagtctcagtttcgaccacatgtgtgtgattcatggggtttagcattgtgtgtttctgctccgtagctggaagtgccgccaccctcgccccacatgtcattttcaagcctccactgttacagattctgtcttctgtggactcttcagggcctgtggtcaggaaccttgtgaagtgttgctggaagctgggggtggggaggtggaatagaatcgggggctgatgcctccctctcctgcctcatttttctgtgggcctcatttggtatgcaaggaaataagccaaacagcctgtgaagaaaggaagaatgagatagtttcctaagttgtctctgcctgagttggccgcgggtctggggctcattcagccctttgtccccctgttgagtgcagtgcgtgtgtggtgacaatgaggtggtgcagttacactgagggctaatggtaggagttccgtcagcccattcatggaggcagaggagggtgcagggcgcggagctcgagccagcaagcagaggaagtcagaggcccttgtaacgagctgaagatcacaaacactgctgtgagggctccaggcttgggggcgggggcagccaggagggaagggggcaagggagggggcctatcatcatagaagttggaggtctgcccgacccccagcgcggtagggtaccacctgtccaggctgacagacgagcattatggcttcccttttaatcagcttaatttggggcatcttaacacaatggctggtgctttggaggctgcaggaaagctgatgtcctagagccgccacacttgacatgcgtgtaacaccttttgattagaggcgctttcgtgtttttccagccacttgggctctgtctctttttcttggagattctctggtctgtatgtctttacttagagcttagaagtcgaggtatataggaaaaaggagttctgaaattggaggcttgccctttctaaagccagtctgagctttcagccagatgtcactgggacaagccacgtcaactctccacgctccattccctagctgggaaacgagggcatttggctatttgatttccagaggccctttggacctccaaattctccaagtctgtgattatttgtgtatgtcttcttataatccagcccctttggaagcactaactccactcttctctcagcttgatcctctaatagaagcaacctggttggatttaaggtggaggtcttcctctctccaggtggctgccctcatctctacccccaccccaatcccatgcattctcctgccctcctgctttgggcaagacccaggcgatgtggagttggcatgtccagttgcaggtatcagcaccactgcaccatctcctctgccttcacttcccaccagcacacagaatttatatgcccttcccaagtccaaaaagggcccctgccatgctaaacaaaggtattcatatgcaaggcatgagctctgtctcatggaagggagaggccaagttctctttccaccatcagagagtagcgttcaacatcatttatacaagacaggcttttgcccttttagtcttgctgaactagaatgagggatttgtgtagtcgaaagtcaagctgatcattgtcaagtttcgtggaagtggaacctgaaggaaggttaggtggagactgcagagagggttagcgtcctgccttaccacaaggtaagtctagaagagggtggggaagggagttcagaattcttcattcatggagtgtacctgccttggtcatccttttatcttccagtcagaggggtcatcagtcaagagctggccaggctgggtgtggtggctcatgtctgtaatcctagcactttgggaggccaaggcgggtggatcatctgaggtcaggagttcgagaccagcctgaccaatctggtgaaaccctgtctctattaaaaatacaaaaatcagctgggggtgatggcgtgcacctgtaatcccagctacttgggatgctgagacaggagaattgcttgaacccaggaggtggaggttgcagtgagccgagatcgcaccattgcactccagcctgagtgacagtgagactccgtctcaaaaaacaaaacaaaagctggccgtagtcaagtcagtgatgatttggattgaaattaaaatgtgactaaagagagagtatgcagttttgtctatctatgaaaccttcctctgttttatgtgggacacctgggcacccactcttggctggaacttacataaaacactactgtgcacgcacatgtcacctcaagtcccgtggctctgaaagtccagtagaagtgacagccagacatcccagtcctccctgtagggttttctcagaactgttcctttaaggtctcaggctgctggaagggagggctgatagcagaaaaagtggggacactgggaactccaaagggaagacgcgcatggcctgaaaccgagttctttcgctttctggagcctggtctccctatgtggagggtcatgctggcatggctggcaatggttaattcaccgatggccatggagtcccaagttggccatattattgcggtaaaagatacattaacccagatgaccttgccgggggccagaatagagcccgtgaggaaggagagcaaggcaggatcggccgggaggcgagagggattttgttgaggagcaaggtcttccacaggaactgcgacttggaaagtattcaccaagggctgtgccatgcgaaaccctctttaaaggaaccgcatcgctacgcctaacgggcatttcttttttaatgtaatggttcagagctattgtctaccacgcctcgcgtgcacacgcacacacacgcaagttccctcagtcagccgagaatcctgccatctcttttagataacaaaagctcttaggccttatgctttgggtaggatttgtcttccatggacaggtattcagttggaaacaagtatatagtcactgcctctatggtatggagatactccgatttagtccctctgcctcttggggaaaaaaaaaaaaaattgtaaacatccccttcagcagcttctcaagtccctgtacagtggaggaacattacacgtgaacttcctggattcaatggattcttctttgcaagaaaaaaaacaaaacaaaaaaacagagaaagaagaaaatatcaatttagattgttaggtccaacgtttcactcagtgagtgagcacagggggtgacggaggatggctggaatgtggggttgaagctgctgttctgggtctcagctcctgcccatgtaccgtggagtgagcatctcacaccacgatgattctggcatttaagtgaactccttcacacggtgctcaagtggagaaagggctgtccatgtctatcccagcttagaagaaaaactgatggtatgagacttgccattcctctctgatgtagaacctgcctaagggacattccacagcagttctgaccgttgtcactttgtgccttaacccccacattcattttgattctatatttagtattaaattttttagattattaggatttaaggttttcaaacatctactgaaatgcaagtgcccctagaaacattatactttcaggccgggctcagtggcttatgcctgtaatcccagtacttcgggaggccaaggcgggcagatacctgaggtcaggagttcaagaccagcctggccaatctggtgaaatcccatctcaactataaatacaaaaatcagctgggcgtggtggcacgtgcctataatcccagctgctcgggaggctgaggaaggagaattgcttgaacccgagaggtggaggttgcagtgagccaagattgtgccattgcactccagcctgggcgacagagcaacactctgtctcaaaaaaaaaaaaaaaaaaaaaaaaaaccagaaaagaaaagaaacattataccttaacttttcgcacctagtgagtgataacctatgaggataatgctgccacatggtccttgagggaagaacttggggaagagccgaacagggatgaggcaggtgagccccatgtgatttatcgtcattcattcagctcaacaggtcggacagggtaagggtaagggatgtaaccaggagatgccacaggaacgtctgagaggtgttagcaagtcccagaggccagcgcccgactccatttcagcctcgttcagggtggcacggagactcctgctgctgcgtcacgtctgtcatgttcagcactcttcccagacacacagtcttgactaaagattgtcaggatcttgacacacgcttcattagtcttgactaaatgcgaatctatacctcatttcaaagaaatctgaattctttaggttccaggaccagtttattgttatacataatcacgatcatttattgagctccacttagcactgcacatatatcagtatcatctcagttgccctttactctgattattttgtggggaaactgagatcagaaaagttaaataacttaggtgccacctgcaagtatagtgggtgggcagcagataccacccttcctcatttcattgttccaggtgatatttcgtctctgcctttggcctttagtctgtggttgttcctaatcttagttttcattgaaagctgtagtttgaaatgtgggatagatgagagataggaaaggaaaatttaggggtatggaaattttgttccttagtggttagttccagctttattttgtttatttatatgtttgtttttaaagatcgggagcttgctgtgttgtccaggctggtatcgaactcctggtttcagcttcccgcctcagcctcccagagtgctgggattacaggcatgagccaatatgcctggccagctgtgttttagatctttgggaaataaagagaatgcttttgggcttggcaaaatagaaacctctgggtggggagaattgcacagtaaaagaaacaaaagggaagtttatattaaactatgaaaagacacagggaggttcaatttaacatatttgccttatgtatgtgcttcttaagagagtgcacaaaggcacctttgcagaggagagaggctagaaaatgcccgttagaagcaagtctacggtttgcaccctcttactagcaccagcaacggtccctgtctagtgatacccatgacttgtcattgcattgcatgtcatctgcctaagagaagctcctgcctggggcagacacactgtcaattacccctacaatatagactgatactaaagcaaggctgcatattcttgcttattcccaaattggatggctcaaggttccagaatgttgtagacattctgcattatatctttatgagagttaaggaaatggtaaagaagcagaaaaagttggggatttttttttttaagtatttacagtgaggcgcggtggctcatgcctgtaatcccagcactttgggaggccgatgcgggcggatcacaaggtcaggagttcgaggccagcctggccaatatggtgaaaccctgtctgtactaaaaatacaaaaattagccaggcgcggtggcgggtgcctgtagtcccagctacttgggaggctgaggcaggagaatcgcttgaacccggaaggtggaggttgcagtgagccgagattgtgccagtgcactccagcctgggggacagagtgagaaaaagtatttacagtttatgtgagggtcagtacgttggttcattggcttccttcttatctagttctcgggctgagtttgctaatgtcatagcacttctagtagccttccccttttctctgccacttcccagcttccccaggcagaaagcatctggtcggccccttgattaccaggcatccataagtgaccatcatttaggccagtgcttctcagaatgccaatcacctgggctccactaaaaggcaggttctgaatagctcggcctgggttgactgagattctgcggttccaacaagctcgcaggtgatgctgatgctgccagcccatggaccccacctggagtagtgaggttccttggcactttaagaacatccctcctttacttcacatttatttctactggaaactagcacagacttatgcaagctaaattacgcatgttttctccgtaggatgctctatgtcctgttcctcttactaacaactctggtctggaccattgttctaggattgtctcaaagcttgccaggagcagattgaggcggtgctcctcaatagcctgcagcagtaccgtcaggaccaacgtgacggatccaagtcggaggatgaactggaccaagccagcacccctacagacgtgcgggatatcgacctgtgaggatgccagttgggccgaaagagagagacgcgtccataatctggtctcttcttctttctggttgtttttgttctttgtgttttagggtgaaacttaaaaaaaaaattctgcccccacctagatcatatttaaagatcttttagaagtgagagaaaaaggtcctacgaaaacggaataataaaaagcatttggtgcctatttgaagtacagcataagggaatcccttgtatatgcgaacagttattgtttgattatgtaaaagtaatagtaaaatgcttacaggaaaacctgcagagtagttagagaatatgtatgcctgcaatatgggaacaaattagaggagacttttttttttcatgttatgagctagcacatacacccccttgtagtataatttcaaggaactgtgtacgccatttatggcatgattagattgcaaagcaatgaactcaagaaggaattgaaataaggagggacatgatggggaaggagtacaaaacaatctctcaacatgattgaaccatttgggatggagaagcacctttgctctcagccacctgttactaagtcaggagtgtagttggatctctacattaatgtcctcttgctgtctacagtagctgctacctaaaaaaagatgttttattttgccagttggacacaggtgattggctcctgggtttcatgttctgtgacatcctgcttcttcttccaaatgcagttcattgcagacaccaccatattgctatctaatggggaaatgtagctatgggccataaccaaaactcacatgaaacggaggcagatggagaccaagggtgggatccagaatggagtcttttctgttattgtatttaaaagggtaatgtggccttggcatttcttcttagaaaaaaactaatttttggtgctgattggcatgtctggttcacagtttagcattgttataaaccattccattcgaaaagcactttgaaaaattgttcccgagcgatagatgggatggtttatgcaagtcatgctgaatactcctcccctcttctcttttgccccctcccttcctgcccccagtctgggttactcttcgcttctggtatctggcgttctttggtacacagttctggtgttcctaccaggactcaagagacaccccttcctgctgacattcccatcacaacattcctcagacaagcctgtaaactaaaatctgttaccattctgatggcacagaaggatcttaattcccatctctatacttctcctttggacatggaaagaaaagttattgctggtgcaaagatagatggctgaacatcagggtgtggcattttgttcccttttccgttttttttttttattgttgttgttaattttattgcaaagttgtattcagcgtacttgaatttttcttcctctccacttcttagaggcattcagttagcaaagaggttggagcaacaacttttttttttttttttgcacaattgtaattgacaggtaatgaagctatttgttaaaatatttgcctttttaagtaaaaaagaaaaatcagaacagggctatttgaagaattattttatacacagattctgccttgtttcatagtatgagggttgaagacggaaaacaatctaagggtctctcatttttttaattttgttttgttcagtttggtttttttttttttttgcgctgctaagaagctaaagtcatccatccttattcacgttgacagtacctagctgtaatgtttcacagagtgtgctgctattttataaacatttttataatatattattttactgcttaaattccaagtcctgaagtagatggttgagatatgagttcttcgtactggaaaagcccttccgtagtttgttttcttctggtagcatattcatggttgtttttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccttcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctaagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgcctcaggaccccactggagagcacagcatgccttactactgggtcatccttggtctatgtgctctgtactggaggctctgttctgcctcttatcagccaggtcaggggcacacatggcttaagtgacaaagccagaggagaagacaaccctgacagcatcacgctgcatcccattgctagcaggattggcaactcttcagacggagctgcgcttccctgcagtctagcacctctagggcctctccagactgtgccctgggagctctgggactgaaaggttaagaacataaggcaggatcagatgactctctccaagagggcaggggaattttctctccatgggccacaggggacagggctgggagaagaaatagacttgcaccttatgtcatgtaaataattgattttctagttcaagaagataatattggtagtgtgggaattggaggtaggaaggggaggaagtctgagtaagccagttggcttctaagccaaaaggattcctctttgtttatctctgagacagtccaaccttgagaatagctttaaaagggaaattaatgctgagatgataaagtccccttaagccaacaaaccctctgtagctatagaatgagtgcaggtttctattggtgtggactcagagcaatttacaagagctgttcatgcagccatccatttgtgcaaaatagggtaagaagattcaagaggatatttattacttcctcataccacatggcttttgatgattctggattctaaacaacccagaatggtcatttcaggcacaacgatactacattcgtgtgtgtctgcttttaaacttggctgggctatcagaccctattctcggctcaggttttgagaagccatcagcaaatgtgtacgtgcatgctgtagctgcagcctgcatcccttcgcctgcagcctactttggggaaataaagtgccttactgactgtagccattacagtatccaatgtcttttgacaggtgcctgtccttgaaaaacaaagtttctatttttatttttaattggtttagttcttaactgctggccaactcttacatccccagcaaatcatcgggccattggattttttccattatgttcatcacccttatatcatgtacctcagatctctctctctctcctctctctcagttatatagtttcttgtcttggacttttttttttcttttctttttctttttttttttgctttaaaacaagtgtgatgccatatcaagtccatgttattctctcacagtgtactctataagaggtgtgggtgtctgtttggtcaggatgttagaaagtgctgataagtagcatgatcagtgtatgcgaaaaggtttttaggaagtatggcaaaaatgttgtattggctatgatggtgacatgatatagtcagctgccttttaagaggtcttatctgttcagtgttaagtgatttaaaaaaataataacctgttttctgactagtttaaagatggatttgaaaatggttttgaatgcaattaggttatgctatttggacaataaactcaccttgacctaaattatctggccgtttttgacttatttataaaccagcagtcctcagaatggaatacacttgtctcatgtcagaactgtttcatgccgctgcaacatttggcagtggcataaaagacacattctaacctggaatggaatctacatgtgcctctgtgttatggcggtacaagtcattgttgacattgctaggggacgaggggtgcccatgcagccagcttataagctagaagcctcagtccaccttcagaaggtgggtacatcacagacactatgactggtcctcagaggatcgtccctgattgttgccagctactcattctgggctgtgaggaagcatctcctggcatgagaggtaccagaagcctgcggtgccatctccagagtctagggagtctctgggaaccctgcccctgcagctttcctggctcctgcctgctgttcttcgtggctcccacctgatttctgatccttcctgcacccctcttctgagacacaggccacaactacctttgctggagtctggagaagcagagcctgggaatgggatgtgacagtctccgtactgctgaaatgaattgccaggccctaggcccagctgctcttggaccttagctcagaccagcttctttcccgagagtgatgggtgtgcagaagacaagggcctaatgaacacttttttgtgtgttttgtttagaaacagggtcttgctgtgtcccccaggttggagtgcagtggcacaatcccagcttgctgcagcctcacactcctgggctcaagcaatcctcctgcctcagcctcccaagtagctgggattacaggcgcccaccaccacgcccagttaatttttttattttttgtacagattttttgtatagctttgttgcacaagctataacagacattttgatgttactgtaaaattaattttttccaaagttccttgtctggaagtcatcgaaggctgttttccattttaattctgacctgagttgtaaacaagatttaaaactggccgttggggaagtccagattaagatattccaggctgatctcaagtaacttcacttaataggacttttaagcttacaaggaccctagaaattcccctttgttcccattccccttgacatccgccattcttagcgacaaatgggggtaacttttttcttgggtttctgcctagtgaagtctgctggcctcctgggagtttcaagggcctctggttgccattcttaaccatccttggaattctctttggcatgacataatgtccaactgggttcctctccctccctttccctatctttttgctctgtaggatcaatgctatatctgtttatagcatgacaactccactccctctctcaaatgccacccagcaacactgctgggcttcccccattctgaacaatggatgttttaagggcgggaagagcagatgaagcacacagccgagcagtgagaaatctgactgtcccatctacgctctttcagacccagatcatcttataactggaaaatctcaaacttggaagtgcctttcctgaaagtggccattaaaaatgcagtgaagacctggaaatccccgatcttttgtgcgtgttcaagggagtgcttttgtatctctaatgactttctaagatttggagcttttatttagtatgcagaggtatccccaaaattcaccttcccagttggcttagcagtaatactgtcaaaatactgacacgaagcaagtactcaaaagctgaatattacaccagattacttccctgctctcctggcaattacagcaacagcaaaaatgctgtggacagagtagggagattcagagtatcaaggtaagcctagtactcacagccgatgtgttatgtggggcctgtactgagcctttaaggaaaagcacagaaaaaaacaggacacacaggcctatgaaatagcagagagaaacaacagcaaatgcaaatgagtctggggggaaatcgatgctaaggtgtgg

SEQ ID NO: 11999 - DNA, 7480 bp, Human
tttgatgagtggccgggcgtggtggatcatgcctgtaatcctggcactttgggaggctgaggtgggcagatcacaaggtcaggagatcaagaccatcctggccaacatggtgaaacacagtctctactaaaaatacaaacattagctgggcatagtggcacatgcctacagttccagctacttaggaggctgaggcaggagaatcacttgaacccaagaggcagaggctgcagtgagccgagatcatgccactgcactccagcctgggcaacagagcaagactctgtctcaagaaaaaaaaaagtttgatgagtgtggggctagtgttgtgatagtctcctgtgccctgccaactcttttggattattttttaaaatgaggaacatttcagatttagtttgtagcaattcaactttgggagtcttgcaagaactcacttattttaatggaaaatagcccaggttgtctaccagcttttcctgagctctgttttgggtgttctacccaaaataaaaaacgtataaacacaaaaatagtaatgttcatgtctgtgacagccaatgttaagtctctgctgttgtctatggctgttatccaaaaagtagattcaattctgtcatgtattggagtctgggaatgttgttaagagatacatacattgaaatttggagagctgctctgtatttatcaattaggcagtaataatcttggatgaaggctagtcttattaatgttgtgaaccagtcttattaatgttgtgaaccagtagtgtccccaggaatagagaacactacactactcactttgcattttcttatccacataatagaattagttagtgataaccctctttactcggaatcgattgctgccacatttctgcatgatacatagatctctgcaaatatgtgatttttttcctaaatggagaaaatccaaaaattcttcttaaaatttttcatgggcatacaagaagataggaggtgacatcttaaaacaagtatctctgaactttttgtataaaaaaaagcaacctctttgctctattattaataccacatgtggtgatatgaatgcccaaatgtagacagcagttatgagatattacaagagaagaaaaaagctctgccgcttatggcaacttacccaaaaagttatctttgacttaggctggaggtgcacatagcatagctcctagagttctgtttatgtcatgaatatttgttactcaaaactccataggccaagagctcctgaagagaaggtcacatgctagcagcaattgtcattttttccctcaaatattgctatagtataattttgtttgaattataaacttcagtctttattatatttgattctggcattttggtttgtagtgctatagtacaggaaatgttttaaatgctttgcctttatgtaagtgaatatcggtacacacacatacacatacacacacagacacagacacacacacacacacactcacagccagtttagaatgtggggtaaggaacaccagacaaagagggcaatataagaaagagaagacattgaaaacattgggaagaggcagtaacagagtgccagagaagataaggcagctgggagggggagaaactaagtgaggtggataaactaaaagcatccttctgggttaaagcagactaaaagcttagcaattgcttaatatcaccatcttatcctatagatgtgggaataaaggctaaggaaggagaaatgaaaatgcagaatcatatgggggcttttccaaggaggtatgaaggaaggtgaggacagggagagcggctggaagtcagggggtaagagaaactctaaaaatcagggcttgagggaaataaaaggtgaggtaagaggctcagggctgtgggaggcacatttttctctgaaaagcagtttggatgaggaagagatttggcagttggaagagagaagaagtcactacagggtactgaggaaaagctttgctgaaattggagatcaaataccagctctgccagtaagaagttgcatctcccagtgaaatgctgctgctgccatttcaactgttagctgttctctttcctggtggtaacagtgaacatggtaagagtcactctggcagctcccagcactggtgcaggggtttggattttaaaaagcaagcagggctttcctaggtgcaattggacactaagggtctgggtctttctgtctcccgccctcttcaaccattctggtggttgggactagaacctgaagccttaaggcagtcaaatgtgtcagacttcctgtgttctttagactctaggttcttgttttctaaatcattttcattcccattcttcctaattgtctcctgcttctctctttatcttcaccatcttgcttttccactcttcacagccttccaggggccgacctcctttcatgttatccagacctcgtcctttaccaatagtacctgggcacaaactcaaggctcaggctggttggatgatttgcagattcatggctgggatagcgactcaggcactgccatattcctgaagccttggtctaaaggtaactttagtgataaggaggttgctgagttagaggagatattccgagtctacatctttggattcgctcgagaagtacaagactttgccggtgatttccagatgaaatgtgagtctagtccaccgaactgggaagagtctcaaggactctcttttctctcttttttgcaaagtgttgctctctctgatgcttctcccttcctttctattttacccaaatgcacgcacatgcttttcttgagtagtctctcactccagcttcacaccatcacacctcatatttcagattcttgctgcctctgcactcttctcttactctcagactgtcttccactttgtaaccagctgctggtttgtcttatgtgaaacttctcctcaagggcccttacttctcctaccctgtgcctgagtgatctaacgtgtggctttctcccctaatccatcttttcaatcatctcctccccgcaccctcctcttgctgggaacctccactcactctggaatgctgcactcctgactgcaccacgctctgcctcacctctcctttcatactcactgtactcctttatcacatacctttgtcttcatggcatgcacatttttctcaatgctcttgtttctgaaaatgtctaaatgttatcattagtttttagctcatcatcattttacaccaaataactttatccccaccaaaatctaaaatcctaggttcttttctcatgcctttttttcttatttgtgtttaataacttgctctcttttccctctacatagacccctttgagatccagggcatagcaggctgtgagctacattctggaggtgccatagtaagcttcctgaggggagctctaggaggattggatttcctgagtgtcaagaatgcttcatgtgtgccttccccagaaggtggcagcagggcacagaaattctgtgcactaatcatacaatatcaaggtatcatggaaactgtgagaattctcctctatgaaacctgcccccgatatctcttgggcgtcctcaatgcaggaaaagcagatctgcaaagacaaggttagtcctgctgttatttcacttcccaccacctcctctaagatcaagagtaggaagatatcaaaggataggagcttaaataacaagttatttggttcccaaaggagtgaatggggtcgctgtccaagcttgtaggtttctgagttcataacctctgaactcgagttataacatgacacttttttttctccttcctgccttagtgaagcctgaggcctggctgtccagtggccccagtcctggacctggccgtctgcagcttgtgtgccatgtctcaggattctacccaaagcccgtgtgggtgatgtggatgcggggtgagcaggagcagcagggcactcagctaggggacatcctgcccaatgctaactggacatggtatctccgagcaaccctggatgtggcagatggggaggcggctggcctgtcctgtcgggtgaagcacagcagtttagagggccaggacatcatcctctactggagtaagaaatagcagggacccaggctggaaatgccaggaagtgatcttcaggcatagagggaggcactggggaaggatagagcttgagagatgaaagagggagagattgattgattgatttccctgaccccaatcccaacaggagtaaaaatagataatccaagttatcaaaaatgtaggaattaaggacctgtaaactgggtagaggggatcaaaggatggatatatggtggccaggaatatgagagaggaagttggaaatgaccatacattggaagtaggtgggcaaaggaaggccaaggaattctgtgtatagtatctgaagtgacatccttttgtcctctctcaattgccaggaaaccccacctccattggctcaattgttttggcaataatagtgccttccttgctccttttgctatgccttgcattatggtatatgaggcgccggtgagttgtgggtggtgttgtttttttttttaatatgtcttttctgttcacccttccactgttttttaccattttatctatttaaaaattgtttatcctcaatcctttcaccatatcctttccccaaactcccattcgttttatgtggacttaaaaaaaattctgttaaaatacacataacataaggtttaccatctttaccatttttaagtgtacagttcagtggtgttaagtgtgttcacattgttgtgcaagcaatcttcaaaactcttctgtcttgcaagactgaaactctattcctattacgctgcaagttcccatttcccctcttctccaggccctggttaggacagctctacattctgtctctatgaattctactattctaggtaccttatataagtggaattgtaaatatttgtctttttgtgacttatttcatttagcgtaatatcctcattgtagcatatgaaagggcttccttccttttttgaaactgaacaatattccaccatatgcgtataacacattttgttcatccattcgtctatctatggacacttgggttgctttcacttttaactatcatgaataatattactatgagcatgggtgtacaaacatcttttatgtggagctcttttgttcttctgtttttaacaggtcatatcagaatatcccatgagccatcatcatgtctcctctcccattcgcaataagtaccaagaagcccaagatatcagcccaaaagtcaatcttatcatatttcaaatgattttcaaatttgatgaaatcagagttttcatgtattttaaaataaattattatttaaacatcagcaaaaaagtacttaaaactgtaaatttattatgagactgtactaacagtgtgattcaccctgattttacacacattaaaatgttagaaaaaatgtgtctcaaaataaatgaaatataatacatatgacttaatggtgactccctttggcttcctaatttaaaacttttctttttctgcttctggttaaatatcatttgtcaaagaaaaccaaatataattatgccagaatcactgtatttgcagagatgcagagccttttggatgtaatttcttctctgtctctgcctggatgaatttctagccctgaaggctcagctgagatgtttcttcctcaggaagactttcctagtgctataataaaaggaactatgcagagatccactttacactttactcacagcattggagttatttttgtttttcctccccttctctttgtaagttccttgaggacagtgttccctatttgtagatctctggcaagatctcttagctgcaaattcattttctcagtaaaaactatctgagttgctgtaactgccaagttaagtgttttctttcagagtcatctactttcttccatttttttttctttttagttgatattgtagattctcctcatcttgctaaaatagtttccacttagccaaaaaatattatgttttctttatttctgttccaaactcctttggagaaaaccacccttggcttactacagctatagtctagcttttaaagggtcatagtgagaggtgaagccagctgcactccctgggttgagtggggactcctataacttttctgtagctagcaagagttttgtaaaatgcaccaatcaatgctctgtaaaaacacaccaatcagtgctctgtagctagcaagaggtttgtaaaatgcaccaatcagtgctctgtaaaatagaccaatctgcactctgtaaaatggaccagccagcgctggtccattaattaataattttataggggccaagcgtggtggctcacgcctgtaatcccagcactttgggaggccgaggcaggtggatcacctgaggtcaggagtttgagaccaggctgaccaacatggcaaaaatctgtctctactaaaaatacaaaaattagccgggcatggtggtgcatggctgtagtcccagctacttggaaggctgaggcaggagaatcacttgaacccagcaagtggaggttgcagtgagccaagattgtgccactgcactccagcctgggtgacagagcaagaccctgtctccaaaaataataataataataataataattttatatgtgcaaacataaagcagtataaaaactatcctttgctcattagacagttttgaaaaaattatcaactcatgattaaaataaattttagatattgtatcatttcatccttaactatttcaacatgtctttctgtaacatatagacttttttaacatatagccgaaattacattatgacatccccaaataaaagatttcttaatatcattaaatatatagttgttcagcattcaaattttttccaattgtctcatgaattgtttttacagtttattcattaaattggaataaaaataagattcatgcattaaaattagttgatgtttcataaaccgtttttaatctgtaggattcttctctcatttttatcctagaatttgttttttaagaaatttcatcattcttcttgtaaaatcatccacagtttggattttgctgattacatagctataatgtcatttaacatgcccctttgttctctttatttactatatataaatagatttgtgggccgggcatggtggctcacgcctgtaatcccagcactttgggaggccgaggcgggcggatcacgaggtcagttgattgagaccatcctggctaacacggtgaaaccccatctctactaaaactacaaaaaaaattagccgggcatgatggtgggcacctgtagtcccagctactcagggaggctgaggcaggagaatggcatgaacccgggaggcggagcttgcagtgagccgagatcgcgccactgcactccagcttgggcaacagagcaagactccgtct

SEQ ID NO: 12000 - DNA, 12416 bp, Human
tcttgttcttgttctttctgttctcaaattttcaatggttaactctttcctcccatttttatttaattccacatatgacctcctcaacaagaccatgcctgatgacctatataaatgacctcacatccattcctatgtattacctggttctttgcatgtagcagcctaaggtcatacacttctcaaccaaacaatcctacgaaccccaataaatagcactccatattttagaacttttagagttttatacatatttttcattcattcacgcattcagtaagggcatggaatacatactagattccagttactacggcaggtgttagaggcacagaggagacaagtcaaagcccttgccctcaagcagcttacagtctagtaagggaaacagataataaaccatgatataatatcagatattgacagcaatctgtacaggcacagagtgtgaggttctattttacatataatagcaactgacaatttctctgagcaggtggcagctgaagagtgagtcggttaaagggagagcgagacatgcagggagatggaaaaagaatcttttagagaaaaagtaaaagccctgtagtggtaggatgcttggcatttttaaggaggaggtttctgtcagagaggatactgaataataggaaaaatgataagagaggtaaccaggggccatattatgtataaagcattctcaactattaggtctttggattttacggtacatttgataggaagcctttcaaagtgcagtggggggaggagttaaacacttcaccaaaatcatatgaattaattataaaacaatggttctagctgctatgtggaaaagggactaagaaattgactgaaaaataggatggaagcaaagggagcttttagggccaacatgtacctctttgtgtcttaggtagacaaatgcatctaatggtccaactaacttctctagatgataacttccaacccacctatgcataaaatttaacgtctttattctaaataagtgatattaataataaaatttggggcaccaagattattaatcagagtggtattttgatttccctccttaaatcaccatacatagctttctgcattcatcttgcgttgactgtcattacttgtctgagtgagactgataccacagcgatgttttaaataataatcatacctcaaaagactgaagtctcagaggtatctgaagagaataacctagagcacagggggagaattgaaggagctgttactgaggtgacataaaagcagtctaaatgacagtaaaatgtgacaagaaaattagcaggaaacaaatgaaacagataatttaagataaacaattttagagcatagcaaggaagttccagaccacaagctttctgtttcctgcattcttacttcttactacgtgatacatctagtcaccagggaagaagcgaatgacacacttccaaaaaccaattcgtagctttctaaataaaaccctttcaagctggagagagatccatgagcatagagatcttaaaattcatgttcagcaataaatcctggggccccagacagtgtcaggtgcatagggggtgttcagtaaatatcagttaaatgtatgcataaatcgataaacgggattcctggaaaatactacactctccttctccaaattatcttcatctcaaagacaggaacctctaacttttaattctttacttagattatgctgtctcctaaactgtttatgttttctagaaatttaaggcaggatgtctcagagtctgggaaaatcccactttcctcctgctacaccttacagttgtgagaaagcacatttcagacaacagggaaaacccatacttcaccacaacaacacactatacattgtctggtccactggagcataaattaaagagaaacaatgtagtcaagcaagtaggcggcaagaggaagggggcggagacatcatcagggagtataaactctgagatgcctcagagcctcacagactcaacaagagctccagcaaagactttcactgtagcttgacttgacctgagattaactagggaatcttgagaataaagatgagctctgaaaattgtttcgtagcagagaacagctctttgcatccggagagtggacaagaaagtaagtcagatctgattgcctatttactctctggtatctctatatatgacattaatagtagttatacaagatatactggtaatctctctatatatgatatataatcttagagaaatatactgctaatctctatgtatgtgatatctaatggttgttagggaaggaagtgaggctttgtcttttagagaagacaggttcttcttcagggaagaggtaaacccctttttatctataagaagatagaatacctgagatgagagaaagccgcaaaaatgaatttcagaagatctttaaagatctttctctttgctttagtttatatcatctcagtgtttagatttaattagaaaactttctgctctagcccagttattctccatcatttttttcatatccatctgtacattctccaggaagtgttgtctctctttatgaaaaattctgttttccacataagcaattacattgtttgccttcctttgcattcagtgtctgctttcagtgtaccttatcctgtgttctcatgacagcatcctctagttgctggaaatgggcaagtttgccatctttgagagaatagctatatcagcagatgaaaatttacagtgtccatttgtaatttgctaaaaaaaaaagtcacaaaagaattcccgaaaatgcaatctcctgctttggtattctttataggactcttttcctctatttcatccttctatttaacctttccaatctctggcttcaaagactatgtaacttagaatttgttcttcctttcctttgtctctcagcaaaatataatcatcttagaaattttcctctcttctatttgtctattctatccacatatctagcttatttcctgttactgggattttgcctattgtttttctataccttacttctgtaaaatttgttgagtttttctatttatccctctttctccttagttaatgaggtaccctaaagcactagcacttaggaattagtctacttgtcagcaagagcgatctattaacaaagggatatgtaagaaacaggagaactaaaacaatcttgtggaaagggattattttctaagcgtgtgtctactatattagtttacttccgaaaaacatcagttacttctcataaatccatcctgtgtttaagaacataaaatatagtgtggataacaaatgcaaagcatgcaaattttcaggtaatcaggcgagccattacttacggcacaggtgtgccgccaaaaagaaataataataataataataataataataactactcaataaatagagagcataggtgaaagaaggacctaatacagaaatttttaacttttcctgatactgtttcaactttcttttgaatgtctgatttaggctgccctagtcatccttggacgttatccttgggtgattcaattagtagcaaattgagttgattttcaacttctccattaatgtgcaggacctgaaatcaaagcaaaagtgtgctgttgagggaaatgttttgtcacctaggagataagtcaagctgtgggtaacaatagccctcaattgtaatcccagcactttgggaggccgaggtgggcggatcacgaggtcaggagatggagaccatcctggctaacacgatgaaaccccgtctgtactaaaaatacaaaaagttagccgggcgtggtggcgggcgcctgtagtcccagctacttaggaggctgaggcaggagaatggcgtgaacccgggaggcggagcttgcagtgagccgagatcacaccactgcactccagcctggacgacagagcgagactccgtctcaaaaaataaataaataaaacagtagccctcattaatgggaataaagtatcatctgagagtcatcccaaagcttactccctcgttgagccgatgggctgactgagactctggaacccacgggtcactggggtgtgttagtgctcactgaggagacagagctgttgcaatactgagttcaagcagcacgactgactcacataatgtgaagtgaaaccagacagagctccgaacttggtaccttgggtagcaaaggcggcttccaatgatgattctataccggtgaacaaagaaaaatttgctttgagaagctgagaaaatcgagctagacggcagtgaagtaaaggcttctcttgcaaaatctgagtgccgatctgtgatgggaaaaataacttccagataaagcaaaagttgatgtggacaccagtacccagtaaattactgtgaaaaaaaggcaacttctcttggtccagtttacctttagataaatgttttaagggtaaaaatatgtgtatttcaagatatgtcttatgtaaacttttttaagttatgaaaatcatccatattgaaaaatagaatgttttctattttgaaactgttttgcattgtcagttacttaagcagccattttacattttggtttttgagaacataatagggacctgtatactccttgtggggccgcattttaagactcctgacagctcatcctgcaaaattaaaatccaaaatctaagtcgcaaaattctcttttctccttcctcagttatttacttagagtgtagaacagacatcctcttagagttttttgtaactatcagttatcgttaacatcatatttttattctaaatccttccatagaaacactgcttgttggaaaaaaaaaaggcttttactttgtttcaccattgtacagagggtaaatgaaataactttcgctgaatatttggtctataatactgttacatttcctctattattttaacatcttttgaaaaattcaaatttttactgttcattcacatatcattttaaattgaggtttagttcacatacgatgaatgcacagctcgtaggtatacagtttaacgacttatgacagtggtataaccacaagaccagcaacatttgaatctttccatcaccctagacagtttgccctgtgtcccattccagttaaattacctttcctacacacacaaaggcaactactgttctgatttttgacaccagagcttagaccaactattatttaacgtcatgtaaatgcaaatatgtagtatacaatcttctgtggctggattttttttcactcaacattttttttggagattccttcattttgttgcatgtatcagttgtcttattttgaattgctgagcggaattcccttgtatggatataccataatttgttcacttattttcctgttggtggatatttggattatttctggaatttggctcttaagaataaagctgctaggagcattcttgcacaaggcattttgagaacatattttcatttttcttgaggatatacataggaataggtttgttgggccatagaaaaggcatatatttaattttataagaaacagtttccaaagtgtttttccaatttactctcccaccaataatatctgaaaattccagttgctccacatctgcagcaacttcaccaaaaaatactgtcacgtttaaaattttgttcagtcattttaatgtcagatatttatatagcaattcaatattttactttatgatattatccatatttatcccattcacatcatttctctcaaacagtaactacaaggagattaaggaattatgctagaattttttatttatttatttatttatttttttagacaaggtctcactctgtcactcaggttagagtgcagtggtgcaatctccgctcacagcaacctctgcctcccaggctaaagcgatcctcccacttcagactcccaagtagctgggaacacaagtgcgtgccaccatgaccagctaattttttgtatttttggtggagacagggtttcaccatgttgctcatgatggtcttgaactcctgagctcaggtgatcaatccactcacctcggcctcccaaaatgctgagattacaggtgtgagccaccatgccctagaatttttttatgtgtcttctggggcatgtgcatatttaataaacgttcttatcatcattaaaacaaactgattatatacttagaattttcatagttactaagtgtataaatcatatgtgtcaggtaaatattttggggagacactttataatctcatcattatgcttgaattgtttcatttcaagccaacaataaactattcaaattcactcaaaattgggggtaaattaacttagaaatttctataaagagacggggaaatttcatataatgagataggaaatattaagtttaaatgcctcaaaagaatgttgcatattcctatagtacttctatagtctgcctgaactcatcatcaactttctcccttccagatgatgccaccagtccccatttctcaacacgtcatgaagggtccttccaagttcctgtcctgtgtgctgtaatgaatgtggtcttcatcaccattttaatcatagctctcattgccttatcaggtgggtctacacttcatcaattctttcaaagcctcctagctgtaagcattcatgcccagctgaaatcaatattagtttagtctagttaatcagaaactagctaattcagaatcatcccatgtaccatatatggccaatttcctaatcaatactaaacataattccacaatccttgaataattaatgtaatacttttataagtattaaaagtatctatgatttatatattactgtagaataaaattgcatttgaaaagatgtttacatctagaatgaagggagctgatttgaattctgaataaatacctatttagctagaaaaaaatgtgaacttcacattcattgattatggaaaaaaatcgtatctaaagccatagattaatcaggaagtggccagtcttttgtgttttatctcaaaggacacagaatggtagttctgaataattaagattatatttaaaagttcccagagagtcagtagtgatttggtattcaatacctccagctataccaagatatatttgtatcttttacaaatgggaatgtttaccattgttttgagatattctgagtcatatgtctttctgtattttgaattggttccctaaaagttagttactctctccatctttccagcctagtgctataaatactgcatcttcaaattcttccgcctctgcattcagattcaaaaccttatttgaaatgtataatgcactttatcctttctagtccaaagaaatatctagtccaaattttcagaattgttctatatttctgtcattttctgacattatgaccaaaagtacatcccctcatcctcatatctccatccaatgatgattaggcacaatggaagatcagatatggtcctgagaactttctttcttcatacccttttcagaattctactttttagcttttatcctttactttatcaccacctagcacaacatagcatcctaaggctagttttgcatgctgtgggtatttggtttcttttgttactaaaacaaagcatttttctgttcacagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatggtaagaataaaaaaaagataaaatactactattttaattcatatggctaatcagtgctttccttccgtttctaagtggagaaaacaaacaaacaaacaaacattgtacctatttcagatgtaggaaaatgtcatcccagagaaccatatgatcagcctgaggtcaaaatgagatttaatttaatcttttaaatttgatttgattgcttagcttcaaagaccagaaatccaaatatgctgatcctatatagaatgagtacatggtcagataagctgtcatgcctcaagttgcagcttttgagaaacaggatttactatctacttccccagaagggtgtttaatgtaacaaactcctttgtgctttctttaagaactttctaaaacgatacgcaggtagagaggaacactgggttggactgaaaaaggaacctggtcacccatggaagtggtcaaatggcaaagaatttaacaactggtaagtctccagaagtctctttatattccccagggtggcatctcaggaaaatcactttccttttctcctttcaaagcactttaaatataaaggctgagctcttcaagagctctaacaatctcttctgaatgcgtatactctggaattctttaataacaggctttattattattctttttctttatccacacttataatacataaaataaatgcttatagtaatttttctcagcaaactctaatgtgagtagtagatctggttaatttggaaatatttcaataataattatgatgatgcaacaaaaacccattttcaatgtcacatttagtctttactaataagacagttgctggaaaataaatccttcttactatttctcagttttcatctccacagaataaagaatagtttcaatgcctaattatgagtttctatacacctgaaagaaaatttgccccagaattagatactctattttcattacctttagttaaaatacatttaatgtttgaagatcattttataagtttgctgttgatcataatactgataaagtatcgagattaaaattcaggtttctagaaaagggattcctaatatttgtcctatggctccatatccacagatgggcttcaggagccataaaccccttaaagctgtatgcactagtatgcatggctgttgaatgcatataattttgtgaaattatttattgaaaaatctatgaactcagaaatgaccaagaatcacttatctggtgccatgccaaccaaatgaatggcgtgctttcctcttacttccatattttttctccacatcctattttttttcaattcttgtccattgtctctacagattagtctatgattatttgacttgtgtatcccactaagaatttaaaagaagcagaggtcaccatctccgagttcattctcatgtaactgaatgaaaacaatgagctgaaaataattctaagtttttttattgtttgacaggttcaacgttacagggtctgacaagtgtgtttttctgaaaaacacagaggtcagcagcatggaatgtgagaagaatttatactggatatgtaacaaaccttacaaataataaggaaacgtgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactattggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaatggtttccaagaaagttcattccttcaaaatacattaaaaagtatatactatatgagaaagcagaaaacagagttactataacttagaaaaaaatcccatgtagagtaaaacccttagttttataatagcttatacatatcaaattgttttcatatgcttatatgctaaagggtgtatgtatccatatccatttttctgtatatagcagatgctctgtaataattactcctcatagtcaatgctctgaaagtatcttgttcaattctgaggtgctatatacactttagttatttatgtaaaataattcaatatatagaaaagaggcataatcttcatgggatatttcaatcagcaaaaaactcaatgatgtagtttggatgtgtgtccctgcccaaatctcatgtcgcattgtaatcccctttgttggaggtggggcctggtgggaggtgattacatcatgggagcaaatctctcatgaatggtttagcatcatcctcttgatggtctccttgcacctgagtgagttctcaggagatctggtcttttcaaagtgtgcagcactttctctctctctctctctctttctctctctctttcctgctttctccatgtgacatgcctgctcccactccacttcaccttccaacatacataaaagctccctaagcttccgcggaagctgagcagtgtcagcattatgcttgtaaaaactgcagaaccgtaagccaattaagccttttttctttataaattacccagtctcagatatttttatagcaatgcaagaatagcctaatacatttgattaccttcaaaattgttttataaatgtaatttgcaatattcttctctgcttgttggaaatgtatgatgtgtatggtatctctaaactattggcaaacggcaaacagaaatgtggatttcagacactgcttagtgaaaaataatgacctctgtgctcctgagttcccacagctgtgggaaaaaagaaacaagcagcctcctagcggtaatattctatcattaccaacaatctactcccgagtcatcttagaaaacaatgtcttgcgattaatattttagttataacatatttttatgtgcataaatctaatcaaattatgaaaattgagagcaagcttaaaaatatttctatattagtatgacacaatttttaagtcattgaatactgactgtatcacctaacaattcaatgaattttatcatttttacaaataattttattgaatccctataattatgtgaaatgagcagctgatgtatttccctttccagaggaagaagttgaaattatgttgaaaaagcgacgcaaaacacggataacagagttattttttacacataatttgaagtcattttattcataaggacaactgttttctttaaatagataaaaaatatacaattcttaaagggaataatgttattatttaaagtatgactctacttgcaagtgaccaatgacaaatataaaaaatgggtttgtctcaagaacccctcctgcccccggctaagtcccctgttacaaaagttgcagtgccatctagtggttatacgagattactgcacttctgttttaaggatcctacaaaacatctatgtggagcgtggagctgctgagacccaaagcacgggggccagaccgcccgagtttcatctctgccacgcgcgggctgactagctattttatcagaactcgttcaaaattcagctaaaattagttagatgttaaattagttagtacatgaaaacaaacttaaaacattatctggctccctagtacaccataggcatgtattaaatactcatgatgattattagaactagaaacactatgtcttcaaacttccagtattggcataaagccgcgtttctacacgacatgtctatttctacgtaatatatcttatttgtatttgtttttggaaagccttttaaaaatttcatttcacaagttataagtaagcacctactac

SEQ ID NO: 12001 - DNA, 15914 bp, Human
ctggcgaggatgcggggcaactagaactcatacatcactgttgagaatgtgaaatggcacagaccctttgcaaattagtatgtcaatttcttgcaaatttaaacatgcactgactaaatggcccagcaatctcactcctaggtatttactcaggtgaaatgaaaatttctattcacccgaaaaaacatttgttgaataaattaatgaatgaataataaacgaatggagctatcataatgtaaaatgactagataatatctaaaattgctgaaacaaaaaaaaatataagcctatttttggaaaaaggaagtaactaccacaaggaatagttagaagagttaagagactgactctttaagcacaggacagatggtcaggaatggttaaaagggcctgctgcttttcattgaccttccagtactattgattttttttaactacgtgaatatattactttcataaaaatgtaaaaagaaaaagaggagtcagagaaagaaaatgaattgtcagaaaaatttagaagttttatcaactgaaatgcagaaaagataaattgtgcttgcatttcatttttgttgttcattccaaacatttatggattagactagctgaaatgaagtaattaagagactcaatagaaaacattgccaagaataaaaaataatttgaggaaaccatgaaaagtttacaggttactctgtcacaaaatactttgttaattcactaccccgcagcaacacacatcaccaaggctggcttctggaatgctttctacttgtagccatttttgaacaataggtgattccgcttttaacaacactgttagaatataatgtagcgagttttaccagagatgtttaagactacctggcacaagtaaatttcattgtatacatgtatatacacgagggagggtgatcatagtctagaaaaaaacaggtcttcagaagtctagaactttaataaccttaaatccaaattattccctgcgtccatccataatgagaaggaagaaatctacacttgcatttcttccacctttcacatctttctcatttaaatcctactgtacttgatttgtgttgttcccaacgtactaggtgctatgcatgacgtagaaacgtgtttccttatatgtatgtactagcaggctccttcaagcacatgcctaaggttgaaagattcaaatataattatagcctcttaaattattgcgtcagagcccgccctatcccctcagaaaaagcccccttttacaccatcaaatgaaatatcaggttatttgcactggatattttttaaaagaaaatatttgattttaaaatcaaagagttcttggttttccatcatttcactaattgtcttactagagacccgagtctcctttgtcaaaatatatttcagtacgcattttaaaaaatatgtgtgtgtgtatacttaaatatatatatatataaagtcttggacttattttcacctagcctggggcatatcgtggatagtttcaatcgacaaaacaggcactctctggcctaggagtggaatccatcctcaattttcgcaggctcctcacaattctctatttggaagaagtgtccctctccttcccttttcttttcctcctttactcagcgtcagtccccgcagccatgtcctccgaccctttttgtctacgtcccagcgtcgcgaaccacagcggcggaggtggagcggggagaggcgttaggccgggcggctaaaacgcgccgttaaagtgggggagagattgcgcggagcccacgcgatccctgggacgccggagacaacggggctcttgggaaggcgcggagcccggggaagccggggatgtgcgcgtgagccgtgcccgcagggtctccccgcctccgccacctttcttgggtggctctccgcctcgtcctccctccgagggccgttggtacattcctagtgactccaagcgcttaaaaggggcccgggaggatgaaccccacagatctgaacctgatttgtgtgtgcaccgcgtctccagcgatcccggatccactgcgctgccaggggcctgggggtgggtctcttgctgtctctgcgacgacatccttacgtttcggcactctaatgctgggtttgtgcgtgtgtgtctgcttagcggtctagcgggctgttaggctccctcgcccccagctccttggctcgctcagctcctccaccgcagcccagcagtgagacgcgcgcgcagccagctccccacgagatggaacagaccgaagtgctgaagccacggaccctggctgatctgatccgcatcctgcaccagctctttgccggcgatgaggtcaatgtagaggaggtgcaggccatcatggaagcctacgagagcgaccccaccgagtgggcaatgtacgccaagttcgaccagtacaggtgagcgcgctgcagcttcaatgccaggcggcgcccactcgccccgtctgaggaggaatggacgtgggggacgcagcccaaagtgactggctcgggaagctcgggccgcgctgcgtccgccgctcgccccctcgctggccagccgcggggctggcacgactcgcttggggctccgcggccacagcgcaggcggaaggtggatcctactggccttgctgacctccggccgggaacggcggacaggcgccgggaagggaggccaccgcgcgtctgcgagattttctgttctcttctctcccgcaaacccctctgcttctaaaccaccagtcctcctgcccctggcctcgggagcaatgcccacactcccaagccatcgttaaccccgggcgcggagatgcggagagaccgcactcaggttcgggccctcctgacaccttaaggaaccgtctggccggactagcagagggtgctcccaggggagcactacatcagccatcgggagaagtgtgtgatgttgaagaagacaagtcacccgcgtcagttctccatcactgcgccttcggtcgcctgcaaccgggcaccttatagcaagcatttttactcatgtaaaatagcgtcttgtggccgtcagctgccactacggaatttctgctgttccctttcccaaaccaatttaactaacttccccgactgtgggtttattcaaatccactgccaagtttcgcagattaaatattcgaccgtcgtttttttcagcccccaaatgatctgatttatcttatccttgcttctgacgatctgtaatgtaaattaaagacccctacttcccagatgtacttgagtgaggtgccctggtaagctggcttttttgcagccccggcttggtgattaagtcgaatctctctaccaatcctccggggccagaggtaaaatttaatcaccccgaagtgtgagaggttctactttttctgagcagttagtgcgtcagtctttgtggttttttgggtttagggttaggagaaaggggtaagtgaaagaaaagaataaggaaagaagtaagtttgtttttcttgggagcaggttcttttagtcactcttcaacatgtgggatgtttcgtaaagttttgttggcatgggcggtttcaactgtattttaggatttgaaatagaaaaagtgaagaccactaaggatcccatttttcatatacaagtgacttgaggaaattcctttggctcctatcagcttagttcatggtagagcccttctgtagccgtgaaagctagcagagagtctagcttttaaattttcttgcatttgctccaggtaattgaagacttgttatgggacaggtactcttccagacacttgacacatatgaggaatggcaggcaatgaagacgttgaatgacttgcactaggtcttctatcgatagcggctccaggctcccggggttagcattgttgttccagagcctacactctaaaccactgttaaaccaggacaggttgtaacagtttttaatctttaatctttagaacaagtgtattttcaaggaccttgaactagtctcgattgacaaactctaaagcttttgaagtgcaaccagctgggttgatcggtcttttcacagatatctgaggtacagctcattaacataatggatgtagtcccgagggggcagttgggggaagacaggagatgggagagaagtcaattctacagtattttttgcattaaataggtgcctagcgctgtgaaggattctgttctctgactttgggagggccagtgcagaagaatcaagacagaatatgctcccgtgtgggccaggctgtgaattctttgaaagaagctgcagagaagcaacaaagattatcctaagacttctggaggaagaattaggatccttctgcaggaactcagtttactgtgaattgaaggttgtgtacacagcttcttgttaggtcataaaggctacaaagtagggaaaactgaggctaaaaagcacttactaagtaactccctctaggatcatgctcttcggacacctcggggtggggaggaatgggacaggatggaaggggcatgctggacaagagttaaccgatgacgaagggaaaaaaaactcccaaaaaatggagtaaagaccccttttctttaacatgacagtctaaatgaatgtcataattatgaaactttgctaactagatgctgtcaacagtacaccttggaccaatagaaactttgacgttgattttgcttttttcacagtcgtggtcgtggtttgcagtttgttgttggtggtggcagtggtggtggttggttgtggtgagtgtgtctgtgtgtatgtgtttgccagttactggtttctcctaattgtaagaggtttagagggttctttacttcactaatgtagtcttctttgttctggtagttagatcagcccccacggtatttgtggaagacttttcattataagggcttttgaatgtggtttgtgtctaggctttagtaaaactaagaattctagaacagctatttaatgaaaccttgtttctcaagtcttgatttagctacaggcagaaaaaagaaaaaaaaaaaaacaatagcaacattcttgcctcaaccagtaatgcactttggaaatactttctctgagaaacttactccatcagtttgaggctgtcacattgagaaacatgcaatttcggtttttttcctgttatttttcccgtgccattaattaaaactgagcagctacctctgtaaatgcagcggttcaaaatgaactgtgaaaaaggatttttcatttgtgttggatttctaattagaaaactgcattcaaagttgcttagaggtggaaatgttaacatttgtgaataaatggtacttggtgacacacttattttttccagtgcttgtttcagcaacgaacttaaaacttctgaatatattgtttttttttaggtatacccgaaatcttgtggatcaaggaaatggaaaatttaatctgatgattctctgttggggtgaaggacatggcaggtaaaataactattcattcacagatatttattagagcatgttttctagcatatgaaaaatatagtaccaggctagccacaggtcttacaagtagtaacaaatctcatttttttttttttttttttttttttttgagacagtggttcactcttgttgcccaggctggagtgaaatggcatgatctcagctcactgcaacttctgcctcctgggttcaagcgattctcctgccttagcctcctgagtagctgggattacaggtatgcaccaccatgcctggctaattttgtatttttagtagagatggggtttcaccatgttggttaggctggtctcgaactcctgacctcaggtgatccactcacctcggcatcccaaagtgctgggattacaggtatgagccaccacacccagccctcattttctacttacttgttcacaatgttccctaatcccaacaaaaattatcaatggaattagcacagggcattcaggcatacactacacatattaaaaccagcccccaaaatgaatagtaaatcaaatgaggtaagtaacccccttaagttaaccatactctgttttctgtgcagtaaaactttatgtgaaattgtgtttacacttgacatttgtggtgtttgaggtgtgtaaacaatcgtgggaccaaagaccaaaggatggagatttgaagctagaaaagcattgcaaattcagaaaatttctttctacttcaagttaattctttagtttctttactgaaaaggcaacttatactgattctttgaaacttagctccttaatttatctttagtttcacgtttgacagtcttattatcaactaagtattactctcttttgaaacatacctttctcagtcttgagaatggtaaaagcaataatttagatccatttttatgaaagaaaacatgaatttataagtgtttggaaagttaggtctgtagagtgcatttatttactcatatggaatgaagtgtttccattcattctctcaatatttttgaaagcacattatgtccagagtgggactagactctgtggatttaggaaacaaattctttttatggtacatatataaattaataaaattcaatagatgaaatgaatacccaaaatgtatatagatacatatattttaattaaccctgtaaccacgactgcttcatatacttaaatactattcactctgagattgcataaataaatcctttgtttcctcaaatccaattaactttttcccaccaatgttggaaggtaatcacaggtagagcactgtaaattgacacaatgttaacattttatatacagtgtaactttaggatggtaatacacatatagataccttctctcccacagctccccaaaggaaggagaaaagacaaaagccttggggaaaaaacattaaatgttaagtggatcttctcagtgtggtacaattactatggatgattgtcttaatcctttctaaaatttctctaatgtactttcataatcaaattctagcccagtttaagtgagttatatgtatttgggggaagataaagtgttgctggttttgtgtttctgttatcaaagtagtataacaaagttaaaaaaactgttcattagtaggggtatgcatcaaaattgtaccttttatatgaattgatatagatgatatattattactttaccctgaacattgttgaactgtaagttgataacattttaaaaattcagctgaaatggattttggctggggagatagcttattgacagtatgcaggtgtcagttctgggaagactgttactgcaggtctggatactagaccatctactgagttcagttgtcattttgtgtacatatagcagtattcatgatcataccaactcccactgctttctgaagatgctacagggaaatctaaaggagacattatttgcctggcctgacaaaaaatccaatgagatggtcaagaagtctgaaagagtcttgagggaaaaccagtgtgcctacatcaatggtaacatcttattctttttctaagggcaagtgggaagaaccatgaccttttgtctgaaatattggttacttacactttttatgcagtagaacctggatcatgagtcatgatttaaaatacttgggaaatgacttaaacatagcaggttttgttttttaagcctttgtatcttggttggaatcacttattgaaaacatatgcatgcagatcagtatccactgaaaagtcatttacttgccaagacttaagacagttaaaataaaatatgaatttacttcagtggagtctttcaacaaaagagatcaagttggaaacattagccttgtgttagaaaatagaacaaaatgttctgtaactaattaagaatgctagctagtctctgtttttctaaaatacatatagcatacctaaaaagtatcctcgagggaaattttacaaagcacgttattggccagtgatttatacatatcttaccaagaattccttatcttttctaaatgggatatgggatagccaaatacttttcaagagaggcagtgattaatttccatattcctaaaaggaacagtaactttccaaaaagctcattaaaatgtatatgagacagatagatagttttttattcccttttacgtaggaggttgccaacacataggaagattaaacaatttgtccaaggttactcagcttttaagtggcaaccagaatttgaacctaagcaatttgattgaaaaacctatgttcttcatcagcatgtaccccacctatataaagtattatagagctttgggggatttttttttggcaaagcaagtttttttctccataaatcttactggcctcgatatttggcctatatacaagtcacttgcaaagatcaaattgtatgggaagttgtcgctcattcacataacacaaggatgttagtttcctatgtggcaggaagctctgattcatttacccaaataatgtgagggttgctatctataaggcacaccagatttccaagaaaattctgttgtctgtacattcacagtaaagctttcagaataatttcagaagtaaagcattcacacacctttcagaataattactttcagctggagtcagagtgcttgtgaaaatagatcagatctttaagaataggtaagctttttaaaggtcttcaatgcaaaaacctatagaatctcaacagataaggaagtggtatacatcagggataaagctgtggtgaggcctggtatgaactggagtatacaagcctcatattaaggtgacagcagtggccacccagctccagtgagatcaacctggtttctttttccatagaagttggaaattctgggttttatatgaaattttgccaattattaaaatattcggtgggatatgttaattatttctgtagactaattacccaaataacttaaaagccacaaattttcaacctctgattcttacagatgcaggagtaggggtggagatggatagtgatcagggggaaggatgttgcaagtacaaggaagagcacaagtgaaggtacaattgttgtaaaaaatggaaactattcaagcattgggggaaggaaagaaagaagaatgggtttggtcagtggattagcaggagagtaaagtgagctcagggtatgggcctgcaagaccagctaaaagtaaggactttctttggtcagcagagttataattgggaatatcttgatcgatttggtggcagcatgcaacatagggtggaggagaagggaggactggggcaaggagaccaagttgcctattgtaatgagcaaaaggtcgaccgggcctggacctaactctgcttcataaatacccccaagaaaagtccagtattactgtgacagagggtacaccatgaccataaaggaaaaagaagcaaagatcaaaatataataataatgcctggattattaataggagcttctctaaaggatgggtgtcttgtttttgcagggtctttgcttgcaggattgtcagcatgcattagatgatgcgtggacctgcagtgttgaacatttgttcaaaactgtgctttagccagtatattatgaacacaacaagctacaggatcaaagaatttgcagatctgagaattaggcaccagttttagaaataaggaaaatgaaagatcctagaatgtgtggcttgttcaaagatagcatcgctaattacctagaagtagaacttaagtcttctggttctatgcttcattcttctttatgatgtgcactcatggagctagatcataaagaagaaagcacaaagcctcatggggtgcctacattagttatgctaaattcattacttgattaatccctgaaactttcttgtaactgtgtaagtttattaacattttttaattgagtatttcatctcgtttttttgttttgtttgttttgttttgtttttgtgtgtgtgtgtgtttaatcttcttgaagatctctctcccagggcctcttgactgcttcagcacagattcgttgatctctaggccaggggtgagctgtgatcctgagattccttacaatgtaaggcttacattctctcaagctttccctttgctgtttcctgtggctggatcccctctttactgatctcatgattttttttcattcttggttgatgcccttgttttggtggagcatatgctccaatggctccacaagaaaggatccatggaaggtaaatttttgagaccccatatatttaaatatctctatattcaactcctacaacttgattgataatttagctgggttatggattatcacctgataaacatcttccctcagaaccatgagggtaattcctttgtcttttagtttctagtgttcttatcaaaagcctagggctggccgggtgtggtgactcacacctgtaatcccagcactttgggaggctaagatggaagaattgcttgagcccaggagttcaagaacagcctggacaacatgttgaaaccccatctctaccaaaaatacaaaaattagctgggcatggtggcaggtgcctgtagtcccagatacttgggaagctaagtgggaggatcacttgagcccgggaggtggaggctacaatgagccaagatcccactgctatacttcagcatggacagcagaatgagaccctgtttttgttttttttgtttttttttaaaaaaacctggtcccattctgatttttgaatctttctattttctttctagaaacttttgggatcttctcttttggtgccttctctctatcctcagtattctgaaatttcacagtgatgtatcttgtttgatgactcattcattgtgctgggtactcagtgggtttttaaatctgggaattcgtgtccttcgactcaggaaaacattaacaggttatttctttgaatttttttttaattctgtttctgaaactcctatttagatattaaacctcttgaactgttcctcttttttttttttctctttcttttctattttctgtctttgtccttttgttctttgagtcttcctcagcatttcctgccaacccttttctggtttctgtttcttcaacctctttttgttttatggtcccttttatggtattttctcttatttctaggaaaacattaatgataggtttttgaacacttcccctgagtagtctctgttgcaggttgcttttttgtttgctctgccctctgtctttcatactagaggccttgctcaaatgtctggtgaccttggcaatgtgctaatatttaaaaaccaagaacaaaaaaattaattggtaaccctgaacatgagtggagcttgtcaactggatttcactttttgatagtctggcagagactttttcttcaggaacttccagcgacaatatctttaaagcttttttcttgagccaatcagattctctgagaagttgcttcctatcttctgcctggaaagaaaaatcttgtctggcagcattctcgcagctaggtgatgactaaagcagggatttttaccattcagtatggaagcttttgtttaattcacctgtttttcacctgatttccatcagtcccaagttgatctcttacactctttctagagactagaccttagtctgctgctgaaaagaaagaagagagagaattggtaaaagggttttgagactctacttcataaacaagctttaaaccagttcttatatctacagcctatctttaccctcatttccagaagtacctggtgctgtcaattcctgtgctatttggagtttcaagatataaatcaggttatttcttggttttctccatggatagcttaggatttagctttctctgctctgtaaagctatccatcttactttctaagctttcaaatttttgttagtgttttctcttttcctattttgtctttgtatattgatgtcttttttatttttttactgccattggagagggttttcaggaaggagcagaggctaatgcatgcgtgtcacttactatctttaactgcaagttcaattctaattaatatctattccatttgcatcacaattgattcatgatctcagatgactcacagagattttacctacagctgttatctaggctcctttatctatttttccttcccggatattgtttagattccattggcttacatcgagtagagaacatcagccatacggaacctgctgtgagccttcacttgtacagtccaccttttgatacatgccatgcctttgatcaaagaacaggacataaaaacaaagtcacaatgacattccatagtaaatttggaatcagaactccaaatgtgagtataatttcttctaggtttaaatgctctgtaggttggcactgttacactgcatgtatgcaaagaatgagatgagtcttaattcatggataaggcccaatatatcttgattgttttatttaactttagcgactatcttttcaatttatttttaaaaacttattatgttagatccaaacattagttgagaaatttcaaaatgtatgcttgtttttaaagaaaatgttttcatttacttgggaaatgagagtgaaaactattatttgatataactgttactgccatgacttactatgcataggtctaatttgctgggccaacagggataagttgcataattaacctttgtaaaggttattctgatgatataactaaagcaaattgtctgttttgtttgccaatgttgcttattcttagagttgttatgccatttataccacaaataagaatagactatactaacatgttcctccttgagaaacaagcatttcctactaaaaataaaaaggcaaccaacactaatatagcagggcagtcttctacctctgaaataagtttgtcatttagaggaatagtctttaattatcagaatatccagaaatagacaatgtgtgaaaatggagaccaaagcaatccttgagtcttaatgaaagcgcagcctctgagggaagccagggcagaattttctcattatcgctccgcttcatctttatcttccacattccaaaccctaagagatattcttattgcgggaaaaacaacaaggctcccttgcccttgctgagttttcatacactgctacaaaagcagaactatttagaaggagttaaaatgtcttttgtaaagtttcttacacagctttctttttttcccttttttacaggcaacttcgggctcgctggagaacaactaaggggcaccaaaccctctgaggttttactttaaggttcgctgtatgtttgccttggacaaaaaggctacctaccacgtgctatccagtaatatacttaaataagccaatacttagatctactgtaaggcagatgctaattataaggcattaagtaagcaaatagtgccctcagctactgcagaagaaaagtcccactgaggaaaagaaagtcttgtgatttttaaaggcaagttttcaagtgctctcatagttctatcctctaattccattaaatccatactaggagcgtcagtgagggttttcatagcttttggaaatactttggtctctgaactgtaattagcaagaagtaaaaacagaaacgtcaaacgtcaaatgtttgctttgttacctggaggactaaatgtagatgtctttagtatactttgtatgttcttaatattggaagataattttgtgaatctgtagattttattttttcagtcttaccttacaaatttcttttctatgaataatagaggaacttacggcactctgccatttgttaatgaaaggaagtgcagaggatttagaaaagtacatgatccccagaccacaacaaaccaaaacataaactcatgtctgtgtcccatggtcatagtcaaagattttgtactgctaaaattaccaaataatttaaataaagtggatttgaacacaatttgaaggtgtctttctgattaacatgatagaaacttcacataaatcagtttcttagatctagatatacaaaagcactgtgacaaatggttttttttttttttttttttttttttgagacagagtctcactctgtcgcccaggctggagtgcggtggtgcaatctcggctcactgtaagctccgcctcccgggttcacgccattctcctgcctcagcctcctgagtagctgggactacaggcgcctgccactgcacccggctaattttttgtatttttagtagagacggggtttcaccgtgttagccaggatggtctcaatctcctgacctcgtgatttgcccacctcggcctcccaaagtgctgggattacaggcgtgagccaccgcgcccggccattttttgtatttttagtagagacggggtttcaccattctatggtctcgatctcctgacctagtgatcggcccgcctcggcctcccaaagtgctgggattacaggcgtgagccaccgcgcccagccgacaaatgcttttatgatgtaagaatatgagagagccaaaaaacattcaaaaacaacttaacctttttggacttaatatcttcactaattggtcagagacaccaatctgagagcctctggctgtagtgtggctcagacgtggtcagttttgcctggaaattgtgtgtctatatctgtatgtgtttaaatgtggattggttttcgacatttaaaaactggagatttcatagaagttgagggattctagctgctcaaaatttgaattatctagaacacttggtctgcactgcatttttattggtattagttggctaggctggggtttgcctcttaaatgggtcggccccccgatctgctgcagtcccaaactcacctatttccattatttgttacctgcaaagcctgcatgtgcattcgagtttgctcttcctgctctaagcaacttcttaaggaatatctgtcataatcttagagctaattaattctgggaatttagttagcaaagtcctttaaaaatagtttctgtgtagctcattggttatattgtttatatatctcatattagtatttacatgttagcttcctctctcatcctttggaaagatattaacacttatcgaatgcttactatgtattaggtattgttataagttgtttgagcctactaatagttctgaaaagtaaccttaatgaattggtatatttctgctgctgtatatagcacattatcacaaacgtagagggttaaagcaatgcagatgtattattctatagccctgcaggtcagaagtctgtttcgcagcactagaatcagtattgtaagggctacactcctttctgtacgctgcacagtatctgttttcttgttttgtgggtttctttttccctcagctcctaaagactgtccagtattccttgacttgaacatccttcctccatcttcaaagccagcaatggcggatttagtccttctacatctcatttacttccctttttttctttgaggaactagacaatgtctccatctcaagattgtatccttaatcacatctgagaagttgttttgtttttggccacatgaaataacatttctaggttctgagtattagattgaatgcctttggaaggcctttctcctgatcacagagttacatcccatcacaatatcaactcagaagtccaaaacccttatccatatatcattatctaaattaggtatgagggaggctctttttaccatccatcctagaacacaattcctctttctatatacacatattcagcatggttaagaaactcgccaaaaggtatctagccaaaatattacagagctaggattgaagccaggatttgatctcaagcaatcatcctctaaaactcattctctttatatttaggcctttcaaggtaaaagaaggctgggccacttctcattttttttgtatcccattataacaaaaagcaaaattatggtat

SEQ ID NO: 12002 - DNA, 6531 bp, Human
tctgtcaccctggctggagtgcagtgccacaatcatggctcattgcagcctgggcctcccaggtgcaagcaatcctcctgcgtcagcccccaagtagctgagactataggtttgtgccactatgcccggctaattttttttttttttttttttttttttgagagatggggccttcctatgttgcccgggtggtctcaaactcctgtgctcaagttatctgcccgcctcagcctcccaaactgctaggattacaggcgtagcccctatgcccagcctctgtttttttctttggactcagcctcagccagatctcccctgggcttgcaacacaaggcccaaaacaatagaagagaagtgaggggagttttccctttactacctagcatgtaaatgaggcctaaagtagactaaggaagggagagtgtgaagggagagtgggccagagctggggttgtggtgaccaactcctggggcctggggggagtttgtgtaggggagggggagggagtggcagggaatcaagacttaatggatgaattctagggcagccccagaggttacatacatggctgtggcttcagacagacctggattcaaggtcaaatgagactggctccaccatttacgaccttagcaagtcacttaacatctaagcctcagttttttcaccagtcaaatggggataaacataacacctgctgcagggcaccacagagggtatcaagtgagggaatgcataaagcatggagcactatccaggcagctgtgggattcctctcatccccccacccctccctgggccctcacagccactctctcaccccagtccccttccactgtagcttagtcacccacttgtcccttccctcgctcccctcccattcatcctcagctaatacaaacaacccatctgcttgctactttctctaccaaaatcacaaaattctaggtcttggctgggcgcggtggctcatgcctgtaatcccagcactttgggaggccgaggcaggcggatcacttgagatcaggcattcgagactagcctagccaacatggtgaaacccagtctccgctaaaaaaaaaaaaaaatacaaaaaattagccaggcgtggtggcacacacctgtagtcccagctatgcgggaggccaaggcaggataattgcttgaacccaggaggtggaggttgcagtaagccgagatcatgccagtgcacagagcaaaactctgtttaaaaaaaaaaacaaaaaaaccaacaacaacaaaacaaaacactaggttttaacaaacttcagaaataatctatttcagtcttcccagttccttgaaatgaggaactgaggcctagagagggaaagcccaactgaaaccaggcttaccgattcctcacctccagcaccttcacagaaatccaccaacccttccacaatctaaacatttcccaagctttcattcagaacctgcagcccatctacaaccttcccttgaaacataaatctatcccagcccttctccttcagctcctataccctgccccaatcttctttaaacaacaaactcatttacggaatatctgctatgttctggctctttttagattggttattattacatgtaatccggcagttcttttgttaaagggtcagagaggtagagtttctggcccagggtctcagagctggtcagtgattaaaccaggattcagcctgcaggatgcatgattccaggcctcgggccctacttactcccaccgttgcctctggattgacctctctcctatcttgtacgatctagcctgctcccccagccagggccttagaacctagagcctggtattatccacccccagatctgcagaaaggaagccacacccctcctccaccttgtaagccctccttcctctccctacctcaccccgcctcctctgcctcctggttcaaaagcagctaaaccaaaagaagcctccagacagccctgagatcacctaaaaagctgctaccaagacagccacgaagatcctaccaaaatgaagcgcttcctcttcctcctactcaccatcagcctcctggttatggtacaggtaagagcaacgcctggcaccactgccaggactccccaaagttgcttggcatggagggagggcatacaggatgtgagctcccagagacccagccttctctcctgagagcacagcagatggactccaacaggaaaactggggacacagcgggcctggccgcccagccttccagctcttctggctggggctgcactgcttgcgggctgccctgagagaaacctgtatccacagctggggagcacttacagggtgctaggcgcgttggggcacccaaggggtgttgtggaataatagagaactaagagacttgggaagacaaccctgagtgaggaaggcatcggcccacagggagtctggggagatggtcctttggggagaggccaggagatgtccaagtggagcctgctgtggttatggaggtgacaggggacactctaacccccactcccctgccagagagaagcctggatgttcaggaatgcaaagaagacaggactctcccatttcagaaacaactggagtctcaaaagcgactgctattccaggaggcagctttggtagcatcccaggtgcccagaggggagtcagtacagcagaccggagccatcaagttcttgatcaagaacagcttgatcaccatcaaaaccagcttaatctccatcaagaacagttctagttgcagctccatcaagcattaaggacagctcgatcaccatctggccacttccccaccccacatccagccacccacgctttgccaagtgctttctcactcagccctggctcatgtgaccttcacaactgtgatgaacttctccccactcagaagatgaaactgaggctcagggaagctaagccctttgccaggctaggaaggtcaagggccagggctcccctgtctccctctatgccagaagggctggtcgctggggaaaggtgaaaagaaaggttctgtgaccgggcacggtggctcacgcctataatcccagcactttgggaggccgaggcaggcggatcacctgaggtcaggagttcaagaccagcctggccaacatgacaaaatcccgtctctactaaaaatacaaaaattagctgggcgagccgggcgcgctggctcgcgtctgtaatcccagcactttgggaggctgaggcgggtggatcatgaggtcaggagatcgagaccatcctggctaacacattgaaacctcgtctctaccataaatacaaaaagaaattagccgggtgtggcgtggtggcaggcgcctgtagtcccagctactcgggaggctgaggcaggagaatggcgtgaacctgggggtgaagcttgcagtgagccgagatcacgccactgcactccagcctgggcgggcgacagagcaagactctgtctcggaaaaaaaaaaaaaaaatagctgggcgtgatggcggctgcctataatcccagctactcgggaggttgaggggtggaggttgcagtgacccgagatcatgccacttcactccagcctgggcaaaagagcgaaactctatctcaaaaaaacagaaagtttctgtgaaagggggtgggcaggggcagtgatcacctctgtccctgcctgtgtcaaagcaggaagcagtcaaacatcctgacaggaccttgtggaagaagtagtggtcacatggggcagaactgaggactgttttatggaggtgggcggatggagggcggggagggtagaaaggggactgcatctttaaataacaaacacgctattcaaaagtcccctgagggctgggtacgatggctcacacctgtaatcccagtactttgggaggccgaggcgggtggatcaccaggtcaggagttcgagaccagcctgaccaacatggtgaaaccccgtctctactaaaaatagaaaaattagccgggcgtggtggcacgtgcctatagtcccagctactcaggaggctgaggcaggagaatcacttgaacccgggaggtggaggatgcagtgagccgagatcgcatcactgcagtccagcctgggtgacagagtgagactccacctctaaaaaaaaaaaaaaaagtcccctgatcttatcccacttctcctcctacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggtcaataaagttacccttgtacttgcagtggggtcctgcttgtggttactggacatccctacgccccaagagccagctgtgcagcagcaccagggagtttcccatgtccccatcagcagggaaattggcaccagggagcagcccccagcttccccacctaaattccaatgctgagggcccttccccttagaagcacattgcagggacaaggcccagaacctggcagcctcaccaaccctgcagttgcgtttgcttcatccatccctgggtgtttgggaatgatggtactagagatgccaccaccctggacatcccaggctcagagagcccctaccccactacctgggtgtcttcagaatgacagatccagggaaatccccagtcccagggacacccctcaacaaggtatttagatccccagcaaaccagccccacaggcatctggggctggagaaggatgatgggtggctgtctacctcccacgctggcccaggggctgggaaggcaggaagggcaagcagctgctctgaccactcccaccctcctgggcttgaggcatcggaggtgggtgctgcagagatggaagggagccccagggcaccccccaagggcccctcccaccttggcttcttccttgaggacctccagggacagagggagctccctctcttctatgtcctgccctctctgagctgggttagagacctggatgccctgtcctggcttctctaagaccagagttggggtgagtgcagcagagccctgggggcacagcccttcagggtgtggctcacactcatctcccatgcctggcccactgcacccccatcacactaacctccacgttttcaccctggacttgtatgcatccctagaatattctttctctgcctcctggagcctggctaactccccaccctaatatctcagctgcaggtccctgacgtgtgcagagagacatctcagcctgccctgcacttgtgggggtgatgttcctgctgtgtgagtccctctacttctttcctcccttctcatggatgcatcactctacctgtcaggatcctctgtgggactgtgcgttccctaaggacagggaccgaaaggctcagtttgtgtctgtgcccgcacagcctagggccccacccggctcagagcctgctctcacaacacttcatttgggtggctgcgcgagactacactccccagttagtctggtcccagggcgccctctgatggcagaaggaggcctaacatctgaacccgaaagctggggcctggagggaagaagccagcctgagcgtcagggaagaaggcaagtgaacaaatccccaccccaccccgaaatatcaaggtgcacagagacaagggtacctggcagcatattagaaaatagcttatgttacaacaaaaaccctataaaaacattcatcccagcaaaagcctccagggctggagggtgaggggaaaagtttcaaagcacgtggatagtccagatctgggatgccctgtcctcatccggctcccatagcaccacgtggtcccggtcgtagccccggcctcctgcgggtgggatggggattaaaagatagggagatagtcagagagagctgggactccatggctctcagccccctcaggagccctcttccccatacatcccaccttacccttcacgtccaggatctggccttcgaacatctggctgcagatgtggcccgattcactgatgctccacgtctggcgcggcaggcggctctcggcccacagcaccaccttggagcctgggctagggggtccaatcacctgtaggctcatggtgggggccatctgaggccccaggaggtcatcaggcattgttcctccccacagggactctactgtacccaagaaacccttgacccatctgctctgaatcctggctcttagggactgtggccctgggcaagtctcttaatcctcctcagcttcagtttcctctcggggatgggaatccccaaatgctggcttttgtgagggttcagtgtgag
